United States Patent 11,931,406 (FLAVIVIRUS VACCINE) - sequence listing, part 51

SEQ ID NO: 18608 - RNA, 9879 nt, Artificial Sequence
  derived and/or modified CDS sequence (opt5) from DENV-1__GQ868506__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgccuuuuuccuggcgcaugccauugggacaucuaucacccaaaagggaaucauuuuuauccuccugaugcuugucaccccuagcauggcuaugcgcugcgugggcauugggaacagagauuucguugagggacuguccggcgccacauggguggacgucgugcucgagcacgggagcugugugacgaccauggcuaagaauaaacccacacuggauaucgaacugcucaagaccgaggucacaaacccugccauucugcggaaacuuugcaucgaagcgaagauuucuaauaccacgacagacucccgcuguccgacccagggagaggccacccugguugaagagcaggaugcuaacuuugugugcagacggacauucguggaccgcggcuggggcaauggguguggacucuuuggcaaagggagccugcuuaccugcgccaaguucaagugcgucacaaaacuggagggaaagaucgugcaguacgaaaaccucaaauauucuguuaucgugacgguccacaccggcgaucaacaucagguggggaaugagacaaccgaacacggaacaauugcuaccaucacgccccaggccccuaccuccgagauucagcugacagacuacggcgcccugacccucgacuguagccccagaacaggccuggauuuuaacgaaaugguucuucugaccaugaaggagaaaucuuggcucgugcauaagcaaugguuccuggaccuuccucugcccuggacguccggggcuagcacaucccaggagaccuggaaucggcaggaucuccuggucacauuuaaaaccgcgcacgccaagaagcaagaaguggucgugcugggaucucaggagggcgcuaugcacaccgcccucacaggggccacggaaauccagaccagcggaacaaccacaauuuucgcuggccaucugaaaugccgccuuaagauggacaaacugacccucaaggggacguccuauguuauguguacaggcagcuucaaacuggagaaggaaguggccgagacccagcacggaaccguccuggugcaaguuaaguacgagggcacagaugcgccgugcaaaaucccuuuuucuacccaggacgaaaagggggugacacagaacggaagacuuaucacggcuaaucccauugucaccgauaaagagaagccugugaacaucgaaacagagccccccuucggcgaguccuauauugugguuggggccggagaaaaagcccucaagcugagcugguuuaagaaaggcucuagcaucgggaagauguucgaggcuaccgcccggggcgcuagacgcauggccauucugggagacacagcgugggauuuuggcuccaucgggggagucuucaccucugugggcaaacucgugcaucaggucuuugggacggccuacggagugcuguucagcggcguuuccuggaccaugaagaucgggauuggcauccuucugacauggcucggacugaauagccggucuaccucccugagcaugacauguauugcugugggcauggucacccuuuaccucggggugaugguucaagccgacucuggaugcgugaucaacuggaaaggcagagaacugaaguguggguccggaauuuuugucacaaacgaggugcacaccuggacggaacaguauaaguuccaggcugauagcccuaaacgccuguccgccgcgaucggcaaggccugggaggaggggguuugcggcauucggucugcuacaagacucgaaaauaucauguggaaacagaucagcaacgagcugaaucauauucuucuggaaaacgacaugaaguuuaccguggucgugggagacgccaauggcauccucgcucaagggaaaaagaugauucgcccgcagcccauggagcacaaauacuccuggaagucuuggggaaaggccaaaaucauuggcgccgauauccagaacaccacauucaucauugacgggccugauacccccgaauguccugacaaucagcgggcuuggaacaucugggagguggaggauuauggauuuggcauuuucacgacaaauaucuggcugaagcugagagacagcuacacccaaaugugcgaucaccgccuuauguccgcggccauuaaagacagcaaggcuguccaugccgauaugggcuauuggaucgaaucugagaaaaacgaaacauggaagcucgcccgggcuuccuucaucgagguuaagaccuguacauggcccaaaagccacacccuguggucuaauggggugcuggaauccgagaugauuaucccgaagauuuacggaggcccuaucagccagcauaacuauagacccggguacuuuacgcagaccgccggaccuuggcaccucggcaaacuggagcuugacuucgaucugugcgaagggacaaccguggucguggacgagcacugcggaaaucgcggccccucucuccggacaaccacgguuacaggcaagauuauccaugaaugguguugcagaagcuguacccugccuccccugcgguuucgcggggaggauggaugcugguacggcauggagaucagaccggugaaagaaaaggaggaaaaccuuguccgguccauggugagcgcggggucuggagagguugacuccuucagccucggcauucuguguguguccaucaugauugaagaggucaugagaucucgcuggagccggaagaugcugaugacagggacccucgcuguguuucugcuucugguuaugggacaacucaccuggaaugaccugaucagacugugcauuauggugggcgccaacgccuccgaucgcaugggcauggggacaacguaucuugcucugauggccaccuucaaaaugagaccuauguuugcggucggacuccuguuccggcgccucacaucuagagaggugcugcuucugaccaucggccucagccugguggcuuccgucgaacugcccaacucucuugaggaacugggggacggacucgccaugggcauuaugaugcugaagcuccugacagaguuucagccccaccagcuuuggaccacgcugcucagccugacauucaucaaaaccacccugucccuugauuacgccuggaagacaaccgcuauggcccugagcaucguuucucucuuuccucugugucucuccacaacgagccagaaaaccacauggcugccggugcuucuggggucuuucggaugcaagccccugaccauguuucucauuacagaaaauaagaucuggggccggaaauccuggccucugaacgagggcauuauggcuaucgggauugugagcauccuucugucuucccuccugaagaaugacgucccccucgccggaccucugaucgcgggcgggaugcuuauugccuguuaugugaucagcggauccagcgcugaucugucucuggagaaagccgcugaaguuagcugggagcaagaagccgagcauuccggcaccucucacaacauucucguggaaguccaggacgaugggacgaugaagaucaaagacgaggagcgcgaugacacccugacaauucuucugaaggccacccuccuggcugugagcggaguuuaccccauguccaucccugcgacacucuucgugugguauuucuggcagaaaaagaagcagagaucuggcguccugugggauacccccagcccgccugaaguggagcgggccguccuugacgauggcaucuaccgcauucugcaaagagggcugcucggacggucccaggugggcguugggguguuucaggacggagucuuccauacaauguggcacgugacgcgcggcgcuguucugauguaucaggggaaaagacuugaacccucuugggccagcgugaagaaagaccugaucuccuacggaggcggcuggcgguuucaagggagcuggaauaccggagaggagguccaggugauugccguggaaccuggcaagaaccccaaaaauguucagacaaccccggggaccuucaagacaccugagggagaagucggcgcuaucgcccucgauuuuaagcccgggacgucuggauccccuauugugaacagagagggcaaaaucgugggccuguacgggaauggagucgugaccacaagcggcaccuauguuucugcgauugcucaagccaaggccucccaggaagggccccuccccgagaucgaggacgaaguguucaaaaagcgcaaccugacaaucauggaucuucacccuggaagcggcaaaacccggagauaccugccggcuauuguccgcgaggccaucaagcggaagcugagaacgcucauucuggcgcccacacgcgugguugcuuccgaaauggccgaggcccuuaaagggaugccuauccgguaucagaccaccgcugugaagucugaacauacaggcagagagauugucgaccugaugugccacgccaccuuuacaaugcgccuccugagccccggacgggugccuaauuacaacaugaucaucauggaugaggcucauuucaccgaccccgccuccauugcggccagaggcuauaucagcacgcggguugggaugggagaagcugccgcuauuuuuaugacagccaccccuccgggcucuguggaggccuucccccaguccaaugcugucauccaagaugaagagcgcgacauuccugaaagaagcuggaacucuggguacgauuggaucacagacuuucccggaaaaaccgugugguucgugccuagcaucaaguccggcaaugauauugcgaacugucugcggaaaaacgggaagcgcgucauccagcucucuagaaagacguucgacaccgaguaucagaaaacaaagaauaacgacugggauuacguugugaccacagacauuagcgagaugggcgccaauuuucgggcugauagagugaucgacccccgccggugccuuaaaccggucauucugaaggauggaccugaaagagugauccuggccggccccaugcccguuaccguggccuccgcugcccagcgccgggggagaauuggacgcaaccaaaauaaagagggcgaccaguacgucuauauggggcagccucucaacaaugaugaagaccacgcgcauuggacagaggcuaagaugcugcuugauaacaucaauacccccgagggaaucauuccugcccuguucgaaccggagcgggaaaagucugccgcuaucgacggcgaguacagacuccgcggggaagccagaaaaacguuuguggagcugaugcggcgcggcgaucugcccguuuggcucagcuauaagguggcguccgagggauuccaguacagcgacagacgguggugcuuugauggcgaacgcaacaaucaaguccuugaggaaaacauggacguggagauuuggacaaaagaaggggagagaaagaaacugcggccuagauggcuggacgcccgcaccuauucugauccccucgcucugcgggaguucaaggaauuugccgcuggaagacgcuccgucagcggcgaccuuauccuggagauugggaaacucccucagcaccugacccugcgggcccagaaugcucucgauaaccuugugaugcugcacaauuccgaacagggaggcaaggccuacagacaugcgauggaggaacugcccgacacaaucgagacccucaugcugcuugcccugaucgcuguucucacaggcggggugacgcuguucuuucugucuggaaagggccucgggaaaaccagcauuggacuucugugugugacagccuccucugcucugcucuggauggccagcgucgagccgcacuggaucgccgcuuccauuauccuggaauucuuucuuaugguucugcucauuccugagcccgaucggcaacgcaccccucaggacaaccagcuggcguauguggugaucggccugcucuucaugauccuuacagucgccgcuaacgaaauggggcugcuggagaccacgaagaaagaucucggaauuggccauguggccgccgagaaucaccaacacgcuaccaugcuggacguugaucuuagacccgccagcgcguggacacuguacgccguggcuaccacagucaucaccccuaugaugcggcauacgauugaaaacacaaccgccaauaucucucucacagcuauugccaaccaggcggccauccugaugggccuggacaagggguggcccauuuccaaaauggauaucggagugccgcuccuugcucugggcugcuacagccaggucaauccucugacccucaccgccgcugugcugaugcuuguugcccacuaugcuaucauugggcccggacugcaggccaaggcgacacgcgaggcccaaaagagaacggcugccggcaucaugaaaaaccccaccguggacgggauugucgcuaucgaucucgacccugugguuuacgacgccaaguuugaaaaacagcugggacagauuaugcugcucauccuuuguacaucucagauccugcugaugcggaccacaugggcccucugcgaguccauuacccuggcgacgggcccgcuuacaacccugugggaaggcagccccgggaaguucuggaauaccacaaucgcugugucuauggccaacauuuuccgcggaagcuaucucgcuggcgccgggcuggccuuuucccugaugaaaucucucggaggcgggagacggggaaccggcgcucaaggcgagacacuuggggagaaguggaagcgccagcugaaucagcugagcaaauccgaauucaacacguacaagagaagcggaaucauggaggucgaucgguccgaagccaaagagggccucaagagaggggaaaccacaaaacaugcggugucucgcggaaccgccaagcugcggugguuuguggagagaaaucuuguuaagccugagggcaaagucauugaccugggguguggacgcggcggcuggagcuauuacugcgcugggcucaagaaagugacagaagugaagggauauaccaaaggcgggcccggacacgaggaaccuauccccauggccacguacggcuggaaccuggucaagcugcauuccgggaaagauguuuucuuuaugccuccggagaagugugacacccuccuuugcgauaucggagaaucuagccccaauccuacaauugaggagggccggacccugagagugcugaagaugguggaacccuggcuccgcggcaaccaguucuguaucaaaauucugaauccuuacaugcccuccgucguggaggcucuugaacaaaugcagcggaagcacgggggaaugcugguuagaaacccgcucucucgcaauagcacacacgagauguauuggguguccugcggcaccgggaacaucgucagcgccgugaacaugacaucucggaugcugcugaauagauuuaccauggcgcaucgcaaaccuacguacgagcgggacguugaucucggagccggcacaagacacguggcugucgaacccgagguggccaaccuggacauuaucgggcagcgcauugaaaauaucaagaacgagcauaaauccaccuggcacuaugaugaagacaaucccuacaagaccugggcuuaucacggaagcuacgaggugaagccuucuggcuccgccagcucuauggucaacggcguugugagacuucugacaaaacccugggaugugaucccuauggucacgcaaauugcuaugaccgacacaaccccguucgggcagcagcggguguuuaaggagaaaguugacacacgcacccccagagccaagcggggaacaacccagaucauggaagugacggcgaaauggcucuggggcuuccuguccagaaauaagaagccucggauuuguacccgcgaggaauuuacaagaaaaguccggagcaacgccgcuaucggggccguguucguugaugagaaucaauggaacuccgcuaaggaagccguggaggacgagcgcuuuugggaucuuguccauagagaacgggagcugcacaaacagggaaagugcgccaccugcguguauaauaugaugggcaaacgcgaaaagaagcucggggaguucggcaaagcgaagggaagcagagcuauuugguacauguggcugggcgcccgguuccuggaauuugaggcccucggguucaugaacgaggaccauugguuuucucgcgaaaauagccuguccggaguugagggcgaagggcuucacaaacugggauacauccucagagauaucucuaagauucccggcgggaacauguaugcugacgauacagccggcugggacacccggaucacggaggaugaccugcagaaugaggcuaaaauuacagaaaucauggagccugaacaugcccuucuggcgaccagcauuuucaagcucacauaccagaacaaagugguccgcgugcaaagacccgccaagaacggaaccgucauggaugugaucucccggcgcgaccagagaggcucugggcagguuggaacguauggccugaauaccuuuacaaacauggaggugcagcugauccggcaaauggaaagcgaggggauuuuccucccguccgagcuggaaaccccuaaucuugcugagagaguccuggauuggcucgaaaagcacggagccgagcgccugaaacggauggcuaucucuggcgacgacuguguggugaagcccauugaugacagauuugccacagcgcuuaccgcccugaacgauauggggaaaguucgcaaggacaucccucagugggaacccagcaaaggcuggaaugauuggcagcaggugccuuucugcucccaccauuuucaccaacucauuaugaaggacggacgggagaucgucgugcccuguagaaaccaggaugagcugguuggccgcgcucgggugagccagggggccggauggucucugagagaaacagcuugccucggcaaguccuacgcccaaauguggcagcugauguauuuccaucgccgggaccuuagacuggcugccaaugcgaucuguagcgccgucccgguggauugggucccuaccucucgcacgacaugguccauucacgcucaccaucaguggaugaccaccgaggacaugcucagcguguggaaccggguuuggaucgaagagaaucccuggauggaagauaaaacacacguguccucuugggaggagguccccuaccuggggaagagagaagaccaguggugcggaagccuuauuggccugaccgcccgggccacaugggcuacgaacauccaaguggccauuaaucagguuagacgccucaucgggaacgagaauuaucuggacuacaugaccuccaugaaacgguuuaagaacgaaagcgauccugagggcgcgcugugguga

SEQ ID NO: 18609 - RNA, 9879 nt, Artificial Sequence
  derived and/or modified CDS sequence (opt5) from DENV-1__GQ868507__SS-prME
agcgugaccaugcugcucaugcugcuucccacagcucuggcuuuccaccucacgaccagaggcggggaaccucauaugaucgucuccaagcaggaacggggaaagucucugcuuuuuaagacaagcgccggcguuaacaugugcacccugauugcgauggaccucggggagcugugugaagauacaaugaccuacaagugcccccagaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagaacaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccgcccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaaacuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucgugaugggacaacugaccuggaaugaccugaucagacuuugcauuaugguuggcgccaacgcuuccgaucgcaugggcauggggacaacguaucuggcccucauggcgaccuuuaaaaugagaccuauguucgcugugggacugcucuuucggcgccugacaucuagagagguccuucugcucaccaucggccugagccugguggccuccguggaacuucccaacucucuggaggaacucggggacggacuggccaugggcauuaugaugcucaagcugcuuacagaguuccagccccaccagcuguggaucacccuccugagccugacguuuaucaaaacaacccuuucccuggauuacgcuuggaagaccacagccauggcucucagcauugucucucuguucccucucugucuguccaccacaagccagaaaacgaccuggcuuccgguucugcuggggucuuuuggaugcaagccccucacaauguuccugaucaccgaaaauaagauuuggggccggaaauccuggccucuuaacgagggcaucauggccauugggaucgugagcauccugcucucuucccugcucaagaaugacgugccccuggcgggaccucuuauugccggcgggaugcugaucgcuuguuaugucauuagcggauccagcgccgaucugucucucgagaaagcugccgaagugagcugggagcaagaagccgagcauuccggcacaucucacaacauccugguugaagugcaggacgaugggaccaugaagauuaaagacgaggagcgcgaugacacgcuuaccauccugcucaaggcuacacugcucgcggucagcggaguguaccccauguccaucccugccacccuguuuguuugguauuucuggcagaaaaagaagcagagaucuggcgugcuuugggauacacccagcccgccugaagucgagcgggcugugcuggacgauggcauuuaccgcauccugcaaagagggcuccugggacggucccaggucggcguggggguuuuccaggacggaguguuucauaccauguggcacgucacacgcggcgccgugcuuauguaucaggggaaaagacuggaacccucuugggccagcguuaagaaagaccucauuuccuacggaggcggcuggcgguuccaagggagcuggaauacgggagaggaggugcaggucaucgcuguggaaccuggcaagaaccccaaaaaugugcagaccaugccggggacauuuaagaccccugagggagaaguuggcgccauugcgcuggauuucaagcccgggaccucuggauccccuaucgucaacagagagggcaaaauugugggccucuacgggaauggaguggucacaacgagcggcaccuaugugucugcuaucgcccaagccaaggcuucccaggaagggccccugcccgagaucgaggacgaaguuuuuaaaaagcgcaaccuuacaauuauggaucugcacccuggaagcggcaaaacccggagauaccugccggccauggugcgcgaggcgaucaagcggaagcucagaacacugauucuugcucccacccgcgucguggccuccgaaauggccgaggcucugaaagggaugccuauccgguaucagacgacagccguuaagucugaacauaccggcagagagauuguggaccucaugugccacgcuaccuucacaaugcgccugcugagccccguccgggugccuaauuacaacaugaucaucauggaugaggcccauuuuaccgaccccgcguccauugccgcuagaggauauaucagcacacggguuggcaugggggaagccgcugccauuuucaugaccgccacgccuccgggaucuguggaggcuuuuccccaguccaaugcggucauccaagaugaagaacgcgacauuccugaaagaagcuggaacucuggcuacgauuggaucacagacuuccccgggaaaaccgugugguuugugccuagcaucaaguccggaaaugauauugccaacugucuccggaaaaacggcaagcgcgucauccagcuuucuagaaagacauucgacaccgaguaucagaaaacgaagaauaacgacugggauuacguugugaccacagacauuagcgagaugggggcuaauuuccgggccgauagagugaucgacccccgccggugccugaaaccggucauucugaaggauggcccugaaagagugauccucgccggacccaugcccguuaccguggcuuccgccgcgcagcgccggggcagaauugggcgcaaccaaaauaaagagggagaccaguacgucuauaugggccagccucugaacaaugaugaagaccacgcucauuggacagaggccaagaugcuucuggauaacaucaauacccccgaggggaucauuccugcccucuuugaaccggagcgggaaaagucugcugccaucgacggagaguacagacugcgcggcgaagcgagaaaaacauucguggagcugaugcggcgcggggaucuccccguuuggcuuagcuauaagguggccuccgagggcuuucaguacagcgacagacgguggugcuucgauggagaacgcaacaaucaaguccuggaggaaaacauggacguggagauuuggaccaaagaaggcgagagaaagaaacugcggccuagauggcucgacgcucgcacguauucugauccccuggcccuucgggaguuuaaggaguucgcugccgggagacgcuccgucagcggagaccugauccucgagauuggcaaacugccucagcaccugacacuccgggcucagaaugcccuugauaaccuggugaugcugcacaauuccgaacaagggggaaaggcguacagacaugccauggaggaacuccccgacaccaucgagacccugaugcuucuggcucucaucgccguucugacaggcggcgugacccuguuuuuccucucugggaagggacuuggcaaaacaagcauugggcugcugugugugacggcuuccucugcccuccuguggauggccagcgucgagccgcacuggaucgcugcguccauuauccuugaauuuuuccugaugguucuccugauuccugagcccgaucggcaacgcaccccucaggacaaccagcuggccuauguggugaucggacuccuuuuuaugauccugacagucgcugccaacgaaaugggccugcucgagaccacaaagaaagaucuggggauuggacauguggccgcugagaaucaccaacacgccaccaugcuugacguugaucugagacccgcgagcgccuggacgcucuacgcuguggccaccacagucaucaccccuaugaugcggcauacaauugaaaacaccacggcuaauaucucucugacagccauugcgaaccaggccgcuauccugaugggccucgacaagggcuggcccauuuccaaaauggauaucggggugccgcuucuggcccugggaugcuacagccaggucaauccucucacccugacagcugccgugcuuaugcugguugcucacuaugccaucauuggccccgggcuccaggcgaaggccacccgcgaggcucaaaagagaaccgccgcuggaaucaugaaaaaccccacaguggacggcauugucgccaucgaucuggacccugugguuuacgacgccaaguucgaaaaacagcuggggcagauuaugcuccuuauccuguguacgucucagauccugcucaugcggaccacaugggcgcugugcgaguccauuacccuugcuacaggaccgcugaccacgcucugggaaggcagccccggcaaguuuuggaauacaaccaucgccgugucuauggcuaacauuuuccgcgggagcuaucuggccggagccggccuggcuuucucccucaugaaaucucuugggggaggcagacgggggaccggagcccaaggcgagacacugggcgagaaguggaagcgccagcugaaucagcucagcaaauccgaauuuaacaccuacaagagaagcgggaucauggaggucgaucgguccgaagcgaaagagggacugaagagaggcgaaacaacgaaacaugccgugucucgcgggaccgcuaaacuucggugguucguggagagaaaucugguuaagccugagggaaaagucauugaccucggcugugggcgcggaggcuggagcuauuacugcgccggccugaagaaagugacagaagugaagggguauaccaaaggaggccccgggcacgaggaaccuauccccauggcuacauacggauggaaccuggucaagcucccuuccggcaaagauguguuuuucaugccgcccgagaagugugacacccuucugugcgauaucggggaaucuagcccuaaucccacgauugaggagggacggacccugagaguucucaagaugguggaaccuuggcugcgcggcaaccaguuuuguaucaaaauucuuaaucccuacaugccguccgucguggagacacuggaacaaaugcagcggaagcauggcgggaugcucguuagaaacccucugucucgcaauagcacccacgagauguauuggguguccugcggaacaggcaacaucgucagcgccgugaacaugaccucucggaugcugcucaauagauucacaauggcgcaccgcaaacccaccuacgagcgggacguugaucugggggccggaacgagacauguggcugucgaacccgagguggccaaccuugacauuaucggccagcgcauugaaaauaucaagaacgagcacaaauccacauggcauuaugaugaagacaauccuuacaagaccugggcuuaucacgggagcuacgaggugaagcccucuggauccgccagcucuauggucaacggcguugugagacugcucaccaaaccuugggaugugaucccgauggucacacaaauugcuaugacggacaccacacccuuuggccagcagcggguguucaaggagaaaguugacacccgcacaccuagagccaagcgggggaccacacagaucauggaagugaccgcgaaauggcuguggggauuucuuuccagaaauaagaagccccggauuuguacgcgcgaggaguucaccagaaaaguccggagcaacgccgcuaucggcgccguguuuguugaugagaaucaauggaacuccgcuaaggaagccguggaggacgagcgcuucugggaucugguccacagagaacgggagcuccauaaacaggggaagugcgccacaugcguguauaauaugaugggaaaacgcgaaaagaagcugggcgaguuugggaaagcgaagggcagcagagcuauuugguacauguggcugggagcccgguuccucgaguucgaggcccugggcuuuaugaacgaggaccacugguucucucgcgaaaauagccuuuccgggguugagggagaaggccugcauaaacucggguacauccugagagauaucucuaagauuccuggaggcaacauguaugcugacgauaccgccgggugggacacacggaucaccgaggaugaccuucagaaugaggcuaaaauuacggaaaucauggagcccgaacacgcccugcucgcgacaagcauuuuuaagcugaccuaccagaacaaagugguccgcgugcaaagaccggccaagaacggcacagucauggaugugaucucccggcgcgaccagagaggaucuggccagguugggaccuauggacugaauacguucaccaacauggaggugcagcucauccggcaaauggaaagcgagggcauuuuucugccuuccgagcuugaaacacccaaucuggcugagagaguccucgauuggcuggaaaagcauggggccgagcgccuuaaacggauggcuaucucuggagacgacuguguggugaagccuauugaugacagauucgccaccgcgcugacagcccucaacgauaugggcaaaguucgcaaggacaucccccagugggaaccuagcaaaggguggaaugauuggcaacaggugcccuuuugcucccaccacuuccaucaacugauuaugaaggacggccgggagaucgucgugccguguagaaaccaggaugagcugguuggacgcgcucgggugagccagggcgccggguggucucucagagaaaccgcuugccugggaaaguccuacgcccaaauguggcagcuuauguauuuucaccgccgggaccugagacucgcugccaaugcgaucuguagcgccgucccuguggauuggguccccacaucucgcaccacgugguccauucaugcucaccaccaguggaugacaaccgaggacaugcugagcguguggaaccggguuuggaucgaagagaaucccuggauggaagauaaaacccauguguccucuugggaggaggucccuuaccuuggcaagagagaagaccaguggugcgggagccugauuggacucacagcccgggccaccugggcuacaaacauccaaguggccauuaaucagguuagacgccugaucggcaacgagaauuaucuggacuacaugacguccaugaaacgguucaagaacgaaagcgauccggagggggcgcucugguga

SEQ ID NO: 18610 - RNA, 9879 nt, Artificial Sequence
  derived and/or modified CDS sequence (opt5) from DENV-1__GQ868508__SS-prME
agcgugaccaugcugcucaugcugcuucccacagcucuggcuuuccaccucacgaccagaggcggggaaccucauaugaucgucuccaagcaggaacggggaaagucucugcuuuuuaagacaagcgccggcguuaacaugugcacccugauugcgauggaccucggggagcugugugaagauacaaugaccuacaagugcccccagaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagaacaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccgcccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaaacuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucgugaugggacaacugaccuggaaugaccugaucagacuuugcauuaugguuggcgccaacgcuuccgaucgcaugggcauggggacaacguaucuggcccucauggcgaccuuuaaaaugagaccuauguucgcugugggacugcucuuucggcgccugacaucuagagagguccuucugcucaccaucggccugagccugguggccuccguggaacuucccaacucucuggaggaacucggggacggacuggccaugggcauuaugaugcucaagcugcuuacagaguuccagccccaccagcuguggaucacccuccugagccugacguuuaucaaaacaacccuuucccuggauuacgcuuggaagaccacagccauggcucucagcauugucucucuguucccucucugucuguccaccacaagccagaaaacgaccuggcuuccgguucugcuggggucuuuuggaugcaagccccucacaauguuccugaucaccgaaaauaagauuuggggccggaaauccuggccucuuaacgagggcaucauggccauugggaucgugagcauccugcucucuucccugcucaagaaugacgugccccuggcgggaccucuuauugccggcgggaugcugaucgcuuguuaugucauuagcggauccagcgccgaucugucucucgagaaagcugccgaagugagcugggagcaagaagccgagcauuccggcacaucucacaacauccugguugaagugcaggacgaugggaccaugaagauuaaagacgaggagcgcgaugacacgcuuaccauccugcucaaggcuacacugcucgcggucagcggaguguaccccauguccaucccugccacccuguuuguuugguauuucuggcagaaaaagaagcagagaucuggcgugcuuugggauacacccagcccgccugaagucgagcgggcugugcuggacgauggcauuuaccgcauccugcaaagagggcuccugggacggucccaggucggcguggggguuuuccaggacggaguguuucauaccauguggcacgucacacgcggcgccgugcuuauguaucaggggaaaagacuggaacccucuugggccagcguuaagaaagaccucauuuccuacggaggcggcuggcgguuccaagggagcuggaauacgggagaggaggugcaggucaucgcuguggaaccuggcaagaaccccaaaaaugugcagaccaugccggggacauuuaagaccccugagggagaaguuggcgccauugcgcuggauuucaagcccgggaccucuggauccccuaucgucaacagagagggcaaaauugugggccucuacgggaauggaguggucacaacgagcggcaccuaugugucugcuaucgcccaagccaaggcuucccaggaagggccccugcccgagaucgaggacgaaguuuuuaaaaagcgcaaccuuacaauuauggaucugcacccuggaagcggcaaaacccggagauaccugccggccauggugcgcgaggcgaucaagcggaagcucagaacacugauucuugcucccacccgcgucguggccuccgaaauggccgaggcucugaaagggaugccuauccgguaucagacgacagccguuaagucugaacauaccggcagagagauuguggaccucaugugccacgcuaccuucacaaugcgccugcugagccccguccgggugccuaauuacaacaugaucaucauggaugaggcccauuuuaccgaccccgcguccauugccgcuagaggauauaucagcacacggguuggcaugggggaagccgcugccauuuucaugaccgccacgccuccgggaucuguggaggcuuuuccccaguccaaugcggucauccaagaugaagaacgcgacauuccugaaagaagcuggaacucuggcuacgauuggaucacagacuuccccgggaaaaccgugugguuugugccuagcaucaaguccggaaaugauauugccaacugucuccggaaaaacggcaagcgcgucauccagcuuucuagaaagacauucgacaccgaguaucagaaaacgaagaauaacgacugggauuacguugugaccacagacauuagcgagaugggggcuaauuuccgggccgauagagugaucgacccccgccggugccugaaaccggucauucugaaggauggcccugaaagagugauccucgccggacccaugcccguuaccguggcuuccgccgcgcagcgccggggcagaauugggcgcaaccaaaauaaagagggagaccaguacgucuauaugggccagccucugaacaaugaugaagaccacgcucauuggacagaggccaagaugcuucuggauaacaucaauacccccgaggggaucauuccugcccucuuugaaccggagcgggaaaagucugcugccaucgacggagaguacagacugcgcggcgaagcgagaaaaacauucguggagcugaugcggcgcggggaucuccccguuuggcuuagcuauaagguggccuccgagggcuuucaguacagcgacagacgguggugcuucgauggagaacgcaacaaucaaguccuggaggaaaacauggacguggagauuuggaccaaagaaggcgagagaaagaaacugcggccuagauggcucgacgcucgcacguauucugauccccuggcccuucgggaguuuaaggaguucgcugccgggagacgcuccgucagcggagaccugauccucgagauuggcaaacugccucagcaccugacacuccgggcucagaaugcccuugauaaccuggugaugcugcacaauuccgaacaagggggaaaggcguacagacaugccauggaggaacuccccgacaccaucgagacccugaugcuucuggcucucaucgccguucugacaggcggcgugacccuguuuuuccucucugggaagggacuuggcaaaacaagcauugggcugcugugugugacggcuuccucugcccuccuguggauggccagcgucgagccgcacuggaucgcugcguccauuauccuugaauuuuuccugaugguucuccugauuccugagcccgaucggcaacgcaccccucaggacaaccagcuggccuauguggugaucggacuccuuuuuaugauccugacagucgcugccaacgaaaugggccugcucgagaccacaaagaaagaucuggggauuggacauguggccgcugagaaucaccaacacgccaccaugcuugacguugaucugagacccgcgagcgccuggacgcucuacgcuguggccaccacagucaucaccccuaugaugcggcauacaauugaaaacaccacggcuaauaucucucugacagccauugcgaaccaggccgcuauccugaugggccucgacaagggcuggcccauuuccaaaauggauaucggggugccgcuucuggcccugggaugcuacagccaggucaauccucucacccugacagcugccgugcuuaugcugguugcucacuaugccaucauuggccccgggcuccaggcgaaggccacccgcgaggcucaaaagagaaccgccgcuggaaucaugaaaaaccccacaguggacggcauugucgccaucgaucuggacccugugguuuacgacgccaaguucgaaaaacagcuggggcagauuaugcuccuuauccuguguacgucucagauccugcucaugcggaccacaugggcgcugugcgaguccauuacccuugcuacaggaccgcugaccacgcucugggaaggcagccccggcaaguuuuggaauacaaccaucgccgugucuauggcuaacauuuuccgcgggagcuaucuggccggagccggccuggcuuucucccucaugaaaucucuugggggaggcagacgggggaccggagcccaaggcgagacacugggcgagaaguggaagcgccagcugaaucagcucagcaaauccgaauuuaacaccuacaagagaagcgggaucauggaggucgaucgguccgaagcgaaagagggacugaagagaggcgaaacaacgaaacaugccgugucucgcgggaccgcuaaacuucggugguucguggagagaaaucugguuaagccugagggaaaagucauugaccucggcugugggcgcggaggcuggagcuauuacugcgccggccugaagaaagugacagaagugaagggguauaccaaaggaggccccgggcacgaggaaccuauccccauggcuacauacggauggaaccuggucaagcuccauuccggcaaagauguguuuuucaugccuccggagaagugugacacccuucugugcgauaucggggaaucuagccccaauccuacgauugaggagggacggacccugagaguucucaagaugguggaacccuggcugcgcggcaaccaguuuuguaucaaaauucuuaauccuuacaugcccuccgucguggagacacuggaacaaaugcagcggaagcacggcgggaugcucguuagaaacccgcugucucgcaauagcacccacgagauguauuggguguccugcggaacaggcaacaucgucagcgccgugaacaugaccucucggaugcugcucaauagauucacaauggcgcaucgcaaaccuaccuacgagcgggacguugaucugggggccggaacgagacacguggcugucgaacccgagguggccaaccuugacauuaucggccagcgcauugaaaauaucaagaacgagcauaaauccacauggcacuaugaugaagacaaucccuacaagaccugggcuuaucacgggagcuacgaggugaagccuucuggauccgccagcucuauggucaacggcguugugagacugcucaccaaacccugggaugugaucccuauggucacacaaauugcuaugacggacaccacaccguuuggccagcagcggguguucaaggagaaaguugacacccgcacacccagagccaagcgggggaccacacagaucauggaagugaccgcgaaauggcuguggggauuucuuuccagaaauaagaagccucggauuuguacgcgcgaggaguucaccagaaaaguccggagcaacgccgcuaucggcgccguguuuguugaugagaaucaauggaacuccgcuaaggaagccguggaggacgagcgcuucugggaucugguccauagagaacgggagcuccacaaacaggggaagugcgccacaugcguguauaauaugaugggaaaacgcgaaaagaagcugggcgaguuugggaaagcgaagggcagcagagcuauuugguacauguggcugggagcccgguuccucgaguucgaggcccugggcuuuaugaacgaggaccauugguucucucgcgaaaauagccuuuccgggguugagggagaaggccugcacaaacucggguacauccugagagauaucucuaagauucccggaggcaacauguaugcugacgauaccgccgggugggacacacggaucaccgaggaugaccuucagaaugaggcuaaaauuacggaaaucauggagccugaacaugcccugcucgcgacaagcauuuuuaagcugaccuaccagaacaaagugguccgcgugcaaagacccgccaagaacggcacagucauggaugugaucucccggcgcgaccagagaggaucuggccagguugggaccuauggacugaauacguucaccaacauggaggugcagcucauccggcaaauggaaagcgagggcauuuuucugccguccgagcuugaaacaccuaaucuggcugagagaguccucgauuggcuggaaaagcacggggccgagcgccuuaaacggauggcuaucucuggagacgacuguguggugaagcccauugaugacagauucgccaccgcgcugacagcccucaacgauaugggcaaaguucgcaaggacaucccucagugggaacccagcaaaggguggaaugauuggcaacaggugccuuuuugcucccaccauuuccaccaacugauuaugaaggacggccgggagaucgucgugcccuguagaaaccaggaugagcugguuggacgcgcucgggugagccagggcgccggguggucucucagagaaaccgcuugccugggaaaguccuacgcccaaauguggcagcuuauguauuuucaucgccgggaccugagacucgcugccaaugcgaucuguagcgccgucccgguggauugggucccuacaucucgcaccacgugguccauucacgcucaccaucaguggaugacaaccgaggacaugcugagcguguggaaccggguuuggaucgaagagaaucccuggauggaagauaaaacccacguguccucuugggaggagguccccuaccuuggcaagagagaagaccaguggugcgggagccugauuggacucacagcccgggccaccugggcuacaaacauccaaguggccauuaaucagguuagacgccugaucggcaacgagaauuaucuggacuacaugacguccaugaaacgguucaagaacgaaagcgauccugagggggcgcucugguga

SEQ ID NO: 18611 - RNA, 9879 nt, Artificial Sequence
  derived and/or modified CDS sequence (opt5) from DENV-1__GQ868509__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaugagcggaaccacaaccauuuuugcuggccaucuuaaaugccgccugaagauggacaaacucacacugaaggggaccuccuauguuauguguacgggcagcuucaaacuggagaaggaaguggccgagacacagcacggaaccguccuugugcaaguuaaguacgagggcaccgaugcgccgugcaaaaucccuuucucuacacaggacgaaaagggggugacccagaacggaagacucaucacagcuaaucccauugucacggauaaagagaagccugugaacaucgaaaccgagccccccuuuggcgaguccuauauugugguuggggccggagaaaaagcccugaagcugagcugguucaagaaaggcucuagcaucgggaagauguuugaggcuacagcccggggcgcuagacgcauggccauucucggagacaccgcgugggauuucggcuccaucgggggagucuuuacaucugugggcaaacuggugcaucaggucuucgggaccgccuacggagugcuuuuuagcggcguuuccuggacgaugaagaucgggauuggcauccugcucaccuggcugggacugaauagccggucuacaucccuuagcaugaccuguauugcugugggcauggucacacucuaccugggggugaugguucaagccgacucuggaugcgugaucaacuggaaaggcagagaacugaaguguggguccggaauuuucgucaccaacgaggugcacacauggaccgaacaguauaaguuucaggcugauagcccuaaacgccucuccgccgcgaucggcaaggccugggaggaggggguuugcggcauucggucugugacgagacuggaaaauaucauguggaaacagaucagcaacgagcuuaaucauauucugcucgaaaacgacaugaaguucacagucguggugggagacgcuaauggcauccuggcccaagggaaaaagaugauucgcccgcagcccauggagcacaaauacuccuggaagucuuggggaaaggcuaaaaucauuggcgccgauauccagaacaccaccuuuaucauugacgggccugauacacccgaauguccugacaaucagcgggccuggaacaucugggaggucgaggauuauggauucggcauuuuuaccacgaauaucuggcugaagcuuagagacagcuacacacaaaugugcgaucaccgccucauguccgcugcgauuaaagacagcaaggccguucaugcugauaugggcuauuggaucgaaucugagaaaaacgaaaccuggaagcuggcccgggccuccuucaucgaggugaagacauguaccuggcccaaaagccacacacuguggucuaauggggugcucgaauccgagaugauuaucccgaagauuuacggaggcccuaucagccagcauaacuauagacccggguacuucacccagacggcuggaccuuggcaccugggcaaacuugagcuggacuuugaucucugcgaagggaccacagucgugguugacgagcacugcggaaaucgcggccccucucugcggaccacaaccgugacgggcaagauuauccaugaaugguguugcagaagcuguacacugccuccccuucgguuccgcggggaggauggaugcugguacggcauggagaucagaccggucaaagaaaaggaggaaaaccucgugcgguccaugguuagcgccgggucuggagagguggacuccuuuagccugggcauucugugugcguccaucaugauugaagaggucaugagaucucgcuggagccggaagaugcucaugaccgggacacuggcuguguuccuucugcucaucaugggacaacugaccuggaaugaccugauuagacuuugcaucaugguuggcgccaacgccuccgaucgcaugggcauggggaccacauaucuggcucucauggccacguuuaaaaugagaccuauguucgcggugggacugcucuuucggcgccugaccucuagagagguccuucugcucacaauuggccugagccugguggcuuccguggaacuucccaacucucuggaggaacucggggacggacuggccaugggcaucaugaugcucaagcugcuuaccgaguuccagccccaccagcuguggacaacccuccugagccugacguuuaucaaaacaacccuuucccuggauuacgccuggaagaccacagcuauggcccucagcauugucucucuguucccucucugucuguccaccacaagccagaaaacgaccuggcuuccgguucugcuggggucuuuuggaugcaagccccucacaauguuccugaucaccgaaaauaagauuuggggccggaaauccuggccucuuaacgagggcaucauggcuauugggaucgugagcauccugcucucuucccugcucaagaaugacgugccccuggccggaccucuuauugcgggcgggaugcugaucgccuguuaugucauuagcggauccagcgcugaucugucucucgagaaagccgcugaagugagcugggagcaagaagccgagcauuccggcacaucucacaacauccugguugaagugcaggacgaugggaccaugaagauuaaagacgaggagcgcgaugacacgcuuaccauccugcucaaggccacacugcucgcugucagcggaguguaccccauguccaucccugcgacccuguuucuuugguauuucuggcagaaaaagaagcagagaucuggcguucugugggauacacccagcccgccugaaguggagcgggccguccuggacgauggcauuuaccgcauccuccaaagagggcugcuuggacggucccaggugggcgucgggguguuccaggacggaguuuuucauaccauguggcacgugacacgcggcgcuguccugauguaucaggggaaaagacucgaacccucuugggccagcgugaagaaagaccugauuuccuacggaggcggcuggcgguuccaagggagcuggaauacgggagaggagguucaggugaucgccgucgaaccuggcaagaaccccaaaaaugugcagaccacaccggggaccuuuaagaccccugagggagaagugggcgcuauugcccucgauuucaagcccgggacaucuggauccccuaucguuaacagagagggcaaaauugucggccuguacgggaauggaguggugacgaccagcggcacauaugucucugcgaucgcucaagccaaggccucccaggaagggccccuucccgagaucgaggacgaaguguuuaaaaagcgcaaccugaccauuauggaucugcacccuggaagcggcaaaacacggagauaccucccggcuaucguucgcgaggccauuaagcggaagcugagaacccuuauccuggcgcccacgcgcguggucgcuuccgaaauggccgaggcccucaaagggaugccuauucgguaucagacaaccgcugugaagucugaacauaccggcagagagaucguugaccugaugugccacgccacauucaccaugcgccugcucagccccgugcgggucccuaauuacaacaugaucauuauggaugaggcucauuuuacagaccccgccuccaucgcggccagaggauauauuagcacccgggugggcaugggggaagcugccgcuaucuucaugacggccacaccuccgggaucuguugaggccuuuccccaguccaaugcugugauucaagaugaagagcgcgacaucccugaaagaagcuggaacucuggcuacgauuggaucaccgacuuccccgggaaaacagucugguuugugccuagcauuaaguccggaaaugauaucgcgaacugucuucggaaaaacggcaagcgcgugauucagcugucuagaaagaccuucgacacggaguaucagaaaaccaagaauaacgacugggauuacgucguuacaaccgacaucagcgagaugggggccaauuuccgggcugauagagugauugacccccgccggugccugaaaccggugauccucaaggauggcccugaaagagucauucuggccggacccaugcccgugacaguugccuccgcugcccagcgccggggcagaaucgggcgcaaccaaaauaaagagggagaccaguacguguauaugggccagccucuuaacaaugaugaagaccacgcgcauuggaccgaggcuaagaugcugcucgauaacaucaauacacccgaggggauuaucccugcccuguuugaaccggagcgggaaaagucugccgcuauugacggagaguacagacugcgcggcgaagccagaaaaaccuucgucgagcucaugcggcgcggggaucuucccguguggcugagcuauaagguugcguccgagggcuuucaguacagcgacagacgguggugcuucgauggagaacgcaacaaucaagugcuggaggaaaacauggacgucgagaucuggacgaaagaaggcgagagaaagaaacuccggccuagauggcuggacgcccgcacauauucugauccccuugcucugcgggaguuuaaggaauucgccgcugggagacgcuccgugagcggagaccucauucuggagaucggcaaacugccucagcaccucacccuucgggcccagaaugcucuggauaaccuggucaugcuccacaauuccgaacaggggggaaaggccuacagacaugcgauggaggaacugcccgacaccaucgagacacuuaugcugcucgcccugauugcugugcugaccggcggcguuacacucuuuuuccuuucugggaagggacugggcaaaacgagcaucgggcugcucugugugaccgccuccucugcucugcuuuggauggccagcguggagccgcacuggauugccgcuuccaucauucuggaauuuuuccucaugguccugcugaucccugagcccgaucggcaacgcacaccucaggacaaccagcucgcguauguugugaucggacuucuguuuaugauucugaccguggccgcuaacgaaaugggccuccuggagacaaccaagaaagaucuugggaucggacaugucgccgccgagaaucaccaacacgcuacgaugcuggacguggaucucagacccgccagcgcguggacccuguacgccguugcuacaaccgugauuacaccuaugaugcggcauaccaucgaaaacacgacagccaauauuucucugaccgcuaucgccaaccaggcggccauucucaugggccuugacaagggcuggcccaucuccaaaauggauaucggggucccgcugcuggcucucggaugcuacagccaggugaauccucugacacuuaccgccgcuguccugaugcucguggcccacuaugcuauuaucggccccgggcugcaggccaaggcgacccgcgaggcccaaaagagaacagcugccggaauuaugaaaaaccccacgguugacggcaucguggcuauugaucuggacccugucguguacgacgccaaguucgaaaaacagcucgggcagaucaugcuucugauccuguguaccucucagauucuccugaugcggacaaccugggcccuuugcgaguccaucacacuggcgaccggaccgcucacgacacugugggaaggcagccccggcaaguuuuggaauaccaccauugcuguuucuauggccaacaucuuccgcgggagcuaucuggcuggagccggccucgccuucucccuuaugaaaucucuggggggaggcagacgggggacaggagcucaaggcgagacccugggcgagaaguggaagcgccagcucaaucagcugagcaaauccgaauuuaacacauacaagagaagcgggauuauggagguggaucgguccgaagccaaagagggacuuaagagaggcgaaacgaccaaacaugcggucucucgcgggacagccaagcugcggugguucguggagagaaaucucgugaagccugagggaaaaguuaucgaccugggcugugggcgcggaggcuggagcuauuacugcgcuggccugaagaaagucaccgaagugaagggguauacaaaaggaggccccgggcacgaggaaccuauccccauggccaccuacggauggaaccucgugaagcuucauuccggcaaagaugucuuuuucaugccuccggagaagugugacacgcugcugugcgauauuggggaaucuagccccaauccuaccaucgaggagggacggacacucagaguucugaagaugguggaacccuggcuucgcggcaaccaguuuuguauuaaaauccugaauccuuacaugcccuccguggucgagacccucgaacaaaugcagcggaagcacggcgggaugcuggugagaaacccgcugucucgcaauagcacacacgagauguauuggguuuccugcggaaccggcaacauugugagcgcugucaacaugacaucucggaugcuccugaauagauucaccauggcccaucgcaaaccuacguuugagcgggacguggaucuuggggcgggaacaagacacguugccguggaacccgaggucgcuaaccuggacaucauuggccagcgcaucgaaaauaucaagaacgagcauaaauccaccuggcacuacgaugaagacaaucccuauaagaccugggccuaccacgggagcuaugaggugaagccuucuggauccgcuagcucuauggugaacggcgucguuagacuccugacaaaacccugggaugugauuccuauggugacgcaaaucgccaugaccgacacaaccccguucggccagcagcgggucuuuaaggagaaaguggacacacgcacccccagagcuaagcgggggacaacccagauuauggaaguuacggccaaauggcuuuggggauuccuguccagaaauaagaagccucggaucuguacccgcgaggaauuuacaagaaaagugcggagcaacgcggccauuggcgcugucuucguggaugagaaucaauggaacuccgccaaggaagcuguugaggacgagcgcuuuugggaucucgugcauagagaacgggagcugcacaaacaggggaagugcgccaccugcgucuacaauaugaugggaaaacgcgaaaagaagcugggcgaguucgggaaagccaagggcagcagagcgaucugguauauguggcucggagcucgguuccuggaauuugaggcccuuggcuucaugaacgaggaccauugguuuucucgcgaaaauagccuguccgggguggagggagaaggccuccacaaacugggguacauccuuagagauauuucuaagauccccggaggcaacauguacgccgacgauacagcugggugggacacccggauuacggaggaugaccugcagaaugaggccaaaaucacagauauuauggaaccugagcaugcucuccuggccaccagcaucuucaagcugacauaucagaacaaaguugugcgcguccaaagacccgcgaagaacggcaccgugauggacgucaucucccggcgcgaucagagaggaucuggccagguggggacguacggacucaauaccuuuacaaacauggaaguucagcugauucggcaaauggagagcgaaggcaucuuccuuccguccgagcuggagaccccuaaucucgccgaaagagugcuggacuggcuugagaagcacggggcugaacgccugaaacggauggccauuucuggagacgauugugucgugaagcccaucgacgauagauuugcuacagcccucaccgcgcugaacgacaugggcaaagugcgcaaggauauuccucagugggagcccagcaaaggguggaaugacuggcagcagguuccuuucugcucccaccauuuucaccaacugaucaugaaggauggccgggaaaucgugguccccuguagaaaccaggacgagcucgugggacgcgcccggguuagccagggcgcuggguggucucugagagagacagccugccuuggaaaguccuaugcucaaauguggcagcugauguacuuccaucgccgggaucucagacuggccgcuaaugccauuuguagcgcggugccggucgacugggugccuaccucucgcacgacaugguccauccacgcccaccaucaguggaugaccaccgaagauaugcuuagcgucuggaaccggguguggauugaggaaaaucccuggauggaggacaaaacacacguuuccucuugggaagaggugcccuaucugggcaagagagaggaccaguggugcgggagccucaucggacugaccgcucgggccacaugggccacgaacauucaagucgcuaucaaucaggugagacgccugauuggcaacgaaaauuaccucgauuauaugaccuccaugaaacgguuuaagaacgagagcgacccugaaggggcccugugguga

SEQ ID NO: 18612 - RNA, 9879 nt, Artificial Sequence
  derived and/or modified CDS sequence (opt5) from DENV-1__GQ868510__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgggcaccgcagagagaagcggucugucgcccuggcuccucaugugggacucggccuggagacacgcaccgaaacguggaugagcuccgagggcgccuggaaacagauucagagaguugaaacaugggcucuucggcaccccggguucaccgugaucgcccuguuucucgcgcaugccauuggaacaucuaucacccaaaagggcaucauuuucauccugcuuaugcuggucaccccuagcauggcuaugcgcugcguggggauuggaaacagagacuuuguugagggccucuccggggccacauggguggaugucgugcuggagcacggaagcugugugacgaccauggcuaagaauaaacccacacuggacaucgaacuccugaagaccgaggucacaaacccugccauucuucggaaacugugcaucgaagcgaagauuucuaauaccacgacagauucccgcuguccgacccagggcgaggccacccucguugaagagcaggacgcuaacuucgugugcagacggacauuuguggaucgcggcugggggaauggauguggccuguucgggaaaggaagccuucugaccugcgccaaguuuaagugcgucacaaaacucgagggcaagaucgugcaguacgaaaaccugaaauauucuguuaucgugacgguccacaccggggaccaacaucaggugggaaaugagacaaccgaacacggcacaauugcuaccaucacgccccaggccccuaccuccgagauucagcugacagauuacggcgcccucacccuggacuguagccccagaacagggcuugacuucaacgaaaugguucugcucaccaugaaggagaaaucuuggcuggugcauaagcaaugguuucuugaucugccucuccccuggacguccggagcuagcacaucccaggagaccuggaaucggcaggaccugcuggucacauucaaaaccgcgcacgccaagaagcaagaaguggucgugcucggcucucaggagggggcuaugcacaccgcccugacaggagccacggaaauccagaccagcggcacaaccacaauuuuugcugggcaucuuaaaugccgccugaagauggauaaacucacccugaagggcacguccuauguuauguguacaggaagcuucaaacuggagaaggaaguggccgagacccagcacggcaccguccuugugcaaguuaaguacgaggggacagacgcgccgugcaaaaucccuuucucuacccaggaugaaaagggagugacacagaacggcagacucaucacggcuaaucccauugucaccgacaaagagaagccugugaacaucgaaacagagccccccuuuggggaguccuauauugugguuggagccggcgaaaaagcccugaagcugagcugguucaagaaagggucuagcaucggcaagauguuugaggcuaccgcccggggagcuagacgcauggccauucucggcgauacagcgugggacuucggguccaucggaggcgucuuuaccucuguggggaaacuggugcaucaggucuucggaacggccuacggcgugcuuuuuagcgggguuuccuggaccaugaagaucggcauuggaauccugcucacauggcugggccugaauagccggucuaccucccuuagcaugacauguauugcuguggggauggucacccucuaccugggagugaugguucaagccgauucuggcugcgugaucaacuggaaagggagagaacugaaguguggauccggcauuuucgucacaaacgaggugcacaccuggacggaacaguauaaguuucaggcugacagcccuaaacgccucuccgccgcgaucgggaaggccugggaggagggcguuugcggaauucggucugcuacaagacuggaaaauaucauguggaaacagaucagcaacgagcuuaaucauauucugcucgaaaacgauaugaaguucaccguggucgugggcgacgccaaugggauccuggcucaaggaaaaaagaugauucgcccgcagcccauggagcacaaauacuccuggaagucuuggggcaaggccaaaaucauuggggccgacauccagaacaccacauuuaucauugauggaccugacacccccgaauguccugauauccagcgggcuuggaauauuugggagguggaggacuauggcuucggcaucuuuacgacaaacauuuggcugaagcuuagagauagcuacacccaaaugugcgaccaccgccucauguccgcggccaucaaagauagcaaggcuguccaugccgacaugggguauuggaucgaaucugagaaaaaugaaacauggaagcuggcccgggcuuccuucauugagguuaagaccuguacauggcccaaaagccacacccuguggucuaacggagugcucgaauccgagaugaucauuccgaagaucuacggcgggccuauuagccagcauaauuauagacccggauacuucacgcagaccgccggcccuuggcaccuggggaaacuugagcuggauuuugaccucugcgaaggaacaaccguggucguggaugagcacugcggcaaccgcggccccucucugcggacaaccacgguuacagggaagaucauccaugaaugguguugcagaagcuguacccugccuccccuucgguuccgcggagaggacggcugcugguacgggauggagauuagaccggugaaagaaaaggaggaaaaucucguccgguccauggugagcgcgggaucuggcgagguugauuccuuuagccuggggauccugugugcuuccauuaugaucgaagaggugaugagaucucgcuggagccggaagaugcucaugacaggaacccuggccgucuuccuucugcucauuaugggccaacugaccuggaaagaccugaucagacuuugcauuauggugggcgccaacgcuuccgaccgcauggggaugggaacaacguaucuggcccucauggcgaccuuuaagaugagaccuauguucgcuguuggccugcucuuucggcgccugacaucuagagaggugcuucugcucaccaucgggcugagccuggucgccuccguggaacuucccaauucucuggaggaacucggagauggccuggccauggggaucaugaugcucaaacugcuuacagaguuccagccccaccagcuguggaccacgcuccugagccugacauuuauuaagaccacccuuucccuggacuacgcuuggaaaacaaccgccauggcucucagcaucgugucucuguucccucucugucuguccacaacgagccagaagaccacauggcuuccgguccugcugggaucucucggcugcaagccccugaccauguuucuuauuacagaaaacaaaaucuggggccggaaguccuggccucugaacgaggggauuauggccaucggaaucguuagcauucuccugucuucccuccugaaaaaugaugugccccuugcgggcccucugaucgccgggggaaugcugauugcuuguuaugugaucagcggcuccagcgccgaccucucucuggagaaggcugccgaagucagcugggagcaagaagccgagcauuccgggaccucucacaacauucuuguggaaguucaggaugacggaacgaugaaaaucaaggaugaggagcgcgacgauacccugacaauccuccugaaagcuacccuccuggcggugagcggcgucuaccccauguccauuccugccacacuuuucgugugguauuuuuggcagaagaagaaacagagaucuggcguucugugggacacccccagcccgccugaaguggagcgggcuguccuggaugacgggaucuaccgcauucuccaaagaggacugcuuggccggucccaggugggggucggaguguuccaggauggcguuuuccauacaauguggcacgugacgcgcggggccguccugauguaucagggaaagagacucgaacccucuugggccagcgugaaaaaggaccugaucuccuacggcggcggguggcgguuucaaggaagcuggaauaccggcgaggagguucaggugauugcugucgaaccugggaaaaaccccaagaaugugcagacaaccccgggaaccuucaagacaccugagggcgaagugggggccaucgcgcucgacuuuaaacccggaacgucuggcuccccuauuguuaacagagagggcaagaucgucgggcuguacggaaauggcguggugaccacaagcgggaccuaugucucugcuaucgcccaagccaaagcuucccaggaaggaccccuucccgagauugaggaugaaguguucaagaaacgcaaccugacaaucauggaccugcacccuggcagcgggaagacccggagauaccucccggccauuguucgcgaggcgaucaagcggaaacugagaacgcuuauucuggcucccacacgcguggucgccuccgaaauggccgaggcucucaagggcaugccuauccgguaucagaccaccgccgugaaaucugaacauacaggaagagagaucguugaucugaugugccacgcuaccuuuacaaugcgccugcucagccccgugcgggucccuaauuacaacaugauuaucauggacgaggcccauuucaccgaucccgcguccauugccgcuagaggcuauaucagcacgcggguggggaugggagaagccgcugccauuuuuaugacagccaccccuccgggcucuguugaggcuuucccccaguccaaugcggugauccaagacgaagagcgcgauaucccugaaagaagcuggaacucuggguacgacuggauuacagauuuucccggaaagaccgucugguucgugccuagcaucaaauccggcaaugacauugccaacugucuucggaagaaugggaagcgcgugauccagcugucuagaaaaacguuugauaccgaguaucagaagacaaaaaacaacgacugggacuacgucguuaccacagauauuagcgagaugggcgcuaauuuccgggccgacagagugaucgauccccgccggugccugaagccggugauucucaaagacggaccugaaagagucauccuggccggccccaugcccgugaccguugcuuccgccgcgcagcgccgggggagaaucggacgcaaccaaaauaaggagggcgaucaguacguguauauggggcagccucuuaacaaugacgaagaucacgcucauuggacagaggccaagaugcugcucgacaacauuaauacccccgagggaaucauuccugcccuguucgaaccggagcgggaaaaaucugcugccaucgauggcgaguacagacugcgcggggaagcgagaaagacguuugucgagcucaugcggcgcggcgaccuucccguguggcugagcuauaaaguugccuccgagggauuccaguacagcgauagacgguggugcuuugacggcgaacgcaacaaucaagugcuggaggaaaacauggaugucgagauuuggacaaaggaaggggagagaaaaaagcuccggccuagauggcuggacgcucgcaccuauucugacccccuugcccugcgggaguucaaagaauuugcugccggaagacgcuccgugagcggcgaucucauccuggagaucgggaagcugccucagcaccucacccuucgggcucagaaugcccuggacaaccuggucaugcuccacaauuccgaacagggaggcaaggcguacagacaugccauggaggaacugcccgauacaauugagacccuuaugcugcucgcucugaucgccgugcugacaggcgggguuacgcucuucuuucuuucuggaaaaggccuggggaagaccagcauuggacugcucugugugacagcuuccucugcccugcuuuggauggccagcguggagccgcacuggaucgcugcguccauuauccuggaauucuuucucaugguccugcugaucccugagcccgaccggcaacgcaccccucaggauaaccagcucgccuauguugugauuggccuucuguucaugauccugacaguggcugccaaugaaauggggcuccuggagaccacgaaaaaggaccuuggaauuggccaugucgccgcugagaaccaccaacacgccaccaugcuggauguggaccucagacccgcgagcgccuggacacuguacgcuguugccaccacagugaucaccccuaugaugcggcauacgauugaaaacacaaccgcuaauaucucucugacagccauugcgaaccaggccgcuauccucaugggccuugauaaaggguggcccaucuccaagauggacauuggagucccgcugcuggcccucggcugcuacagccaggugaauccucugacccuuaccgcugccguccugaugcucguggcucacuaugccaucauugggcccggacugcaggcgaaggccacacgcgaggcucaaaaaagaacggccgcuggcaucaugaagaaccccaccguugaugggauuguggccaucgaccuggauccugucguguacgacgccaaauuugaaaagcagcucggacagaucaugcuucugauucuguguacaucucagauccuccugaugcggaccacaugggcgcuuugcgaguccauuacccuggcuacgggcccgcucacaacccugugggaaggcagccccgggaaauucuggaauaccacaaucgccguuucuauggcuaacauuuuucgcggaagcuaucuggccggcgccgggcucgcuuucucccuuaugaagucucugggaggcgggagacggggaaccggcgcccaaggcgagacacugggggagaaguggaaacgccagcucaaucagcugagcaaguccgaauucaacacguacaaaagaagcggaaucauggagguggaccgguccgaagcgaaggagggccuuaaaagaggggaaaccacaaagcaugccgucucucgcggaaccgcuaagcugcggugguuuguggagagaaaucucgugaaaccugagggcaagguuaucgaucugggguguggacgcggcggcuggagcuauuacugcgccgggcugaaaaaggucacagaagugaaaggauauaccaagggcgggcccggacacgaggaaccuauucccauggcuacguacggcuggaaccucgugaaacuucauuccgggaaggacgucuucuuuaugccuccggagaagugugauacccugcugugcgacaucggagaaucuagccccaauccuacaauugaggagggccggacccucagaguucugaaaaugguggaacccuggcuucgcggcaaccaguucuguaucaagauucugaauccuuacaugcccuccguggucgagacacucgaacaaaugcagcggaaacacgggggaaugcuggugagaaacccgcugucucgcaauagcacccacgagauguauuggguuuccugcggcacagggaacaucgugagcgccgucaauaugaccucucggaugcuccugaacagauuuacgauggcgcaucgcaagccuacauacgagcgggauguggaccuuggagccggcaccagacacguugcuguggaacccgaggucgccaaccuggauauuaucgggcagcgcaucgaaaauauuaaaaacgagcauaaguccaccuggcacuaugacgaagauaaucccuacaagacaugggcuuaucacggaagcuacgaggugaaaccuucuggcuccgccagcucuauggugaacggcgucguuagacuccugacgaagcccugggacgugaucccuauggugacccaaauugcuaugacagauaccacaccguucgggcagcagcgggucuuuaaagagaagguggacacccgcacacccagagccaaacggggaaccacgcagaucauggaaguuaccgcgaaguggcuuuggggcuuccuguccagaaauaagaaaccucggauuuguacacgcgaggaauuuaccagaaaggugcggagcaacgccgcuaucggggccgucuucguggacgagaaucaauggaacuccgcuaaagaagccguugaggaugagcgcuuuugggaccucgugcauagagaacgggagcugcacaagcagggaaaaugcgccacaugcgucuauaauaugaugggcaagcgcgaaaagaaacugggggaguucggcaaggcgaaaggaagcagagcuaucugguacauguggcucggcgcccgguuucuggaauucgaggcccuuggguucaugaacgaggaucauugguuuucucgcgaaaauagccuguccggaguggagggcgaagggcuccacaagcugggauacauucuuagagacaucucuaaaauucccggcgggaacauguaugcugaugacaccgccggcugggauacgcggaucacagaggacgaucugcagaaugaggcuaagauuaccgacaucauggaaccugagcaugcccuccuggcgacaagcaucuucaaacugaccuaccagaacaagguugugcgcguccaaagacccgccaagaauggaacggugauggaugucauuucccggcgcgaccagagaggcucugggcaggugggaaccuauggccucaacacauuuaccaacauggaaguucagcugauccggcaaauggagagcgaagggauuuuccuuccguccgagcuggagacaccuaaucucgcugaaagagugcuggauuggcuuggaaaacacggcgccgagcgccugaagcggauggcuaucucuggggacgacugugucgugaaacccauugaugacagauuugccaccgcgcucacagcccugaacgauaugggcaaggugcgcaaagacaucccucagugggaacccagcaagggauggaaugauuggcagcagguuccuuucugcucccaccauuuucaccaacugaucaugaaggacggccgggagauugugguccccuguagaaaccaggaugaacucguggggcgcgcucggguuagccagggagccggcuggucucugagagagaccgcuugccuugggaaauccuacgcccaaauguggcagcugauguauuuccaucgccgggaccucagacuggcugccaaugcgaucuguagcgccgugccggucgauugggugccuacgucucgcacaaccugguccauucacgcucaccaucaguggaugaccacagaggacaugcuuagcgucuggaaccggguguggaucgaagagaaucccuggauggaagauaagacccacguuuccucuugggaggaagugcccuaccugggaaaaagagaggaccaguggugcggcagccucauugggcugacagcccgggccacgugggcuaccaacauccaagucgccauuaaucaggugagacgccugaucggcaacgagaauuaucucgacuacaugacauccaugaagcgguuuaaaaacgaaagcgauccugagggagcgcugugguga

SEQ ID NO: 18613 - RNA, 9879 nt, Artificial Sequence
  derived and/or modified CDS sequence (opt5) from DENV-1__GQ868511__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaccugccgccugaaaauggacaagcucacgcugaaagggacauccuauguuauguguaccggcagcuucaagcuggagaaagaaguggccgagacccagcacggaacaguccuugugcaaguuaaguacgagggcaccgaugcgccgugcaagaucccuuucucuacacaggacgaaaaaggggugacgcagaacggaagacucaucaccgcuaaucccauugucacagauaaggagaaaccugugaacaucgaaaccgagccccccuuuggcgaguccuauauugugguuggggccggagaaaaggcccugaaacugagcugguucaagaagggcucuagcaucgggaaaauguuugaggcuacagcccggggcgcuagacgcauggccauucucggagacaccgcgugggauuucggcuccaucgggggagucuuuacgucugugggcaagcuggugcaucaggucuucgggaccgccuacggagugcuuuuuagcggcguuuccuggacaaugaaaaucgggauuggcauccugcucaccuggcugggacugaauagccggucuacaucccuuagcaugaccuguauugcugugggcauggucacacucuaccugggggugaugguucaagccgacucuggaugcgugaucaacuggaagggcagagaacugaaauguggguccggaauuuucgucaccaacgaggugcacacguggacagaacaguauaaguuucaggcugauagcccuaagcgccucuccgccgcgaucggcaaagccugggaggaggggguuugcggcauucggucugcuaccagacuggaaaauaucauguggaagcagaucagcaacgagcuuaaucauauucugcucgaaaacgacaugaaauucaccguggucgugggagacgccaauggcauccuggcucaagggaagaaaaugauucgcccgcagcccauggagcacaaguacuccuggaaaucuuggggaaaggccaagaucauuggcgccgauauccagaacacaaccuuuaucauugacgggccugauacgcccgaauguccugacaaucagcgggcuuggaacaucugggagguggaggauuauggauucggcauuuuuacaaccaauaucuggcugaaacuuagagacagcuacacacaaaugugcgaucaccgccucauguccgcggccauuaaggacagcaaagcuguccaugccgauaugggcuauuggaucgaaucugagaagaacgaaaccuggaaacuggcccgggcuuccuucaucgagguuaagacauguaccuggcccaagagccacacgcuguggucuaauggggugcucgaauccgagaugauuaucccgaaaauuuacggaggcccuaucagccagcauaacuauagacccggguacuucacccagacagccggaccuuggcaccugggcaagcuugagcuggacuuugaucucugcgaagggaccacaguggucguggacgagcacugcggaaaucgcggccccucucugcggaccacgacaguuaccggcaaaauuauccaugaaugguguugcagaagcuguacacugccuccccuucgguuccgcggggaggauggaugcugguacggcauggagaucagaccggugaaggaaaaagaggaaaaccucguccgguccauggugagcgcggggucuggagagguugacuccuuuagccugggcauucugugugcuuccaucaugauugaagaggugaugagaucucgcuggagccggaagaugcucaugaccgggacccuggccgucuuccuucugcucgugaugggacaacugacauggaaugaccugaucagacuuugcauuaugguuggcgccaacgcuuccgaucgcaugggcauggggacgaccuaucuggcccucauggcgacauuuaagaugagaccuauguucgcugugggacugcucuuucggcgccugaccucuagagagguccuucugcucacaaucggccugagccugguggccuccguggaacuucccaacucucuggaggaacucggggacggacuggccaugggcauuaugaugcucaaacugcuuaccgaguuccagccccaccagcuguggacgacacuccugagccugaccuuuaucaagaccacacuuucccuggauuacgcuuggaaaaccacagccauggcucucagcaucgucucucuguucccucucugucuguccacgaccagccagaagacaaccuggcuuccgguucugcuggggucuuuuggaugcaaaccccucacaauguuccugauuaccgaaaauaagaucuggggccggaaguccuggccucuuaacgagggcauuauggccaucgggauugugagcauccugcucucuucccugcucaaaaaugacgugccccuggcgggaccucuuaucgccggcgggaugcugauugcuuguuaugucaucagcggauccagcgccgaucugucucucgagaaggcugccgaagugagcugggagcaagaagccgagcauuccggcacgucucacaacauucugguugaagugcaggacgaugggaccaugaaaaucaaggacgaggagcgcgaugacacacuuaccauucugcucaaagcuacacugcucgcggucagcggaguguaccccauguccaucccugccacccuguuuguuugguauuucuggcagaagaaaaagcagagaucuggcgugcuuugggauacacccagcccgccugaagucgagcgggcugugcuggacgauggcaucuaccgcauucugcaaagagggcuccugggacggucccaggucggcguggggguuuuccaggacggaguguuucauacgauguggcacgucacccgcggcgccgugcuuauguaucaggggaagagacuggaacccucuugggccagcguuaaaaaggaccucaucuccuacggaggcggcuggcgguuccaagggagcuggaauacaggagaggaggugcaggucauugcuguggaaccuggcaaaaaccccaagaaugugcagaccaccccggggacauuuaaaacgccugagggagaaguuggcgccaucgcgcuggauuucaagcccgggaccucuggauccccuauugucaacagagagggcaagaucgugggccucuacgggaauggaguggucacaaccagcggcacauaugugucugcuauugcccaagccaaagcuucccaggaagggccccugcccgagaucgaggacgaaguuuuuaagaaacgcaaccuuaccaucauggaucugcacccuggaagcggcaagacgcggagauaccugccggccauugugcgcgaggcgaucaaaaagaagcuccggacacugauucuugcucccaccagagucguggccuccgaaauggccgaggcucugaaagggaugccuauccgcuaucagaccacagccguuaagucugaacauaccggccgggagauuguggaccucaugugccacgcuacauucaccaugagacugcugagccccguccgcgugccuaauuacaacaugaucaucauggaugaggcccauuuuacggaccccgcguccauugccgcucggggauauaucagcacaagaguuggcaugggggaagccgcugccauuuucaugaccgccacaccuccgggaucuguggaggcuuuuccccaguccaaugcggucauccaagaugaagagcgggacauuccugaacgcagcuggaacucuggcuacgauuggaucaccgacuuccccgggaaaacggugugguuugugccuagcaucaaguccggaaaugauauugccaacugucucagaaaaaacggcaagcgggucauccagcuuucucgcaagaccuucgacacagaguaucagaaaaccaagaauaacgacugggauuacguugugacaaccgacauuagcgagaugggggcuaauuucagagccgaucgggugaucgaccccagacgcugccugaaaccggucauucugaaggauggcccugaacgggugauccucgccggacccaugcccguuacaguggcuuccgccgcgcagagacgcggccggauugggagaaaccaaaauaaagagggagaccaguacgucuauaugggccagccucugaacaaugaugaagaccacgcucauuggaccgaggccaagaugcuucuggauaacaucaauacgcccgaggggaucauuccugcccucuuugaaccggagcgcgaaaagucugcugccaucgacggagaguaccggcugagaggcgaagcgcgcaaaacauucguggagcugaugagacggggggaucuccccguuuggcuuagcuauaagguggccuccgagggcuuucaguacagcgaccgcagauggugcuucgauggagaacggaacaaucaaguccuggaggaaaacauggacguggagauuuggaccaaagaaggcgagcgcaagaaacugagaccucgguggcucgacgcuagaaccuauucugauccccuggcccuucgcgaguuuaaggaauucgcugccgggcggagauccgucagcggagaccugauccucgagauuggcaaacugccucagcaccugacacuccgcgcucagaaugcccuugauaaccuggugaugcugcacaauuccgaacaggggggaaaggcguaccggcaugccauggaggaacuccccgacaccaucgagacacugaugcuucuggcucucaucgccguucugacgggcggcgugacccuguuuuuccucucugggaagggacuuggcaaaacaagcauugggcugcugugugugaccgcuuccucugcccuccuguggauggccagcgucgagccgcacuggaucgcugcguccauuauccuugaauuuuuccugaugguucuccugauuccugagcccgauagacaacggacaccucaggacaaccagcuggccuauguggugaucggacuccuuuuuaugauccugaccgucgcugccaacgaaaugggccugcucgagacgaccaagaaagaucuggggauuggacauguggccgcugagaaucaccaacacgccacaaugcuugacguugaucugcgccccgcgagcgccuggacccucuacgcuguggccacaaccgucaucacgccuaugaugagacauacaauugaaaacaccacagcuaauaucucucugaccgccauugcgaaccaggccgcuauccugaugggccucgacaagggcuggcccauuuccaaaauggauaucggggugccgcuucuggcccugggaugcuacagccaggucaauccucucacccugacagcugccgugcuuaugcugguugcucacuaugccaucauuggccccgggcuccaggcgaaggccacgcgggaggcucaaaagcgcaccgccgcuggaaucaugaaaaaccccacaguggacggcauugucgccaucgaucuggacccugugguuuacgacgccaaguucgaaaaacagcuggggcagauuaugcuccuuauccuguguaccucucagauccugcucaugagaacaaccugggcgcugugcgaguccauuacgcuugcuacaggaccgcugaccacccucugggaaggcagccccggcaaguuuuggaauacaaccaucgccgugucuauggcuaacauuuuccgggggagcuaucuggccggagccggccuggcuuucucccucaugaaaucucuugggggaggccgcagagggacaggagcccaaggcgagacgcugggcgagaaguggaagcggcagcugaaucagcucagcaaauccgaauuuaacgcguacaagcgcagcgggaucauggaggucgauagauccgaagccaaagagggacugaagcggggcgaaaccacaaaacaugcugugucuagagggaccgccaagcuucgcugguucguggagcggaaucugguuaagccugagggaaaagucauugaccucggcugugggagaggaggcuggagcuauuacugcgcuggccugaagaaagugacagaagugaagggguauaccaaaggaggccccgggcacgaggaaccuauccccauggccacguacggauggaaccuggucaagcuccauuccggcaaagauguuuuuuucaugccuccggagaagugugacacccuucugugcgauaucggggaaucuagccccaauccuacaauugaggagggacgcacccugcgggugcucaagaugguggaacccuggcugagaggcaaccaguuuuguaucaaaauucuuaauccuuacaugcccuccgucguggagacacuggaacaaaugcagcgcaagcacggcgggaugcucguucggaacccgcugucuagaaauagcacccacgagauguauuggguguccugcggaacaggcaacaucgucagcgcggugaacaugaccucucgcaugcugcucaaucgguucacgauggcccauagaaaaccuacauacgagcgcgacguugaucugggggcuggaacccggcacguggccgucgaacccgagguggcuaaccuugacauuaucggccagagaauugaaaauaucaagaacgagcauaaauccaccuggcacuaugaugaagacaaucccuacaagacaugggccuaucacgggagcuacgaggugaagccuucuggauccgcuagcucuauggucaacggcguugugcgccugcucacgaaacccugggaugugaucccuauggucacccaaauugccaugacagacaccacaccguuuggccagcagagaguguucaaggagaaaguugacacccggacaccccgcgcgaagagagggaccacgcagaucauggaagugaccgccaaauggcuguggggauuucuuucccggaauaagaagccuagaauuuguacacgggaggaauucacccgcaaagucagaagcaacgcugccaucggcgcuguguuuguugaugagaaucaauggaacuccgccaaggaagccguggaggacgagagcuucugggaucugguccauaaagaacgggagcuccacaagcaggggaaaugcgcgacaugcguguauaauaugaugggaaagcgcgaaaagaaacugggcgaguuugggaaggcuaaaggcucuagagccauuugguacauguggcugggagcccgguuccucgaauucgaggcucugggcuuuaugaacgaggaccauugguucagccgcgaaaauucccuuucugggguugagggagaaggccugcacaagcucggguacauccugagagauaucagcaaaauucccggaggcaacauguaugccgacgauaccgcugggugggacacgcggaucacagaggaugaccuucagaaugaggccaagauuaccgaaaucauggagccugaacaugcgcugcucgccacauccauuuuuaaacugaccuaccagaacaaggugguccgcgugcaaagacccgcuaagaacggcacggucauggaugugaucucucggcgcgaccagagaggaagcggccagguugggaccuauggacugaauacauucaccaacaugggcgugcagcucauccggcaaauggaguccgaagggauuuuucugccgucugagcuugagacaccuaaucuggccgaacgcguccucgauuggcuggagaaacacggagcugaaagacuuaagcggauggccaucagcggcgacgacuguguggugaaacccauugaugacagauucgcgaccgcccugacagcucucaacgauauggggaagguucgcaaagacaucccucagugggagcccuccaagggcuggaaugauuggcagcaggugccuuuuugcagccaccauuuccaccaacugauuaugaaggacggacgggaaaucgucgugcccuguagaaaccaggaugagcugguuggccgcgcccgggugucucagggggcuggauggucccucagagagaccgccugccugggcaaaagcuacgcucaaauguggcagcuuauguauuuucaucgccgggaccugagacucgccgcgaaugccaucuguucugcugucccgguggauugggucccuacgucccgcacaaccuggagcauucacgcccaccaucaguggaugaccacagaagacaugcuguccguguggaaccggguuuggaucgaggaaaaucccuggauggaggauaagacccacgugucuagcugggaagagguccccuaccuugggaaaagagaggaccaguggugcggaucccugauuggccucacagcccgcgcuacgugggccaccaacauccaaguggcgauuaaucagguucggagacugaucgggaacgaaaauuaucuggacuacaugacaagcaugaagcgguucaaaaacgagucugauccugaaggcgcucucugguga

SEQ ID NO: 18614 - RNA, 9879 nt, Artificial Sequence
  derived and/or modified CDS sequence (opt5) from DENV-1__GQ868512__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucuguguguguccaucaugauugaagaggucaugagaucucgcuggagccggaagaugcucaugacagggacccuggcuguguuccuucugcucguuaugggacaacugaccuggaaugaccugaucagacuuugcauuauggugggcgccaacgccuccgaucgcaugggcauggggacaacguaucuggcucucauggccaccuuuaaaaugagaccuauguucgcggucggacugcucuuucggcgccugacaucuagagaggugcuucugcucaccaucggccugagccugguggcuuccgucgaacuucccaacucucuggaggaacucggggacggacuggccaugggcauuaugaugcucaagcugcuuacagaguuccagccccaccagcuguggaccacgcuccugagccugacauuuaucaaaaccacccuuucccuggauuacgccuggaagacaaccgcuauggcccucagcaucguuucucuguucccucucugucuguccacaacgagccagaaaaccacauggcuuccggugcugcuggggucuuuuggaugcaagccccucaccauguuccugauuacagaaaauaagaucuggggccggaaauccuggccucuuaacgagggcauuauggcuaucgggauugugagcauccugcucucuucccugcucaagaaugacgucccccuggccggaccucuuaucgcgggcgggaugcugauugccuguuaugugaucagcggauccagcgcugaucugucucucgagaaagccgcugaaguuagcugggagcaagaagccgagcauuccggcaccucucacaacauucugguggaaguccaggacgaugggacgaugaagaucaaagacgaggagcgcgaugacacccuuacaauucugcucaaggccacccugcucgcugugagcggaguuuaccccauguccaucccugcgacacuguuugugugguauuucuggcagaaaaagaagcagagaucuggcguccuuugggauacccccagcccgccugaaguggagcgggccguccuggacgauggcaucuaccgcauucugcaaagagggcuccugggacggucccaggugggcguugggguguuccaggacggagucuuucauacaauguggcacgugacgcgcggcgcuguucuuauguaucaggggaaaagacuggaacccucuugggccagcgugaagaaagaccucaucuccuacggaggcggcuggcgguuccaagggagcuggaauaccggagaggagguccaggugauugccguggaaccuggcaagaaccccaaaaauguucagacaaccccggggaccuuuaagacaccugagggagaagucggcgcuaucgcccuggauuucaagcccgggacgucuggauccccuauugugaacagagagggcaaaaucgugggccucuacgggaauggagucgugaccacaagcggcaccuauguuucugcgauugcucaagccaaggccucccaggaagggccccugcccgagaucgaggacgaaguguuuaaaaagcgcaaccuuacaaucauggaucugcacccuggaagcggcaaaacccggagauaccugccggcuauuguccgcgaggccaucaagcggaagcucagaacgcugauucuugcgcccacacgcgugguugcuuccgaaauggccgaggcccugaaagggaugccuauccgguaucagaccaccgcugugaagucugaacauacaggcagagagauugucgaccucaugugccacgccaccuucacaaugcgccugcugagccccgugcggguuccuaauuacaacaugaucaucauggaugaggcucauuuuaccgaccccgccuccauugcggccagaggauauaucagcacgcgggugggcaugggggaagcugccgcuauuuucaugacagccaccccuccgggaucugucgaggccuuuccccaguccaaugcugugauccaagaugaagagcgcgacauuccugaaagaagcuggaacucuggcuacgauuggaucacagacuuccccgggaaaaccgugugguuugucccuagcaucaaguccggaaaugauauugcgaacugucuccggaaaaacggcaagcgcguuauccagcuuucuagaaagacguucgacaccgaguaucagaaaacaaagaauaacgacugggauuacguggugaccacagacauuagcgagaugggggccaauuuccgggcugauagagucaucgacccccgccggugccugaaaccggugauucugaaggauggcccugaaagaguuauccucgccggacccaugcccgugaccgucgccuccgcugcccagcgccggggcagaauugggcgcaaccaaaauaaagagggagaccaguacguguauaugggccagccucugaacaaugaugaagaccacgcgcauuggacagaggcuaagaugcuucuggauaacaucaauacccccgaggggaucauuccugcccucuuugaaccggagcgggaaaagucugccgcuaucgacggagaguacagacugcgcggcgaagccagaaaaacguucguugagcugaugcggcgcggggaucuccccguguggcuuagcuauaaggucgcguccgagggcuuucaguacagcgacagacgguggugcuucgauggagaacgcaacaaucaagugcuggaggaaaacauggacgucgagauuuggacaaaagaaggcgagagaaagaaacugcggccuagauggcucgacgcccgcaccuauucugauccccuggcucuucgggaguuuaaggaauucgccgcugggagacgcuccgugagcggagaccugauccucgagauuggcaaacugccucagcaccugacccuccgggcccagaaugcucuugauaaccugguuaugcugcacaauuccgaacaggggggaaaggccuacagacaugcgauggaggaacuccccgacacaaucgagacccugaugcuucuggcccucaucgcugugcugacaggcggcgugacgcuguuuuuccucucugggaagggacuuggcaaaaccagcauugggcugcugugugucacagccuccucugcucuccuguggauggccagcguugagccgcacuggaucgccgcuuccauuauccuugaauuuuuccugauggugcuccugauuccugagcccgaucggcaacgcaccccucaggacaaccagcuggcguauguggucaucggacuccuuuuuaugauccugacaguggccgcuaacgaaaugggccugcucgagaccacgaagaaagaucuggggauuggacauguugccgccgagaaucaccaacacgcuaccaugcuugacguggaucugagacccgccagcgcguggacacucuacgccgucgcuaccacagugaucaccccuaugaugcggcauacgauugaaaacacaaccgccaauaucucucugacagcuauugccaaccaggcggccauccugaugggccucgacaagggcuggcccauuuccaaaauggauaucggggucccgcuucuggcucugggaugcuacagccaggugaauccucucacccugaccgccgcuguucuuaugcugguggcccacuaugcuaucauuggccccgggcuccaggccaaggcgacacgcgaggcccaaaagagaacggcugccggaaucaugaaaaaccccaccgucgacggcauuguggcuaucgaucuggacccuguuguguacgacgccaaguucgaaaaacagcuggggcagauuaugcuccuuauccuguguacaucucagauccugcucaugcggaccacaugggcccugugcgaguccauuacccuugcgacgggaccgcugacaacccucugggaaggcagccccggcaaguuuuggaauaccacaaucgcugucucuauggccaacauuuuccgcgggagcuaucuggcuggagccggccuggccuucucccucaugaaaucucuugggggaggcagacgggggaccggagcucaaggcgagacacugggcgagaaguggaagcgccagcugaaucagcucagcaaauccgaauuuaacacguacaagagaagcgggaucauggagguggaucgguccgaagccaaagagggacugaagagaggcgaaaccacaaaacaugcggugucucgcgggaccgccaagcuucggugguucguugagagaaaucuggucaagccugagggaaaagugauugaccucggcugugggcgcggaggcuggagcuauuacugcgcuggccugaagaaagugacagaagucaagggguauaccaaaggaggccccgggcacgaggaaccuauccccauggccacguacggauggaaccugguuaagcuccauuccggcaaagauguguuuuucaugccuccggagaagugugacacccuucugugcgauaucggggaaucuagccccaauccuacaauugaggagggacggacccugagagugcucaagauggucgaacccuggcugcgcggcaaccaguuuuguaucaaaauucuuaauccuuacaugcccuccgugguugaggcucuggaacaaaugcagcggaagcacggcgggaugcucgugagaaacccgcugucucgcaauagcacacacgagauguauugggucuccugcggaaccggcaacaucgugagcgccguuaacaugacaucucggaugcugcucaauagauucaccauggcgcaucgcaaaccuacguacgagcgggacguggaucugggggccggaacaagacacgucgcuguggaacccgagguggccaaccuugacauuaucggccagcgcauugaaaauaucaagaacgagcauaaauccaccuggcacuaugaugaagacaaucccuacaagaccugggcuuaucacgggagcuacgaggucaagccuucuggauccgccagcucuaugguuaacggcguggugagacugcucacaaaacccugggaugucaucccuauggugacgcaaauugcuaugaccgacacaaccccguuuggccagcagcggguuuucaaggagaaaguggacacacgcacccccagagccaagcgggggacaacccagaucauggaagucacggcgaaauggcuguggggauuucuuuccagaaauaagaagccucggauuuguacccgcgaggaauucacaagaaaagugcggagcaacgccgcuaucggcgccguuuuuguggaugagaaucaauggaacuccgcuaaggaagccgucgaggacgagcgcuucugggaucuggugcauagagaacgggagcuccacaaacaggggaagugcgccaccugcguuuauaauaugaugggaaaacgcgaaaagaagcugggcgaguuugggaaagcgaagggcagcagagcuauuugguacauguggcugggagcccgguuccucgaauucgaggcccugggcuuuaugaacgaggaccauugguucucucgcgaaaauagccuuuccgggguggagggagaaggccugcacaaacucggguacauccugagagauaucucuaagauucccggaggcaacauguaugcugacgauacagccgggugggacacccggaucacggaggaugaccuucagaaugaggcuaaaauuacagaaaucauggagccugaacaugcccugcucgcgaccagcauuuuuaagcugacauaccagaacaaagucgugcgcguccaaagacccgccaagaacggcaccgugauggauguuaucucccggcgcgaccagagaggaucuggccagguggggacguauggacugaauaccuucacaaacauggagguccagcucauccggcaaauggaaagcgagggcauuuuucugccguccgagcuugaaaccccuaaucuggcugagagagugcucgauuggcuggaaaagcacggggccgagcgccuuaaacggauggcuaucucuggagacgacugugugguuaagcccauugaugacagauucgccacagcgcugaccgcccucaacgauaugggcaaagugcgcaaggacaucccucagugggaacccagcaaaggguggaaugauuggcagcaggucccuuuuugcucccaccauuuccaccaacugauuaugaaggacggccgggagaucgugguucccuguagaaaccaggaugagcuggugggacgcgcucgggucagccagggcgccggguggucucucagagaaacagcuugccugggaaaguccuacgcccaaauguggcagcuuauguauuuucaucgccgggaccugagacucgcugccaaugcgaucuguagcgccgugccggucgauugggugccuaccucucgcacgacaugguccauucacgcucaccaucaguggaugaccaccgaggacaugcugagcguuuggaaccggguguggaucgaagagaaucccuggauggaagauaaaacacacgucuccucuugggaggaggugcccuaccuuggcaagagagaagaccaguggugcgggagccugauuggacucaccgcccgggccacaugggcuacgaacauccaaguugccauuaaucaggugagacgccugaucggcaacgagaauuaucuggacuacaugaccuccaugaaacgguucaagaacgaaagcgauccugagggggcgcucugguga

SEQ ID NO: 18615 - RNA, 9879 nt, Artificial Sequence
  derived and/or modified CDS sequence (opt5) from DENV-1__GU131970__SS-prME
agcgugaccaugcugcucaugcugcuucccacagcucuggcuuuccaccucacgaccagaggcggggagccucauaugaucgucuccaagcaggaacggggaaaaucucugcuuuuuaagacaagcgccggcguuaauaugugcacccugauugcgauggaccucggggagcugugugaagauacaaugaccuacaaaugcccccagaucacagaggcugaacccgacgauguggacuguuggugcaaugccaccgauacgugggugaccuauggaacauguucccagaccggcgagcacagaagagagaagcggucugucgcccuggcuccucauguggggcucggacuggaaacacgcaccgagacguggaugagcuccgaaggcgccuggaaacagauucagagaguugagacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagacuuuguugagggacucuccggcgccacauggguggaugucgugcuggaacacgggagcugugugacgaccauggcuaagaauaaacccacacuggacaucgagcuccugaagaccgaagucacaaacccugccauucuucggaaacugugcaucgaggcgaagauuucuaauaccacgacagauucccgcuguccgacccagggagaagccacccucguugaggagcaggacgcuaacuucgugugcagacggacauuuguggaucgcggcuggggcaauggguguggacuguucggcaaagggagccuucugaccugcgccaaguuuaagugcgucacaaaacucgaaggaaagaucgugcaguacgagaaccugaaauauucuguuaucgugacgguccacaccggcgaccaacaucagguggggaaugaaacaaccgagcacggaacaauugcuaccaucacgccccaggccccuaccuccgaaauucagcugacagauuacggcgcccucacccuggacuguagccccagaacaggccuugacuucaacgagaugguucugcucaccaugaaggagaaaucuuggcuggugcauaagcaaugguuucuugaucugccucuccccuggacguccggggcuagcacaucccaggaaaccuggaaucggcaggaccugcuggucacauucaaaaccgcgcacgccaagaagcaagagguggucgugcucggaucucaggaaggcgcuaugcacaccgcccugacaggggccacggagauccagaccagcggaacaaccacaauuuuugcuggccaucuuaaaugccgccugaagauggauaaacucacccugaaggggacguccuauguuauguguacaggcagcuucaaacuggaaaaggagguggccgagacccagcacggaaccguccuugugcaaguuaaguacgaaggcacagacgcgccgugcaaaaucccuuucucuacccaggaugagaagggggugacacagaacggaagacucaucacggcuaaucccauugucaccgacaaagaaaagccugugaacaucgagacagagccgcccuuuggcgaauccuauauugugguuggggccggagagaaagcccugaagcugagcugguucaagaaaggcucuagcaucgggaagauguuugaagcuaccgcccggggcgcuagacgcauggccauucucggagauacagcgugggacuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgauucuggaugcgugaucaacuggaaaggcagagagcugaaguguggguccggaauuuucgucacaaacgaagugcacaccuggacggagcaguauaaguuucaggcugacagcccuaaacgccucuccgccgcgaucggcaaggccugggaggaagggguuugcggcauucggucugcuacaagacuggagaauaucauguggaaacagaucagcaacgaacuuaaucauauucugcucgagaacgauaugaaguucaccguggucgugggagacgccaauggcauccuggcucaagggaaaaagaccauucgcccgcagcccauggaacacaaauacuccuggaagucuuggggaaaggccaaaaucauuggcgccgacauccagaacacaaccuuuaucauugaugggccugacacgcccgaguguccugauaaucagcgggcuuggaacaucugggagguggaagacuauggauucggcauuuuuacaaccaauaucuggcugaaacuuagagauagcuacacacaaaugugcgaccaccgccucauguccgcggccauuaaagauagcaaggcuguccaugccgacaugggcuauuggaucgagucugagaagaaugagaccuggaagcuggcccgggcuuccuucaucgaaguuaagacauguaccuggcccaaaagccacacgcuguggucuaauggggugcucgaguccgagaugauuaucccgaagauuuacggaggcccuaucagccagcauaacuauagacccggguacuucacccagacagccggaccuuggcaccugggcaaacuugaacuggauuuugaccucugcgaggggaccacaguggucguggaugaacacugcggaaaucgcggccccucucugcggaccacgacaguuaccggcaagauuauccaugagugguguugcagaagcuguacacugccuccccuucgguuccgcggggaggacggaugcugguacggcauggaaaucagaccggugaaagagaaggaagagaaccucguccgguccauggugagcgcggggucuggagaaguugauuccuuuagccugggcauucuguguguguccaucaugauugaggaggucaugagaucucgcuggagccggaagaugcucaugaccgggacccuggcuguguuccuucugcucaucaugggacaacugacauggaaagaccugauuagacuuugcaucaugguuggcgccaaugccuccgaccgcaugggcauggggacgaccuaucuggcucucauggccacauuuaagaugagaccuauguucgcggugggacugcucuuucggcgccugaccucuagagaaguccuucugcucacaauuggccugagccugguggcuuccguggagcuucccaacucucuggaagaacucggggauggacuggccaugggcaucaugaugcucaaacugcuuaccgaguuccacccccaucagcuguggacgacacuccugagccugaccuuuaucaagaccacacuuucccuggacuacgccuggaaaaccacagcuauggcccucagcauugucucucuguucccucucugucuguccacgaccagccagaagacaaccuggcuuccgguucugcuggggucuuuuggaugcaagccccucacaauguuccugaucaccgagaacaaaauuuggggccggaaguccuggccucuuaaugagggcaucauggcuauugggaucgugagcauccugcucucuucccugcucaaaaacgaugugccccuggccggaccucuuauugcgggcgggaugcugaucgccuguuaugucauuagcggauccagcgcugaccugucucucgaaaaggccgcugaggugagcugggaacaggaggccgaacacuccggcacgucucauaauauccugguugaggugcaagaugacgggaccaugaaaauuaaggaugaggaacgcgacgauacacuuaccauccugcucaaagccacacugcucgcugucagcggaguguaccccauguccaucccugcgacccuguuuguuugguauuucuggcagaagaagaaacagagaucuggcgugcuuugggacacacccagcccgccugaggucgaacgggccgugcuggaugacggcauuuaccgcauccugcagagagggcuccugggacggucccaagucggcguggggguuuuccaggauggaguguuucacacgauguggcacgucacccgcggcgcugugcuuauguaucaggggaagagacuggagcccucuugggccagcguuaaaaaggaccucauuuccuacggaggcggcuggcgguuccaggggagcuggaacacaggagaggaagugcaagucaucgccguggagccuggcaaaaaucccaagaacgugcagaccaccccggggacauuuaagacgccugaaggagagguuggcgcuauugcccuggacuucaaacccgggaccucuggauccccuaucgucaauagagaaggcaagauugugggccucuacgggaacggaguggucacaaccagcggcacauaugugucugcgaucgcucaggccaaagccucccaagaggggccccugcccgagaucgaagaugagguuuuuaagaaacgcaaucuuaccauuauggaccugcauccuggaagcggcaagacgcggagauaccugccggcuaucgugcgcgaagccauuaagcggaaacucagaacacugauccuugcgcccacccgcgucguggcuuccgagauggccgaagcccugaaggggaugccuauucgguaucagaccacagcuguuaaaucugagcacaccggcagagagaucguggaucucaugugccaugccacauucaccaugcgccugcugagccccguccgggugccuaacuacaauaugaucauuauggacgaagcucacuuuacggaucccgccuccaucgcggccagaggauauauuagcacacggguuggcaugggggaggcugccgcuaucuucaugaccgccacaccuccgggaucuguggaagccuuuccccaguccaacgcugucauucaggacgaggaacgcgauaucccugagagaagcuggaacucuggcuacgacuggaucaccgauuuccccgggaagacggugugguuugugccuagcauuaaauccggaaacgacaucgcgaauugucuccggaagaacggcaagcgcgucauucaacuuucuagaaaaaccuucgauacagaguaucagaagaccaaaaacaaugacugggacuacguugugacaaccgauaucagcgaaaugggggccaacuuccgggcugacagagugauugauccccgccggugccugaagccggucauccugaaagacggcccugagagagugauucucgccggacccaugcccguuacaguggccuccgcugcccagcgccggggcagaaucgggcgcaaucagaacaaggaaggagaucaauacgucuauaugggccagccucugaauaacgacgaggaucaugcgcacuggaccgaggcuaagaugcuucuggacaauaucaacacgcccgaagggauuaucccugcccucuuugagccggaacgggagaaaucugccgcuauugauggagaauacagacugcgcggcgaggccagaaagacauucguggagcugaugcggcgcggggaccuccccguuuggcuuagcuauaaaguggcguccgaaggcuuucaguacagcgauagacgguggugcuucgacggagagcgcaauaaccagguccuggaagagaauauggauguggaaaucuggaccaaggagggcgagcgcaagaagcugcggccuagauggcucgacgcccgcaccuauucugacccccuggcccuucgggaauuuaaagaguucgccgcugggagacgcuccgucagcggagaucugauucucgaaaucggcaagcugccucaacaccugacacuccgggcccagaacgcucuugacaaucuggugaugcugcauaacuccgagcaagggggaaaggccuacagacacgcgauggaagaacuccccgauaccaucgagacacugaugcuucuggcccucauugcuguucugacgggcggcgugacccuguuuuuccucucugggaaaggacuuggcaagacaagcaucgggcugcugugugugaccgccuccucugcucuccuguggauggccagcgucgaaccgcauuggauugccgcuuccaucauucuugaguuuuuccugaugguucuccugaucccugaacccgaccggcagcgcacaccucaagauaaucagcuggcguauguggugaucggacuccuuuuuaugauucugaccgucgccgcuaacgagaugggccugcucgagacgaccaaaaaggaccuggggaucggacacguggccgccgaaaaccaccagcaugcuacaaugcuugauguugaccugagacccgccagcgcguggacccucuacgccguggcuacaaccgucauuacgccuaugaugcggcacacaaucgagaauaccacagccaacauuucucugaccgcuaucgccaaucaagcggccauucugaugggccucgauaaaggcuggcccaucuccaagauggacaucggggugccgcuucuggcucugggaugcuacagccaggucaacccucucacccugacagccgcugugcuuaugcugguugcccauuaugcuauuaucggccccgggcuccaggccaaggcgacgcgcgaagcccagaaaagaaccgcugccggaauuaugaagaaucccacaguggauggcaucgucgcuauugaccuggauccugugguuuacgacgccaaauucgagaagcaacuggggcagaucaugcuccuuauccuguguaccucucagauucugcucaugcggacaaccugggcccugugcgaauccaucacgcuugcgacaggaccgcugaccacccucugggagggcagccccggcaaauuuuggaacacaaccauugcugugucuauggccaauaucuuccgcgggagcuaucuggcuggagccggccuggccuucucccucaugaagucucuugggggaggcagacgggggacaggagcucagggcgagacgcugggcgaaaaguggaaacgccaacugaaccagcucagcaaguccgaguuuaauaccuacaaaagaagcgggauuauggaagucgaccgguccgaggccaaggaaggacugaaaagaggcgagacaaccaagcacgcggugucucgcgggacagccaaacuucggugguucguggagagaaaccugguuaaaccugaaggaaaggucaucgaucucggcugugggcgcggaggcuggagcuauuacugcgcuggccugaaaaaggugaccgaggugaaaggguauacgaagggaggccccgggcaugaggaaccuauccccauggccaccuacggauggaaucuggucaaacuccacuccggcaaggacguguuuuucaugccuccggaaaagugugauacacuucugugcgacauuggggagucuagccccaacccuaccaucgaggaaggacggacacugagaguucucaaaaugguggagcccuggcugcgcggcaaucaguuuuguauuaagauccuuaacccuuacaugcccuccgucguggaaacccuggagcagaugcaacggaaacacggcgggaugcucguuagaaauccgcugucucgcaacagcacacaugagauguauuggguguccugcggaaccggcaauauugucagcgcugugaacaugacgucucggaugcugcucaacagauucacaauggcccaccgcaagccuaccuacgaacgggauguugaccugggggcgggaaccagacauguggccgucgagcccgaaguggcuaaucuugauaucauuggccagcgcaucgagaacaucaaaaaugaacacaaguccacauggcacuaugacgaggauaaccccuacaagacgugggccuaucaugggagcuacgaggugaaaccuucuggauccgcuagcucuauggucaauggcguugugagacugcucaccaagcccugggacgugauuccuauggucacacagaucgccaugaccgauacaaccccguuuggccaacagcggguguucaaagaaaagguugacacacgcacccccagagcuaaacgggggacgacccagauuauggaggugacagccaaguggcuguggggauuucuuuccagaaacaagaaaccucggaucuguacccgcgaagaguucacaagaaagguccggagcaaugcggccauuggcgcuguguuuguugacgaaaaccaguggaacuccgccaaagaggcuguggaggaugaacgcuucugggaccugguccacagagagcgggaacuccauaagcaagggaaaugcgcuaccugcguguauaacaugaugggaaagcgcgagaagaaacugggcgaauuugggaaggccaaaggcagcagagcgaucugguacauguggcugggagcucgguuccucgaguucgaggcccugggcuuuaugaaugaagaucacugguucucucgcgagaacagccuuuccgggguugaaggagagggccugcauaagcucggguacauccugagagacauuucuaaaauccccggaggcaauauguaugccgaugacacggcugggugggauacacggauuaccgaggacgaucuucagaacgaagccaagaucacagacauuauggagccugaacacgcucugcucgccaccagcaucuuuaaacugacguaccagaauaaggugguccgcgugcagagacccgcgaagaacggcaccgucauggaugugaucucccggcgcgaccaaagaggaucuggccagguugggacauauggacugaacaccuucacaaauauggaggugcagcucauucggcagauggaaagcgagggcaucuuucugccguccgagcuugaaaccccuaaccuggccgagagaguccucgauuggcuggaaaaacacggggcugagcgccuuaagcggauggccauuucuggagacgacuguguggugaaacccaucgaugacagauucgcuacagcccugaccgcgcucaaugauaugggcaagguucgcaaagacauuccucaaugggaacccagcaagggguggaacgauuggcaacaggugccuuuuugcucccaucacuuccaucagcugaucaugaaggacggccgggagaucgucgugcccuguagaaaucaagaugagcugguuggacgcgcccgggugagccagggcgcuggguggucucucaaagaaacggccugccugggaaaguccuacgcucagauguggcaacuuauguauuuucacagacgcgaccugcggcucgccgcuaacgccauuuguagcgcggucccgguggauugggucccuacaucuagaaccaccugguccauccacgcccaucaccaguggaugacaaccgaggacaugcugagcguguggaaucgcguuuggauugaagagaaccccuggauggaagauaaaacacauguguccucuugggaggagguccccuaccuuggcaagcgggaagaccaguggugcgggagccugaucggacucacggcuagagccaccugggccacaaauauucagguggcuaucaaccaaguucggagacugauuggcaaugagaacuaucuggacuacaugaccuccaugaaacgcuucaagaaugaaagcgauccugagggggcccucugguga

SEQ ID NO: 18616 - RNA, 9879 nt, Artificial Sequence
  derived and/or modified CDS sequence (opt5) from DENV-1__KF955427__SS-prME
agcgugacaaugcugcucaugcugcuucccacagcucuggcuuuccaccucacgaccagaggaggggagccucauaugaucgucagcaagcaggaacgggggaaaucucugcuuuuuaagacaagcgcuggaguuaacaugugcacccugauugcgauggaccucggggagcugugugaagauacaaugaccuacaaaugcccccagaucacagaggcugaacccgacgauguggacuguuggugcaaugccaccgauacgugggugaccuauggaacauguucccagaccggcgagcacagaagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagaacaagaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgccuggacaggggccacggaaauccagaccagcggaacaaccacaauuuuugcuggccaucugaaauggcgccuuaagauggacaaacugacccucaaggggacguccuauguuaugugcacaggcagcuucaaacuggagaaggaaguggccgagacccagcacggaaccggccugguccaagugaaguacgaggggacagaugcgccguguaaaaucccuuucucugcucaggacgaaaagggaguuacccagaacggcagacuuaucacagccaaucccauugugacggauaaagagaagccugucaacaucgaaaccgagccgcccuuuggggaguccuauauuguggugggagccggcgaaaaagcucucaagcugagcugguucaagaaagggucuagcaucggcaagauguuugaggccacagcucggggagccagacgcauggcgauucugggcgacaccgccugggauuucggguccaucggaggcguuuuuacaucugucgggaaacucgugcaucagguguucggaaccgcuuacggcguccuguuuagcgggguguccuggacgaugaagaucggcauuggaauccuucugaccuggcucggccugaauagccggucuacaucccugagcaugaccugcauugccguugggauggugacacuuuaccucggagucauggugcaagcugacucuggcuguguuaucaacuggaaagggagagaacugaagugcggauccggcauuuucgugaccaacgagguccacacauggaccgaacaguauaaguuucaggccgauagcccuaaacgccuguccgcggccaucgggaaggcuugggaggagggcguguguggcauucggucugccacgagacucgaaaauaucauguggaaacagaucagcaacgagcugaaucauauucuucuggaaaacgacaugaaguucacaguuguggucggcgacgcuaaugggauccucgcccaaggcaaaaagaugauucgcccgcagcccauggagcacaaauacuccuggaagucuuggggcaaggccaaaaucauuggggcugauauccagaacaccaccuuuaucauugacggaccugauacacccgaaugcccugacaaucagcgggcguggaacaucugggagguggaggauuauggcuucggcauuuuuaccacgaauaucuggcugaagcugagagacagcuacacacaaaugugugaucaccgccuuauguccgccgcuauuaaagacagcaaggccgugcaugccgauaugggguauuggaucgaaucugagaaaaacgaaaccuggaagcucgcucgggccuccuucaucgaggucaagacaugcaccuggcccaaaagccacacacuguggucuaauggaguucuggaauccgagaugauuaucccgaagauuuacggcgggccuaucagccagcauaacuauagacccggauacuucacccagacggcgggcccuuggcaccucgggaaacuggagcuugacuuugaucugugugaaggaaccacagugguggucgacgagcacugcggcaaucgcggccccucucuccggaccacaaccgugacggggaagauuauccaugaauggugcuguagaagcugcacacugccuccccugcgguuccgcggagaggauggcuguugguacgggauggagaucagaccgguuaaagaaaaggaggaaaaccuugugcgguccauggucagcgcuggaucuggcgagguggacuccuuuagccucgggauucugugcgccuccaucaugauugaagagguuaugagaucucgcuggagccggaagaugcugaugaccggaacacucgccguguuccugcuucuggucaugggccaacucaccuggaaugaccugaucagacuguguauuauggugggcgcuaacgccuccgaucgcauggggaugggaaccacauaucuugcgcugauggcuacguuuaaaaugagaccuauguucgccguuggccuccuguuucggcgccucaccucuagagaggugcugcuucugacaaucgggcucagccuggucgccuccguggaacugcccaacucucuugaggaacugggagacggccucgcuauggggauuaugaugcugaagcuccugaccgaguuccagccccaccagcuuuggacaacccugcucagccugacguuuaucaaaacaacccugucccuugauuacgccuggaagaccacagcuauggcccugagcaucgugucucucuucccucugugccucuccaccacaagccagaaaacgaccuggcugccgguccuucugggaucuuuuggcuguaagccccugacaauguuccucauuaccgaaaauaagaucuggggccggaaauccuggccucugaacgaggggauuauggcgaucggaauuguuagcauccuucugucuucccuccugaagaaugacgugccccucccugauccccugaucgccggcgggauucuuaucgcuugcuaugugauuagcggauccagcgccgaccugucucuggagaaagcugccgaaaugagcugggagcaagaagccgagcauuccggcacaucucacaacauccucgucgaagugcaggaugacgggccuaugaagauuaaagaugaggagcgcgacgauacccugacgauccuucugaaggcuacccuccuggcgguuagcggaguguaccccauguccaucccgggcacacucuuugucugguauuucuggcagaaaaagaagcagagaucuggcgugcugugggacaccccuucucccccuaaaguugaacgggccgugcuugaugacgggauuuaccgcauccugcaaagaggacugcucggccggucccaggucggggugggagucuuccaggacggcguguuucauacaauguggcacguuacccgcggggcugugcugauguaucagggaaagagacuugagcccuccugggccagcgucaaaaaggaucugauuuccuacggcggcggguggcgguuccaaggaagcuggaauacaggcgaagaggugcagguuaucgccguggagccggggaaaaacccuaagaauguccagacgacccccggaacauuuaagaccccugaaggcgaggugggggcuauugcccucgacuucaaacccggaaccucuggcucccccaucgugaacagagaaggcaagauuguugggcuguacggaaauggcgucgugacaacgagcgggaccuaugugucugcgaucgcucaagccaaagccucccaggagggaccucucccggaaaucgaggaugaggucuuuaagaaacgcaaccugacaauuauggaccuucaccccggcagcgggaagacccggagauaccugccugcuaucgugcgcgaagccauuaagcggaaacugagaacacucauccuggcgcccacccgcguuguggcuuccgagauggccgaagcccuuaagggcaugccuauucgguaucagacgacagcugucaaaucugagcauaccggaagagaaaucguggaucugaugugucacgccaccuucacaaugcgccuccugagccccguucgggugccuaauuacaacaugaucauuauggacgaggcucauuuuaccgauccggccuccaucgcggccagaggcuauauuagcacacgggucgggaugggagaggcugccgcuaucuucaugaccgccacgcccccuggcucuguggaagccuuuccccaguccaaugcuguuauucaagacgaggaacgcgauaucccugagagaagcuggaacucuggguacgacuggaucacagauuuccccggaaagaccgugugguuugucccgagcauuaaauccggcaaugacaucgcgaacugccugcggaagaacgggaagcgcgugauucagcucucuagaaaaacauucgacaccgaauaucagaagacgaaaaauaacgauugggacuacguggucaccacagauaucagcgagaugggcgccaauuuccgggcugacagaguuauugauccucgccggugucuuaagcccgugauccugaaagacggacccgagagagugauucuggccggcccuaugcccgucaccguggccuccgcugcccagcgccgggggagaaucggacgcaaccaaaauaaggaaggcgaucaguacguuuauauggggcagccucucaacaaugacgaggaucacgcgcauuggacagaagcuaagaugcugcuugacaacaucaauaccccggagggaauuauccccgcccuguuugagccugaacgggagaaaucugccgcuauugauggcgaauacagacuccgcggggaggccagaaagacauucguggaacugaugcggcgcggcgaccugcccgucuggcucagcuauaaaguggcguccgagggauuucaguacagcgauagacgguggugcuucgacggcgagcgcaacaaucaaguucuugaagagaacauggacguggaaaucuggaccaaggagggggaacgcaaaaagcugcggccuagauggcuggaugcccgcacguauucugacccccucgcucugcgggaguuuaaagaguucgccgcuggaagacgcuccauuagcggcgaucuuauccuggaaaucgggaagcucccgcagcaccugacacugcgggcccagaaugcucucgacaaccuugucaugcugcacaauuccgagcagggaggcaaggccuacagacaugcgauggaggaacugccugauaccauugaaacccucaugcugcuugcccugaucgcugugcucacaggcggggucacccuguuuuuccugucuggaaaaggccucgggaagacaagcauuggacuucugugcgugacggccuccucugcucugcucuggauggccagcguugagccccacuggaucgccgcuuccauuauccuggaguuuuuccuuauggugcugcucaucccugaacccgaccggcaacgcaccccucaggauaaccagcuggcguauguggucauuggccugcucuuuaugauccuuacaguugccgcuaacgagauggggcugcuggaaaccaccaaaaaggaccucggaauuggccauguggccgccgagaaucaccaacacgcuaccaugcuggauguggaccuuagacccgccagcgcguggacgcuguacgccgucgcuaccacagugaucaccccgaugaugcggcauacaauugagaacaccacggccaauaucucucucacagcuauugccaaccaggcggccauccugaugggccuggauaaaggguggccuaucuccaagauggacauuggaguuccccuccuugcucugggcuguuacagccaggugaauccccugacccucacagccgcuguccugaugcuuguggcccacuaugcuaucauugggccuggacugcaggccaaggcgacccgcgaagcccagaaaagaaccgcugccggcaucaugaagaacccgacagucgaugggauuguggcuaucgaccucgaccccguuguguacgaugccaaauucgagaagcagcugggacagaucaugcugcucauucuuugcacgucucagauccugcugaugcggaccacaugggcccucugugaauccauuacccuggcgacaggcccucuuaccacgcugugggagggcagccccgggaaauuuuggaauacaaccaucgcugucucuauggccaacauuuuccgcggaagcuaucucgcuggcgccgggcuggccuucucccugaugaagucucucggaggcgggagacggggaaccggcgcucaaggcgaaacacuuggggagaaguggaaacgccagcugaaucagcugagcaaguccgaguuuaacaccuacaaaagaagcggaaucauggaaguggaccgguccgaggccaaggaaggccucaaaagaggggagacaacgaagcaugcgguuucucgcggaaccgccaagcugcggugguucguggaaagaaaucuugucaaaccugagggcaaggugaucgaucuggggugcggacgcggcggcuggagcuauuacugugcugggcucaaaaaggugacagagguuaaaggauauaccaagggcgggcccggacacgaggagccuauuccgauggccacauacggcuggaaccuggucaaacugcauuccgggaaggacguguuuuucaugcccccugaaaagugcgauacccuccuuugugacaucggagagucuagccccaauccuacgauugaagagggccggacccugagagugcugaaaauggucgagcccuggcuccgcggcaaccaguuuugcaucaagauucugaauccguacaugccuuccguuguggaaacacuugagcaaaugcagcggaaacacgggggaaugcuggugagaaacccccucucucgcaauagcacccacgaaauguauugggucuccuguggcacagggaacaucgugagcgcuguuaacaugaccucucggaugcugcugaauagauucacaauggcccaucgcaagcccaccuacgagcgggauguggaccucggagcgggcacgagacacgucgccguggagccugaaguugcuaaccuggauauuaucgggcagcgcaucgagaauauuaaaaacgaacauaaguccacauggcacuaugacgaggauaaucccuacaagaccugggccuaucacggaagcuacgaagugaaaccuucuggcuccgcuagcucuauggucaacggcguggugagacuucugaccaagccgugggacgucauccccaugguuacacaaauugccaugacggacaccacaccuuuugggcagcagcggguguucaaagagaagguggauacccgcacacccagagcuaaacggggaaccacacagaucauggaggucaccgccaaguggcucuggggcuuucuguccagaaauaagaaaccucggauuugcacgcgcgaagaguucaccagaaaggugcggagcaacgcggccaucggggcuguuuuuguggacgaaaaucaauggaacuccgccaaagaggcugucgaagaugagcgcuucugggaccuugugcauagagagcgggaacugcacaagcagggaaaaugugccacaugcguuuauaauaugaugggcaagcgcgagaagaaacucggggaauuuggcaaggccaaaggaagcagagcgaucugguacauguggcugggcgcucgguuccuggaguucgaagcccucggguuuaugaacgaggaucauugguucucucgcgagaauagccuguccggaguggaaggcgaggggcuucacaagcugggauacauucucagagacaucucuaaaauucccggcgggaacauguaugccgaugacaccgcuggcugggauacacggaucaccgaagacgaucugcagaaugaggccaagauuacggagaucauggaaccggagcaugcccuucuggccacaagcaucuuuaaacucaccuaccagaacaaggucgugcgcguucaaagaccugcgaagaacggaacagugauggacgucauuucccggcgcgaucagagaggcucuggacaggugggaaccuauggccugaauacguucaccaacauggaaguccagcugauccggcaaauggagagcgaagggauuuuucuccccuccgagcuggagacaccuaaucuugccgaaagagugcuggacuggcucgagaaacacggagcugaacgccugaagcggauggccaucucuggcgacgauugcguugugaaacccauugacgauagauucgcuaccgcccuuacagcgcugaacgacauggggaagguccgcaaagauaucccucagugggagcccagcaagggcuggaaugacuggcaacaggugccguuuuguucccaccauuuccaccaacucaucaugaaggauggacgggaaauugugguuccuugcagaaaccaggacgagcuggugggccgcgcccgggucagccagggggcuggauggucucugagagagaccgccugucucggcaaauccuacgcucaaauguggcagcugauguauuuucaucgccgggaucuuagacuggccgcuaaugccaucugcagcgcggugcccguugacugggugcccacaucucgcaccacgugguccauucacgcccaccaucaguggaugacaaccgaagauaugcucagcgucuggaaccggguguggaucgaggaaaauccuuggauggaggacaagacccacgucuccucuugggaagaggugccguaccuggggaaaagagaggaccagugguguggaagccuuauuggccugacagcucgggccaccugggccacaaacauccaaguugcuauuaaucaggugagacgccucaucgggaacgaaaauuaucuggauuacaugacguccaugaagcgguucaaaaacgagagcgaccccgaaggcgcccugugguga

SEQ ID NO: 18617 - RNA, 9879 nt, Artificial Sequence
  derived and/or modified CDS sequence (opt5) from DENV-1__GQ868513__SS-prME
agcgugaccaugcugcucaugcugcuucccaccgcucuggcuuuccaccucacgaccagaggcggggaaccucauaugaucgucuccaagcaggaacggggaaagucucugcuuuuuaagacaagcgccggcguuaacaugugcacccugauugcgauggaccucggggagcugugugaagauacaaugaccuacaagugcccgcagaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagaacaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugccgaccgcccugacaggggccacggaaauccagaccagcggaacaaccacaauuuuugcuggccaccuuaaaugccgccugaagauggacaaacucacccugaaggggacguccuauguuauguguacaggcagcuucaaacuggagaaggaaguggccgagacccagcauggaaccguccuugugcaaguuaaguacgagggcacagaugcgccuugcaaaauccccuucucuacccaggacgaaaagggggugacacagaacggaagacucaucacggcuaauccuauugucaccgauaaagagaagcccgugaacaucgaaacagagcccccuuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaccaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcauaccuggacggaacaguauaaguuucaggcugauagcccgaaacgccucuccgccgcgaucggcaaggccugggaggaggggguuugcggcauucggucugcuacaagacuggaaaauaucauguggaaacagaucagcaacgagcuuaaucacauucugcucgaaaacgacaugaaguucaccguggucgugggagacgccaauggcauccuggcucaagggaaaaagaugauucgcccccagccuauggagcauaaauacuccuggaagucuuggggaaaggccaaaaucauuggcgccgauauccagaacaccacauuuaucauugacgggcccgauaccccugaaugucccgacaaucagcgggcuuggaacaucugggagguggaggauuauggauucggcauuuuuacgacaaauaucuggcugaaacuuagagacagcuacacccaaaugugcgaucaccgccucauguccgcggccauuaaagacagcaaggcuguccacgccgauaugggcuauuggaucgaaucugagaaaaacgaaacauggaagcuggcccgggcuuccuucaucgagguuaagaccuguacauggccgaaaagccauacccuguggucuaauggggugcucgaauccgagaugauuaucccuaagauuuacggaggccccaucagccagcacaacuauagaccuggguacuucacgcagaccgccggacccuggcaucugggcaaacuugagcuggacuuugaucucugcgaagggacaaccguggucguggacgagcacugcggaaaucgcggcccuucucugcggacaaccacgguuacaggcaagauuauccacgaaugguguugcagaagcuguacccugcccccgcuucgguuccgcggggaggauggaugcugguacggcauggagaucagaccugugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucgugaugggacaacugaccuggaaugaccugaucagacuuugcauuaugguuggcgccaacgcuuccgaucgcaugggcauggggacaacguaucuggcccucauggcgaccuuuaaaaugagacccauguucgcugugggacugcucuuucggcgccugacaucuagagagguccuucugcucaccaucggccugagccugguggccuccguggaacuucccaacucucuggaggaacucggggacggacuggccaugggcauuaugaugcucaagcugcuuacagaguuccagccucaucagcuguggaucacccuccugagccugacguuuaucaaaacaacccuuucccuggauuacgcuuggaagaccacagccauggcucucagcauugucucucuguucccgcucugucuguccaccacaagccagaaaacgaccuggcuucccguucugcuggggucuuuuggaugcaagccucucacaauguuccugaucaccgaaaauaagauuuggggccggaaauccuggccccuuaacgagggcaucauggccauugggaucgugagcauccugcucucuucccugcucaagaaugacgugccucuggcgggaccccuuauugccggcgggaugcugaucgcuuguuaugucauuagcggauccagcgccgaucugucucucgagaaagcugccgaagugagcugggagcaagaagccgagcacuccggcacaucucauaacauccugguugaagugcaggacgaugggaccaugaagauuaaagacgaggagcgcgaugacacgcuuaccauccugcucaaggcuacacugcucgcggucagcggaguguacccuauguccauccccgccacccuguuuguuugguauuucuggcagaaaaagaagcagagaucuggcgugcuuugggauacaccgagcccucccgaagucgagcgggcugugcuggacgauggcauuuaccgcauccugcaaagagggcuccugggacggucccaggucggcguggggguuuuccaggacggaguguuucacaccauguggcaugucacacgcggcgccgugcuuauguaucaggggaaaagacuggaaccuucuugggccagcguuaagaaagaccucauuuccuacggaggcggcuggcgguuccaagggagcuggaauacgggagaggaggugcaggucaucgcuguggaacccggcaagaacccgaaaaaugugcagaccaugccugggacauuuaagacccccgagggagaaguuggcgccauugcgcuggauuucaagccugggaccucuggaucccccaucgucaacagagagggcaaaauugugggccucuacgggaauggaguggucacaacgagcggcaccuaugugucugcuaucgcccaagccaaggcuucccaggaagggccccugccugagaucgaggacgaaguuuuuaaaaagcgcaaccuuacaauuauggaucugcacccgggaagcggcaaaacccggagauaccugcccgccauggugcgcgaggcgaucaagcggaagcucagaacacugauucuugcuccuacccgcgucguggccuccgaaauggccgaggcucugaaagggaugcccauccgguaucagacgacagccguuaagucugaacacaccggcagagagauuguggaccucaugugccaugcuaccuucacaaugcgccugcugagcccuguccgggugcccaauuacaacaugaucaucauggaugaggcccacuuuaccgacccugcguccauugccgcuagaggauauaucagcacacggguuggcaugggggaagccgcugccauuuucaugaccgccacgccgcccggaucuguggaggcuuuuccucaguccaaugcggucauccaagaugaagaacgcgacauucccgaaagaagcuggaacucuggcuacgauuggaucacagacuucccugggaaaaccgugugguuugugcccagcaucaaguccggaaaugauauugccaacugucuccggaaaaacggcaagcgcgucauccagcuuucuagaaagacauucgacaccgaguaucagaaaacgaagaauaacgacugggauuacguugugaccacagacauuagcgagaugggggcuaauuuccgggccgauagagugaucgacccgcgccggugccugaaaccugucauucugaaggauggccccgaaagagugauccucgccggacccaugccuguuaccguggcuuccgccgcgcagcgccggggcagaauugggcgcaaccaaaauaaagagggagaccaguacgucuauaugggccagccccugaacaaugaugaagaccaugcucacuggacagaggccaagaugcuucuggauaacaucaauaccccugaggggaucauuccggcccucuuugaacccgagcgggaaaagucugcugccaucgacggagaguacagacugcgcggcgaagcgagaaaaacauucguggagcugaugcggcgcggggaucucccuguuuggcuuagcuauaagguggccuccgagggcuuucaguacagcgacagacgguggugcuucgauggagaacgcaacaaucaaguccuggaggaaaacauggacguggagauuuggaccaaagaaggcgagagaaagaaacugcggcccagauggcucgacgcucgcacguauucugauccucuggcccuucgggaguuuaaggaguucgcugccgggagacgcuccgucagcggagaccugauccucgagauuggcaaacugccccagcaucugacacuccgggcucagaaugcccuugauaaccuggugaugcugcacaauuccgaacaagggggaaaggcguacagacacgccauggaggaacucccggacaccaucgagacccugaugcuucuggcucucaucgccguucugacaggcggcgugacccuguuuuuccucucugggaagggacuuggcaaaacaagcauugggcugcugugugugacggcuuccucugcccuccuguggauggccagcgucgagccucauuggaucgcugcguccauuauccuugaauuuuuccugaugguucuccugauucccgagccugaucggcaacgcacaccccaggacaaccagcuggccuauguggugaucggacuccuuuuuaugauccugacagucgcugccaacgaaaugggccugcucgagaccacaaagaaagaucuggggauuggacacguggccgcugagaaucaucaacacgccaccaugcuugacguugaucugagaccugcgagcgccuggacgcucuacgcuguggccaccacagucaucacccccaugaugcggcacacaauugaaaacaccacggcuaauaucucucugacagccauugcgaaccaggccgcuauccugaugggccucgacaagggcuggccgauuuccaaaauggauaucggggugccucuucuggcccugggaugcuacagccaggucaauccccucacccugacagcugccgugcuuaugcugguugcucauuaugccaucauuggccccgggcuccaggcgaaggccacccgcgaggcucaaaagagaaccgccgcuggaaucaugaaaaacccuacaguggacggcauugucgccaucgaucuggacccggugguuuacgacgccaaguucgaaaaacagcuggggcagauuaugcuccuuauccuguguacgucucagauccugcucaugcggaccacaugggcgcugugcgaguccauuacccuugcuacaggaccccugaccacgcucugggaaggcagcccuggcaaguuuuggaauacaaccaucgccgugucuauggcuaacauuuuccgcgggagcuaucuggccggagccggccuggcuuucucccucaugaaaucucuugggggaggcagacgggggaccggagcccaaggcgagacacugggcgagaaguggaagcgccagcugaaucagcucagcaaauccgaauuuaacaccuacaagagaagcgggaucauggaggucgaucgguccgaagcgaaagagggacugaagagaggcgaaacaacgaaacacgccgugucucgcgggaccgcuaaacuucggugguucguggagagaaaucugguuaagcccgagggaaaagucauugaccucggcugugggcgcggaggcuggagcuauuacugcgccggccugaagaaagugacagaagugaagggguauaccaaaggaggcccugggcaugaggaacccaucccuauggcuacauacggauggaaccuggucaagcuccacuccggcaaagauguguuuuucaugccgcccgagaagugugacacccuucugugcgauaucggggaaucuagcccuaaucccacgauugaggagggacggacccugagaguucucaagaugguggaaccuuggcugcgcggcaaccaguuuuguaucaaaauucuuaaucccuacaugccguccgucguggagacacuggaacaaaugcagcggaagcauggcgggaugcucguuagaaacccucugucucgcaauagcacccacgagauguauuggguguccugcggaacaggcaacaucgucagcgccgugaacaugaccucucggaugcugcucaauagauucacaauggcgcaccgcaaacccaccuacgagcgggacguugaucugggggccggaacgagacauguggcugucgaacccgagguggccaaccuugacauuaucggccagcgcauugaaaauaucaagaacgagcacaaauccacauggcauuaugaugaagacaauccuuacaagaccugggcuuaucacgggagcuacgaggugaagcccucuggauccgccagcucuauggucaacggcguugugagacugcucaccaaaccuugggaugugaucccgauggucacacaaauugcuaugacggacaccacacccuuuggccagcagcggguguucaaggagaaaguugacacccgcacaccuagagccaagcgggggaccacacagaucauggaagugaccgcgaaauggcuguggggauuucuuuccagaaauaagaagccccggauuuguacgcgcgaggaguucaccagaaaaguccggagcaacgccgcuaucggcgccguguuuguugaugagaaucaauggaacuccgcuaaggaagccguggaggacgagcgcuucugggaucugguccacagagaacgggagcuccauaaacaggggaagugcgccacaugcguguauaauaugaugggaaaacgcgaaaagaagcugggcgaguuugggaaagcgaagggcagcagagcuauuugguacauguggcugggagcccgguuccucgaguucgaggcccugggcuuuaugaacgaggaccacugguucucucgcgaaaauagccuuuccgggguugagggagaaggccugcauaaacucggguacauccugagagauaucucuaagauuccuggaggcaacauguaugcugacgauaccgccgggugggacacacggaucaccgaggaugaccuucagaaugaggcuaaaauuacggaaaucauggagcccgaacacgcccugcucgcgacaagcauuuuuaagcugaccuaccagaacaaagugguccgcgugcaaagaccggccaagaacggcacagucauggaugugaucucccggcgcgaccagagaggaucuggccagguugggaccuauggacugaauacguucaccaacauggaggugcagcucauccggcaaauggaaagcgagggcauuuuucugccuuccgagcuugaaacacccaaucuggcugagagaguccucgauuggcuggaaaagcauggggccgagcgccuuaaacggauggcuaucucuggagacgacuguguggugaagccuauugaugacagauucgccaccgcgcugacagcccucaacgauaugggcaaaguucgcaaggacaucccccagugggaaccuagcaaaggguggaaugauuggcaacaggugcccuuuugcucccaccacuuccaucaacugauuaugaaggacggccgggagaucgucgugccguguagaaaccaggaugagcugguuggacgcgcucgggugagccagggcgccggguggucucucagagaaaccgcuugccugggaaaguccuacgcccaaauguggcagcuuauguauuuucaccgccgggaccugagacucgcugccaaugcgaucuguagcgccgucccuguggauuggguccccacaucucgcaccacgugguccauucaugcucaccaccaguggaugacaaccgaggacaugcugagcguguggaaccggguuuggaucgaagagaaucccuggauggaagauaaaacccauguguccucuugggaggaggucccuuaccuuggcaagagagaagaccaguggugcgggagccugauuggacucacagcccgggccaccugggcuacaaacauccaaguggccauuaaucagguuagacgccugaucggcaacgagaauuaucuggacuacaugacguccaugaaacgguucaagaacgaaagcgauccggagggggcgcucugguga

SEQ ID NO: 18618 - RNA, 9879 nt, Artificial Sequence
  derived and/or modified CDS sequence (opt5) from DENV-1__GU131973__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucuguguguguccaucaugauugaagaggucaugagaucucgcuggagccggaagaugcucaugacagggacccuggcuguguuccuucugcucguuaugggacaacugaccuggaaugaccugaucagacuuugcauuauggugggcgccaacgccuccgaucgcaugggcauggggacaacguaucuggcucucauggccaccuuuaaaaugagaccuauguucgcggucggacugcucuuucggcgccugacaucuagagaggugcuucugcucaccaucggccugagccugguggcuuccgucgaacuucccaacucucuggaggaacucggggacggacuggccaugggcauuaugaugcucaagcugcuuacagaguuccagccccaccagcuguggaccacgcuccugagccugacauuuaucaaaaccacccuuucccuggauuacgccuggaagacaaccgcuauggcccucagcaucguuucucuguucccucucugucuguccacaacgagccagaaaaccacauggcuuccggugcugcuggggucuuuuggaugcaagccccucaccauguuccugauuacagaaaauaagaucuggggccggaaauccuggccucuuaacgagggcauuauggcuaucgggauugugagcauccugcucucuucccugcucaagaaugacgucccccuggccggaccucuuaucgcgggcgggaugcugauugccuguuaugugaucagcggauccagcgcugaucugucucucgagaaagccgcugaaguuagcugggagcaagaagccgagcauuccggcaccucucacaacauucugguggaaguccaggacgaugggacgaugaagaucaaagacgaggagcgcgaugacacccuuacaauucugcucaaggccacccugcucgcugugagcggaguuuaccccauguccaucccugcgacacuguuugugugguauuucuggcagaaaaagaagcagagaucuggcguccuuugggauacccccagcccgccugaaguggagcgggccguccuggacgauggcaucuaccgcauucugcaaagagggcuccugggacggucccaggugggcguugggguguuccaggacggagucuuucauacaauguggcacgugacgcgcggcgcuguucuuauguaucaggggaaaagacuggaacccucuugggccagcgugaagaaagaccucaucuccuacggaggcggcuggcgguuccaagggagcuggaauaccggagaggagguccaggugauugccguggaaccuggcaagaaccccaaaaauguucagacaaccccggggaccuuuaagacaccugagggagaagucggcgcuaucgcccuggauuucaagcccgggacgucuggauccccuauugugaacagagagggcaaaaucgugggccucuacgggaauggagucgugaccacaagcggcaccuauguuucugcgauugcucaagccaaggccucccaggaagggccccugcccgagaucgaggacgaaguguuuaaaaagcgcaaccuuacaaucauggaucugcacccuggaagcggcaaaacccggagauaccugccggcuauuguccgcgaggccaucaagcggaagaugagaacgcucauucuggcgcccacacgcgugguugcuuccgaaauggccgaggcccuuaaagggaugccuauccgguaucagaccaccgcugugaagucugaacauacaggcagagagauugucgaccugaugugccacgccaccuucacaaugcgccuccugagccccgugcggguuccuaauuacaacaugaucaucauggaugaggcucauuuuaccgaccccgccuccauugcggccagaggauauaucagcacgcgggugggcaugggggaagcugccgcuauuuucaugacagccaccccuccgggaucugucgaggccuuuccccaguccaaugcugugauccaagaugaagagcgcgacauuccugaaagaagcuggaacucuggcuacgauuggaucacagacuuccccgggaaaaccgugugguuugucccuagcaucaaguccggaaaugauauugcgaacugucugcggaaaaacggcaagcgcguuauccagcucucuagaaagacguucgacaccgaguaucagaaaacaaagaauaacgacugggauuacguggugaccacagacauuagcgagaugggggccaauuuccgggcugauagagucaucgacccccgccggugccuuaaaccggugauucugaaggauggcccugaaagaguuauccuggccggacccaugcccgugaccgucgccuccgcugcccagcgccggggcagaauugggcgcaaccaaaauaaagagggagaccaguacguguauaugggccagccucucaacaaugaugaagaccacgcgcauuggacagaggcuaagaugcugcuugauaacaucaauacccccgaggggaucauuccugcccuguuugaaccggagcgggaaaagucugccgcuaucgacggagaguacagacuccgcggcgaagccagaaaaacguucguugagcugaugcggcgcggggaucugcccguguggcucagcuauaaggucgcguccgagggcuuucaguacagcgacagacgguggugcuucgauggagaacgcaacaaucaagugcuugaggaaaacauggacgucgagauuuggacaaaagaaggcgagagaaagaaacugcggccuagauggcuggacgcccgcaccuauucugauccccucgcucugcgggaguuuaaggaauucgccgcugggagacgcuccgugagcggagaccuuauccuggagauuggcaaacucccucagcaccugacccugcgggcccagaaugcucucgauaaccuuguuaugcugcacaauuccgaacaggggggaaaggccuacagacaugcgauggaggaacugcccgacacaaucgagacccucaugcugcuugcccugaucgcugugcucacaggcggcgugacgcuguuuuuccugucugggaagggacucggcaaaaccagcauugggcuucugugugucacagccuccucugcucugcucuggauggccagcguugagccgcacuggaucgccgcuuccauuauccuggaauuuuuccuuauggugcugcucauuccugagcccgaucggcaacgcaccccucaggacaaccagcuggcguauguggucaucggacugcucuuuaugauccuuacaguggccgcuaacgaaaugggccugcuggagaccacgaagaaagaucucgggauuggacauguugccgccgagaaucaccaacacgcuaccaugcuggacguggaucuuagacccgccagcgcguggacacuguacgccgucgcuaccacagugaucaccccuaugaugcggcauacgauugaaaacacaaccgccaauaucucucucacagcuauugccaaccaggcggccauccugaugggccuggacaagggcuggcccauuuccaaaauggauaucggggucccgcuccuugcucugggaugcuacagccaggugaauccucugacccucaccgccgcuguucugaugcuuguggcccacuaugcuaucauuggccccgggcugcaggccaaggcgacacgcgaggcccaaaagagaacggcugccggaaucaugaaaaaccccaccgucgacggcauuguggcuaucgaucucgacccuguuguguacgacgccaaguucgaaaaacagcuggggcagauuaugcugcucauccuuuguacaucucagauccugcugaugcggaccacaugggcccucugcgaguccauuacccuggcgacgggaccgcuuacaacccugugggaaggcagccccggcaaguuuuggaauaccacaaucgcugucucuauggccaacauuuuccgcgggagcuaucucgcuggagccggccuggccuucucccugaugaaaucucucgggggaggcagacgggggaccggagcucaaggcgagacacuuggcgagaaguggaagcgccagcugaaucagcugagcaaauccgaauuuaacacguacaagagaagcgggaucauggagguggaucgguccgaagccaaagagggacucaagagaggcgaaaccacaaaacaugcggugucucgcgggaccgccaagcugcggugguucguugagagaaaucuugucaagccugagggaaaagugauugaccugggcugugggcgcggaggcuggagcuauuacugcgcuggccucaagaaagugacagaagucaagggguauaccaaaggaggccccgggcacgaggaaccuauccccauggccacguacggauggaaccugguuaagcugcauuccggcaaagauguguuuuucaugccuccggagaagugugacacccuccuuugcgauaucggggaaucuagccccaauccuacaauugaggagggacggacccugagagugcugaagauggucgaacccuggcuccgcggcaaccaguuuuguaucaaaauucugaauccuuacaugcccuccgugguugaggcucuugaacaaaugcagcggaagcacggcgggaugcuggugagaaacccgcucucucgcaauagcacacacgagauguauugggucuccugcggaaccggcaacaucgugagcgccguuaacaugacaucucggaugcugcugaauagauucaccauggcgcaucgcaaaccuacguacgagcgggacguggaucucggggccggaacaagacacgucgcuguggaacccgagguggccaaccuggacauuaucggccagcgcauugaaaauaucaagaacgagcauaaauccaccuggcacuaugaugaagacaaucccuacaagaccugggcuuaucacgggagcuacgaggucaagccuucuggauccgccagcucuaugguuaacggcguggugagacuucugacaaaacccugggaugucaucccuauggugacgcaaauugcuaugaccgacacaaccccguuuggccagcagcggguuuucaaggagaaaguggacacacgcacccccagagccaagcgggggacaacccagaucauggaagucacggcgaaauggcucuggggauuucuguccagaaauaagaagccucggauuuguacccgcgaggaauucacaagaaaagugcggagcaacgccgcuaucggcgccguuuuuguggaugagaaucaauggaacuccgcuaaggaagccgucgaggacgagcgcuucugggaucuugugcauagagaacgggagcugcacaaacaggggaagugcgccaccugcguuuauaauaugaugggaaaacgcgaaaagaagcucggcgaguuugggaaagcgaagggcagcagagcuauuugguacauguggcugggagcccgguuccuggaauucgaggcccucggcuuuaugaacgaggaccauugguucucucgcgaaaauagccuguccgggguggagggagaaggccuucacaaacugggguacauccucagagauaucucuaagauucccggaggcaacauguaugcugacgauacagccgggugggacacccggaucacggaggaugaccugcagaaugaggcuaaaauuacagaaaucauggagccugaacaugcccuucuggcgaccagcauuuuuaagcucacauaccagaacaaagucgugcgcguccaaagacccgccaagaacggcaccgugauggauguuaucucccggcgcgaccagagaggaucuggccagguggggacguauggacugaauaccuucacaaacauggagguccagcugauccggcaaauggaaagcgagggcauuuuucucccguccgagcuggaaaccccuaaucuugcugagagagugcuggauuggcucgaaaagcacggggccgagcgccugaaacggauggcuaucucuggagacgacugugugguuaagcccauugaugacagauucgccacagcgcuuaccgcccugaacgauaugggcaaagugcgcaaggacaucccucagugggaacccagcaaaggguggaaugauuggcagcaggucccuuuuugcucccaccauuuccaccaacucauuaugaaggacggccgggagaucgugguucccuguagaaaccaggaugagcuggugggacgcgcucgggucagccagggcgccggguggucucugagagaaacagcuugccucggaaaguccuacgcccaaauguggcagcugauguauuuucaucgccgggaccuuagacuggcugccaaugcgaucuguagcgccgugccggucgauugggugccuaccucucgcacgacaugguccauucacgcucaccaucaguggaugaccaccgaggacaugcucagcguuuggaaccggguguggaucgaagagaaucccuggauggaagauaaaacacacgucuccucuugggaggaggugcccuaccugggcaagagagaagaccaguggugcgggagccuuauuggacugaccgcccgggccacaugggcuacgaacauccaaguugccauuaaucaggugagacgccucaucggcaacgagaauuaucuggacuacaugaccuccaugaaacgguucaagaacgaaagcgauccugagggggcgcugugguga

SEQ ID NO: 18619 - RNA, 9879 nt, Artificial Sequence
  derived and/or modified CDS sequence (opt5) from DENV-1__GQ868517__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuuccucacccaggacgaaaagggggugacacagaacggaagacugaucacggcuaaucccauugucaccgauaaagagaagccugugaacaucgaaacagagccccccuuuggcgagucuuauauugugguuggggccggagaaaaagcccugaagcucuccugguucaagaaaggcagcucuaucgggaagauguuugaggcuaccgcccggggcgcuagacgcauggccauucugggagacacagcgugggauuucggcagcaucgggggagucuuuaccuccgugggcaaacuugugcaucaggucuucgggacggccuacggagugcuguuuucuggcguuagcuggaccaugaagaucgggauuggcauccuccugacauggcugggacuuaauucccggagcaccucucucuccaugacauguauugcugugggcauggucacccuguaccugggggugaugguucaagccgacagcggaugcgugaucaacuggaaaggcagagaacucaagugugggucuggaauuuucgucacaaacgaggugcacaccuggacggaacaguauaaguuucaggcugauuccccuaaacgccugagcgccgcgaucggcaaggccugggaggaggggguuugcggcauucgguccgcuacaagacuugaaaauaucauguggaaacagaucucuaacgagcugaaucauauucuccuggaaaacgacaugaaguucaccguggucgugggagacgccaauggcauccuggcucaagggaaaaagaugauucgcccgcagcccauggagcacaaauacagcuggaaguccuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcuuaagcucagagacucuuacacccaaaugugcgaucaccgccugaugagcgcggccauuaaagacuccaaggcuguccaugccgauaugggcuauuggaucgaaagcgagaaaaacgaaacauggaagcuggcccgggcuucuuucaucgagguuaagaccuguacauggcccaaaucccacacccucuggagcaauggggugcuggaaucugagaugauuaucccgaagauuuacggaggcccuaucucccagcauaacuauagacccggguacuucacgcagaccgccggaccuuggcaccuuggcaaacuggagcucgacuuugaucugugcgaagggacaaccguggucguggacgagcacugcggaaaucgcggccccagccugcggacaaccacgguuacaggcaagauuauccaugaaugguguugcagaucuuguacccuuccuccccuccgguuccgcggggaggauggaugcugguacggcauggagaucagaccggugaaagaaaaggaggaaaaccugguccggagcaugguguccgcggggagcggagagguugacucuuuuucccugggcauucucugugcuagcaucaugauugaagaggugaugagaucccgcuggucucggaagaugcugaugacagggacccuugccgucuuccugcuccugaucaugggacaacugaccuggaaugaccuuauuagacugugcaucauggugggcgccaacgcuagcgaucgcaugggcauggggacaacguaucucgcccugauggcgaccuuuaaaaugagaccuauguucgcuguuggacuccuguuucggcgccuuacauccagagaggugcugcuccugaccauuggccugucucuugucgccagcguggaacugcccaacucccucgaggaacugggggacggacucgccaugggcaucaugaugcugaagcuucugacagaguuccagccccaccagcucuggaccacgcugcugucucuuacauuuaucaaaaccacccugagccucgauuacgcuuggaagacaaccgccauggugcuguccauugucagccucuucccucugugucuuucuacaacgucccagaaaaccacauggcugccgguucugcucgggagcuuuggaugcaagccccugaccauguuccuuaucacagaaaauaagauuuggggccggaaaucuuggccucugaacgagggcaucauggcuauugggaucguguccauccuccugagcucucuccugaagaaugacgugccccuugccggaccucugauugcgggcgggaugcugaucgccuguuaugucauuuccggaagcuccgcugaucucagccuggagaaagccgcugaagugucuugggagcaagaagccgagcauagcggcaccucccacaacauccuuguugaagugcaggacgaugggacgaugaagauuaaagacgaggagcgcgaugacacccugacaauccuccugaaggccacccuccuggcugucucuggaguguaccccaugagcaucccugcgacacuuuuuguuugguauuucuggcagaaaaagaagcagagauccggcgugcugugggauacccccucuccgccugaagucgagcgggccgugcuggacgauggcauuuaccgcauccuccaaagagggcugcuuggacggagccaggucggcguggggguuuuccaggacggaguguuucauacaauguggcacgucacgcgcggcgcugugcugauguaucaggggaaaagacucgaacccuccugggccucuguuaagaaagaccugauuagcuacggaggcggcuggcgguuccaaggguccuggaauaccggagaggaggugcaggucaucgccguggaaccuggcaagaaccccaaaaaugugcagacaaccccggggaccuuuaagacaccugagggagaaguuggcgcuauugcccucgauuucaagcccgggacgagcggaucuccuaucgucaacagagagggcaaaauugugggccuguacgggaauggaguggucaccacauccggcaccuaugugagcgcgaucgcucaagccaaggccucucaggaagggccccuucccgagaucgaggacgaaguuuuuaaaaagcgcaaccugacaauuauggaucugcacccuggauccggcaaaacccggagauaccucccggcuaucgugcgcgaggccauuaagcggaagcugagaacgcuuauccuggcgcccacacgcgucguggcuagcgaaauggccgaggcccucaaagggaugccuauucgguaucagaccaccgcuguuaaguccgaacauacaggcagagagaucguggaccugaugugccacgccaccuucacaaugcgccugcucucucccguccgggugccuaauuacaacaugaucauuauggaugaggcucauuuuaccgaccccgccagcaucgcggccagaggauauauuuccacgcggguuggcaugggggaagcugccgcuaucuucaugacagccaccccuccgggaagcguggaggccuuuccccagucuaaugcugucauucaagaugaagagcgcgacaucccugaaagauccuggaacagcggcuacgauuggaucacagacuuccccgggaaaaccgugugguuugugccuucuauuaagagcggaaaugauaucgcgaacugucuucggaaaaacggcaagcgcgucauucagcuguccagaaagacguucgacaccgaguaucagaaaacaaagaauaacgacugggauuacguugugaccacagacaucucugagaugggggccaauuuccgggcugauagagugauugacccccgccggugccugaaaccggucauccucaaggauggcccugaaagagugauucuggccggacccaugcccguuaccguggccagcgcugcccagcgccggggcagaaucgggcgcaaccaaaauaaagagggagaccaguacgucuauaugggccagccucuuaacaaugaugaagaccacgcgcauuggacagaggcuaagaugcugcucgauaacaucaauacccccgaggggauuaucccugcccuguuugaaccggagcgggaaaaguccgccgcuauugacggagaguacagacugcgcggcgaagccagaaaaacguucguggagcucaugcggcgcggggaucuucccguuuggcugucuuauaagguggcgagcgagggcuuucaguacuccgacagacgguggugcuucgauggagaacgcaacaaucaaguccuggaggaaaacauggacguggagaucuggacaaaagaaggcgagagaaagaaacuccggccuagauggcuggacgcccgcaccuauagcgauccccuugcucugcgggaguuuaaggaauucgccgcugggagacgcucugucuccggagaccucauucuggagaucggcaaacugccucagcaccucacccuucgggcccagaaugcucuggauaaccuggugaugcuccacaauagcgaacaggggggaaaggccuacagacaugcgauggaggaacugcccgacacaaucgagacccuuaugcugcucgcccugauugcuguucugacaggcggcgugacgcucuuuuuccuuuccgggaagggacugggcaaaaccucuaucgggcugcucugugugacagccagcuccgcucugcuuuggauggccucugucgagccgcacuggauugccgcuagcaucauucuggaauuuuuccucaugguucugcugaucccugagcccgaucggcaacgcaccccucaggacaaccagcucgcguauguggugaucggacuucuguuuaugauucugacagucgccgcuaacgaaaugggccuccuggagaccacgaagaaagaucuugggaucggacauguggccgccgagaaucaccaacacgcuaccaugcuggacguugaucucagacccgccuccgcguggacacuguacgccguggcuaccacagucauuaccccuaugaugcggcauacgaucgaaaacacaaccgccaauauuagccugacagcuaucgccaaccaggcggccauucucaugggccuugacaagggcuggcccaucucuaaaauggauaucggggugccgcugcuggcucucggaugcuacucccaggucaauccucugacccuuaccgccgcugugcugaugcucguugcccacuaugcuauuaucggccccgggcugcaggccaaggcgacacgcgaggcccaaaagagaacggcugccggaauuaugaaaaaccccaccguggacggcaucgucgcuauugaucuggacccugugguuuacgacgccaaguucgaaaaacagcucgggcagaucaugcuucugauccuguguacaagccagauucuccugaugcggaccacaugggcccuuugcgagucuaucacccuggcgacgggaccgcucacaacccugugggaaggcucccccggcaaguuuuggaauaccacaauugcugugagcauggccaacaucuuccgcgggucuuaucuggcuggagccggccucgccuucagccuuaugaaaucccuggggggaggcagacgggggaccggagcucaaggcgagacacugggcgagaaguggaagcgccagcucaaucagcugucuaaaagcgaauuuaacacguacaagagauccgggauuauggaggucgaucggagcgaagccaaagagggacuuaagagaggcgaaaccacaaaacaugcggugucccgcgggaccgccaagcugcggugguucguggagagaaaucucguuaagccugagggaaaagucaucgaccugggcugugggcgcggaggcuggucuuauuacugcgcuggccugaagaaagugacagaagugaagggguauaccaaaggaggccccgggcacgaggaaccuauccccauggccacguacggauggaaccucgucaagcuucauagcggcaaagauguuuuuuucaugccuccggagaagugugacacccugcugugcgauauuggggaauccucucccaauccuacaaucgaggagggacggacccucagagugcugaagaugguggaacccuggcuucgcggcaaccaguuuuguauuaaaauccugaauccuuacaugcccagcgucguggagacacucgaacaaaugcagcggaagcacggcgggaugcugguuagaaacccgcugucccgcaauucuacccacgagauguauugggugagcugcggaacaggcaacauugucuccgcugugaacaugaccagccggaugcuccugaauagauucacgauggcccaucgcaaaccuacauuugagcgggacguugaucuuggggcgggaaccagacacguggccgucgaacccgagguggcuaaccuggacaucauuggccagcgcaucgaaaauaucaagaacgagcauaaaucuaccuggcacuacgaugaagacaaucccuauaagacaugggccuaccacggguccuaugaggugaagccuagcggaucugcuuccagcauggucaacggcguugugagacuccugacgaaacccugggaugugauuccuauggucacccaaaucgccaugacagacaccacaccguucggccagcagcggguguuuaaggagaaaguugacacccgcacacccagagcuaagcgggggaccacgcagauuauggaagugaccgccaaauggcuuuggggauuccugucuagaaauaagaagccucggaucuguacacgcgaggaauuuaccagaaaaguccgguccaacgcggccauuggcgcuguguucguugaugagaaucaauggaacagcgccaaggaagcuguggaggacgagcgcuuuugggaucucguccauagagaacgggagcugcacaaacaggggaagugcgccacaugcguguacaauaugaugggaaaacgcgaaaagaagcugggcgaguucgggaaagccaagggcuccagagcgaucugguauauguggcucggagcucgguuccuggaauuugaggcccuuggcuucaugaacgaggaccauugguuuagccgcgaaaauucucugagcgggguugagggagaaggccuccacaaacugggguacauccuuagagauauuuccaagauccccggaggcaacauguacgccgacgauaccgcugggugggacacgcggauuacagaggaugaccugcagaaugaggccaaaaucaccgauauuauggaaccugagcaugcucuccuggccacaucuaucuucaagcugaccuaucagaacaaagugguccgcgugcaaagacccgcgaagaacggcacggucauggacgugaucagccggcgcgaucagagaggauccggccagguugggaccuacggacucaauacauuuaccaacauggaagugcagcugauucggcaaauggagucugaaggcaucuuccuuccgagcgagcuggagacaccuaaucucgccgaaagaguccuggacuggcuugagaagcacggggcugaacgccugaaacggauggccauuuccggagacgauuguguggugaagcccaucgacgauagauuugcuaccgcccucacagcgcugaacgacaugggcaaaguucgcaaggauauuccucagugggagcccucuaaaggguggaaugacuggcagcaggugccuuucugcagccaccauuuucaccaacugaucaugaaggauggccgggaaaucgucgugcccuguagaaaccaggacgagcucguuggacgcgcccgggugucccagggcgcuggguggagccugagagagaccgccugccuuggaaagucuuaugcucaaauguggcagcugauguacuuccaucgccgggaucucagacuggccgcuaaugccauuuguuccgcggucccgguggacugggucccuacgagccgcacaaccuggucuauccacgcccaccaucaguggaugaccacagaagauaugcuuuccguguggaaccggguuuggauugaggaaaaucccuggauggaggacaaaacccacgugagcuccugggaagagguccccuaucugggcaagagagaggaccaguggugcgggucucucaucggacugacagcucgggccacgugggccaccaacauucaaguggcuaucaaucagguuagacgccugauuggcaacgaaaauuaccucgauuauaugacaagcaugaaacgguuuaagaacgaguccgacccugaaggggcccugugguga

SEQ ID NO: 18620 - RNA, 9879 nt, Artificial Sequence
  derived and/or modified CDS sequence (opt5) from DENV-1__GU131976__SS-prME
agcgugaccaugcugcugaugcugcuucccacagcccuggcuuuccaccucacgaccagaggcggggagccucauaugaucgucuccaagcaggaacggggaaagucucugcuuuuuaagacaagcgccggcguuaacaugugcacccugauugcgauggaccucggggagcugugugaagauacaaugaccuacaagugcccccagaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagaacaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccgcccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaaacuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuucccucaugaucgaagaggugaugagaucucgcuggagccggaagaugcugaugacagggacccuugccgucuuccugcuccugauuaugggacaacugaccuggaaugaccuuaucagacugugcauuauggugggcgccaacgcuuccgaucgcaugggcauggggacaacguaucucgcccugauggcgaccuuuaaaaugagaccuauguucgcuguuggacuccuguuucggcgccuuacaucuagagaggugcugcuccugaccaucggccugagccuugucgccuccguggaacugcccaacucucucgaggaacugggggacggacucgccaugggcauuaugaugcugaaacuucugacagaguuccagccccaccagcucuggaccacgcugcugagccuuacauuuaucaaaaccacccugucccucgauuacgcuuggaagacaaccgccauggcucugagcaucgugucucucuucccucugugucuuuccacaacgagccagaaaaccacauggcugccgguccugcucgggucuuuuggaugcaagccccugaccauguuccuuauuacagaaaauaagaucuggggccggaaauccuggccucugaacgagggcauuauggccaucgggauuguuagcauccuccugucuucccuccugaagaaugacgugccccuugcgggaccucugaucgccggcgggaugcugauugcuuguuaugugaucagcggauccagcgccgaucucucucuggagaaagcugccgaagucagcugggagcaagaagccgagcauuccggcaccucucacaacauucuuguggaaguucaggacgaugggacgaugaagaucaaagacgaggagcgcgaugacacccugacaauucuccugaaggcuacccuccuggcggugagcggagucuaccccauguccaucccugccacacuuuuugugugguauuucuggcagaaaaagaagcagagaucuggcguucugugggauacccccagcccgccugaaguggagcgggcuguccuggacgauggcaucuaccgcauucuccaaagagggcugcuuggacggucccaggugggcgucgggguguuccaggacggaguuuuucauacaauguggcacgugacgcgcggcgccguccugauguaucaggggaaaagacucgaacccucuugggccagcgugaagaaagaccugaucuccuacggaggcggcuggcgguuccaagggagcuggaauaccggagaggagguucaggugauugcugucgaaccuggcaagaaccccaaaaaugugcagacaaccccggggaccuuuaagacaccugagggagaagugggcgccaucgcgcucgauuucaagcccgggacgucuggauccccuauuguuaacagagagggcaaaaucgucggccuguacgggaauggaguggugaccacaagcggcaccuaugucucugcuauugcccaagccaaggcuucccaggaagggccccuucccgagaucgaggacgaaguguuuaaaaagcgcaaccugacaaucauggaucugcacccuggaagcggcaaaacccggagauaccucccggccauuguucgcgaggcgaucaagcggaagcugagaacgcuuauucuggcucccacacgcguggucgccuccgaaauggccgaggcucucaaagggaugccuauccgguaucagaccaccgccgugaagucugaacauacaggcagagagauuguugaccugaugugccacgcuaccuucacaaugcgccugcucagccccgugcgggucccuaauuacaacaugaucaucauggaugaggcccauuuuaccgaccccgcguccauugccgcuagaggauauaucagcacgcgggugggcaugggggaagccgcugccauuuucaugacagccaccccuccgggaucuguugaggcuuuuccccaguccaaugcggugauccaagaugaggaacgcgacauuccugaaagaagcuggaacucuggcuacgauuggaucacagacuuccccgggaaaaccgucugguuugugccuagcaucaaguccggaaaugauauugccaacugucuucggaaaaacggcaagcgcgugauccagcugucuagaaagacguucgacaccgaguaucagaaaacaaagaauaacgacugggauuacgucguuaccacagacauuagcgagaugggggcuaauuuccgggccgauagagugaucgacccccgccggugccugaaaccggugauucucaaggauggcccugaaagagucauccuggccggacccaugcccgugaccguugcuuccgccgcgcagcgccggggcagaauugggcgcaaccaaaauaaagagggagaccaguacguguauaugggccagccucuuaacaaugaugaagaccacgcucauuggacagaggccaagaugcugcucgauaacaucaauacccccgaggggaucauuccugcccuguuugaaccggagcgggaaaagucugcugccaucgacggagaguacagacugcgcggcgaagcgagaaaaacguucgucgagcucaugcggcgcggggaucuucccguguggcugagcuauaagguugccuccgagggcuuucaguacagcgacagacgguggugcuucgauggagaacgcaacaaucaagugcuggaggaaaacauggacgucgagauuuggacaaaagaaggcgagagaaagaaacuccggccuagauggcuggacgcucgcaccuauucugauccccuugcccugcgggaguuuaaggaguucgcugccgggagacgcuccgugagcggagaccucauccuggagauuggcaaacugccucagcaccucacccuuaaggcucagaaugcccuggauaaccuggucaugcuccacaauuccgaacaagggggaaaggcguaccggcaugccauggaggaacugcccgacacaaucgagacccuuaugcugcucgcucugaucgccgugcugacaggcggcguuacgcucuuuuuccuuucugggaaaggacugggcaagaccagcauugggcugcucugugugacagcuuccucugcccugcuuuggauggccagcguggagccgcacuggaucgcugcguccauuauccuggaauuuuuccucaugguccugcugauuccugagcccgauagacaacggaccccucaggacaaccagcucgccuauguugugaucggacuucuguuuaugauccugacaguggcugccaacgaaaugggccuccuggagaccacgaaaaaggaucuugggauuggacaugucgccgcugagaaucaccaacacgccaccaugcuggacguggaucuccgccccgcgagcgccuggacacuguacgcuguugccaccacagugaucaccccuaugaugagacauacgauugaaaacacaaccgcuaauaucucucugacagccauugcgaaccaggccgcuauccucaugggccuugacaaaggcuggcccauuuccaagauggauaucggggucccgcugcuggcccucggaugcuacagccaggugaauccucugacccuuaccgcugccguccugaugcucguggcucacuaugccaucauuggccccgggcugcaggcgaaggccacacgggaggcucaaaaacgcacggccgcuggaaucaugaagaaccccaccguugacggcauuguggccaucgaucuggacccugucguguacgacgccaaauucgaaaagcagcucgggcagauuaugcuucugauccuguguacaucucagauccuccugaugagaaccacaugggcgcuuugcgaguccauuacccuggcuacgggaccgcucacaacccugugggaaggcagccccggcaaauuuuggaauaccacaaucgccguuucuauggcuaacauuuuccgggggagcuaucuggccggagccggccucgcuuucucccuuaugaagucucucgggggaggccgcagagggaccggagcccaaggcgagacacugggcgagaaguggaaacggcagcucaaucagcugagcaaguccgaauuuaacacguacaaacgcagcgggaucauggagguggauagauccgaagcgaaggagggacuuaaacggggcgaaaccacaaagcaugccgucucuagagggaccgcuaagcugcgcugguucguggagcggaaucucgugaaaccugagggaaagguuauugaccugggcugugggagaggaggcuggagcuauuacugcgccggccugaaaaaggucacagaagugaaaggguauaccaagggaggccccgggcacgaggaaccuauccccauggcuacguacggauggaaccucgugaaacuucauuccggcaaggaugucuuuuucaugccuccggagaagugugacacccugcugugcgauaucggggaaucuagccccaauccuacaauugaggagggacgcacccuccggguucugaaaaugguggaacccuggcuuagaggcaaccaguuuuguaucaagauucugaauccuuacaugcccuccguggucgagacacucgaacaaaugcagcgcaaacacggcgggaugcuggugcggaacccgcugucuagaaauagcacccacgagauguauuggguuuccugcggaacaggcaacaucgugagcgccgucaacaugaccucucgcaugcuccugaaucgguucacgauggcgcauagaaagccuacauuugagcgcgacguggaucuuggggccggaacccggcacguugcuguggaacccgaggucgccaaccuggacauuaucggccagagaauugaaaauaucaaaaacgagcauaaguccaccuggcacuacgaugaagacaaucccuauaagacaugggcuuaccacgggagcuaugaggugaaaccuucuggauccgccagcucuauggugaacggcgucguucgccuccugacgaagcccugggaugugaucccuauggugacccaaauugcuaugacagacaccacaccguucggccagcagagagucuuuaaagagaagguggacacccggacaccccgcgccaaaagagggaccacgcagaucauggaaguuaccgcgaaguggcuuuggggauuccugucccggaauaagaaaccuagaauuuguacacgggaggaauuuacccgcaaggugagaagcaacgccgcuaucggcgccgucuucguggaugagaaucaauggaacuccgcuaaagaagccguugaggacgagcgguuuugggaucucgugcaucgcgaaagagagcugcacaagcaggggaaaugcgccacaugcgucuacaauaugaugggaaagcgggaaaagaaacugggcgaguucgggaaggcgaaaggcagccgcgcuauuugguauauguggcucggagccagauuccuggaauuugaggcccuuggcuucaugaacgaggaccauugguuuucucgggaaaauagccuguccgggguggagggagaaggccuccacaagcugggguacauccuucgcgauaucucuaaaauucccggaggcaacauguacgcugacgauaccgccgggugggacacgagaaucacagaggaugaccugcagaaugaggcuaagauuaccgauaucauggaaccugagcaugcccuccuggcgacaagcauuuucaaacugaccuaucagaacaagguugugcggguccaacgccccgccaagaacggcacggugauggacgucaucuccagacgggaucagcgcggaucuggccagguggggaccuacggacucaauacauuuaccaacauggaaguucagcugaucagacaaauggagagcgaaggcauuuuccuuccguccgagcuggagacaccuaaucucgcugaacgggugcuggacuggcuugagaaacacgggaccgaaagacugaagcgcauggccaucucuggagacgauugugucgugaaacccauugacgaucgguuugcuacagcccucaccgcgcugaacgacaugggcaaggugagaaaagauaucccucagugggagcccagcaagggguggaaugacuggcagcagguuccuuucugcucccaccauuuucaccaacugauuaugaaggauggccgcgaaaucgugguccccugucggaaccaggacgagcucgugggcagagcucgcguuagccagggagcuggguggucucugcgggagacggccugccuuggaaaauccuaugcucaaauguggcagcugauguacuuccauagacgcgaucuccggcuggccgcuaaugccaucuguagcgcggugccggucgacugggugccuacaucuagaaccaccugguccauucacgcccaccaucaguggaugacaaccgaagauaugcuuagcgucuggaaccgcguguggaucgaggaaaaucccuggauggaggacaagacacacguuuccucuugggaagaggugcccuaucugggcaaacgggaggaccaguggugcgggagccucauuggacugacggcuagagccaccugggccacaaacauccaagucgcuauuaaucaggugcggagacugaucggcaacgaaaauuaccucgauuauaugaccuccaugaagcgcuuuaaaaacgagagcgacccugaaggggcccugugguga

SEQ ID NO: 18621 - RNA, 9879 nt, Artificial Sequence
  derived and/or modified CDS sequence (opt5) from DENV-1__GQ868518__SS-prME
agcgugaccaugcugcucaugcugcuucccacagcccuggcuuuccaccucacgacccggggcggggaaccucauaugaucgucuccaagcaggaacggggaaagucucugcuuuuuaagacaagcgccggcguuaacaugugcacccugauugcgauggaccucggggaacugugugaagauacaaugaccuacaaaugcccccagaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagaacaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccgcccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaaacuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucgugaugggacaacugaccuggaaugaccugaucagacuuugcauuaugguuggcgccaacgcuuccgaucgcaugggcauggggacaacguaucuggcccucauggcgaccuuuaaaaugagaccuauguucgcugugggacugcucuuucggcgccugacaucuagagagguccuucugcucaccaucggccugagccugguggccuccguggaacuucccaacucucuggaggaacucggggacggacuggccaugggcauuaugaugcucaagcugcuuacagaguuccagccccaccagcuguggaccacgcuccugagccugacauuuaucaaaaccacccuuucccuggauuacgcuuggaagacaaccgccauggcucucagcaucgucucucuguucccucucugucuguccacaacgagccagaaaaccacauggcuuccgguucugcuggggucuuuuggaugcaagccccucaccauguuccugauuacagaaaauaagaucuggggccggaaauccuggccucuuaacgagggcauuauggccaucgggauugugagcauccugcucucuucccugcucaagaaugacgugccccuggcgggaccucuuaucgccggcgggaugcugauugcuuguuaugucaucagcggauccagcgccgaucugucucucgagaaagcugccgaagugagcugggagcaagaagccgagcauuccggccccucucacaacauucugguugaagugcaggacgaugggaccaugaagaucaaagacgaggagcgcgaugacacgcuuaccauucugcucaaggcuacacugcucgcggucagcggaguguacccuauguccauccccgccacccuguuuguuugguauuucuggcagaaaaagaagcagagaucuggcgugcuuugggauacaccgagcccucccgaagucgagcgggcugugcuggacgauggcaucuaccgcauucugcaaagagggcuccugggacggucccaggucggcguggggguuuuccaggacggaguguuucauaccauguggcacgucacacgcggcgccgugcuuauguaucaggggaaaagacuggaaccuucuugggccagcguuaagaaagaccucaucuccuacggaggcggcuggcgguucagagggagcuggaauacgggagaggaggugcaagucauugcuguggaacccggcaagaacccgaaaaaugugcagaccacaccugggaccuuuaagacccccgagggagaaguuggcgccaucgcgcuggauuucaagccugggacaucuggaucccccauugucaaccgcgagggcaaaaucgugggccucuacgggaauggaguggucacgaccagcggcacauaugugucugcuauugcccaggccaaggcuucccaagaagggccccugccugagaucgaggacgaaguuuuuaaaaagcggaaccuuaccaucauggaucugcacccgggaagcggcaaaacaagacgcuaccugcccgccauugugcgggaggcgaucaagagaaagcuccgcacccugauucuugcuccuacgcgggucguggccuccgaaauggccgaggcucugaaagggaugcccaucagauaucagacaaccgccguuaagucugaacauaccggccgcgagauuguggaccucaugugccacgcuacauucaccaugcggcugcugagcccugucagagugcccaauuacaacaugaucaucauggaugaggcccauuuuacagacccugcguccauugccgcucggggauauaucagcacccgcguuggcaugggggaagccgcugccauuuucaugacggccacaccgcccggaucuguggaggcuuuuccucaguccaaugcggucauccaggaugaagagagagacauucccgaacggagcuggaacucuggcuacgauuggaucaccgacuucccugggaaaacagugugguuugugcccagcaucaaguccggaaaugauauugccaacugucuccgcaaaaacggcaagagagucauccaacuuucucggaagaccuucgacacggaguaucagaaaaccaagaauaacgacugggauuacguugugacaaccgacauuagcgagaugggggcuaauuucagagccgaucgcgugaucgacccgcggagaugccugaaaccugucauucugaaggauggccccgaacgcgugauccucgccggacccaugccuguuacaguggcuuccgccgcgcagcggagaggccgcauugggcggaaccagaauaaagagggagaccaauacgucuauaugggccagccccugaacaaugaugaagaccacgcucauuggaccgaggccaagaugcuucuggauaacaucaauacaccugaggggaucauuccggcccucuuugaacccgagagagaaaagucugcugccaucgacggagaguaccgccugagaggcgaagcgcggaaaaccuucguggagcugaugcgcagaggggaucucccuguuuggcuuagcuauaagguggccuccgagggcuuucaguacagcgaccggcgcuggugcuucgauggagaaagaaacaaucagguccuggaggaaaacauggacguggagauuuggacgaaagaaggcgagcggaagaaacugagaccccgcuggcucgacgcucggacauauucugauccucuggcccuuagagaguuuaaggaguucgcugccgggcgccgguccgucagcggagaccugauccucgagauuggcaaacugccccaacaccugaccuccagagcucagaaugcccucgauaaccuugugaugcugcacaauucugaacaagggggaaaggcguaccggcaugccauggaggaacugccggacaccaucgagacacucaugcugcuugcucugaucgccguucucaccggcggcgugacacuguuuuuccugagcgggaagggacucggcaaaacguccauugggcuucugugugugaccgcuucuagcgcccugcucuggauggccuccgucgagccucacuggaucgcugcgagcauuauccuggaauuuuuccuuaugguucugcucauucccgagccugaucgccagagaacaccccaagacaaccagcuggccuauguggugaucggacugcucuuuaugauccuuaccgucgcugccaacgaaaugggccugcuggagacaaccaagaaagaucucgggauuggacauguggccgcugagaaucaccagcacgccacgaugcuggacguugaucuucggccugcgucugccuggacccuguacgcuguggccacaaccgucaucacacccaugaugcgccauaccauugaaaacacgacagcuaauaucucccucaccgccauugcgaaccaagccgcuauccugaugggccuggacaagggcuggccgauuagcaaaauggauaucggggugccucuccuugcccugggaugcuacucucaggucaauccccugacacucaccgcugccgugcugaugcuuguugcucacuaugccaucauuggccccgggcugcaggcgaaggccaccagagaggcucagaagcggacagccgcuggaaucaugaaaaacccuacgguggacggcauugucgccaucgaucucgacccggugguuuacgacgccaaguucgaaaaacaacuggggcagauuaugcugcucauccuuuguaccucccagauccugcugaugcgcacaaccugggcgcucugcgagagcauuacacuggcuaccggaccccuuacgacacugugggaaggcucuccuggcaaguuuuggaauaccaccaucgccgugagcauggcuaacauuuucagaggguccuaucucgccggagccggccuggcuuucucucugaugaaaagccucgggggaggccggcgcgggacaggagcccagggcgagacccuuggcgagaaguggaagagacaacugaaucagcuguccaaaagcgaauuuaacacauacaagcgguccgggaucauggaggucgauagaucugaagcgaaagagggacucaagcgcggcgaaacgaccaaacaugccgugagccgggggacagcuaagcugagaugguucguggagcgcaaucuuguuaagcccgagggaaaagucauugaccugggcugugggcggggaggcugguccuauuacugcgccggccucaagaaagugaccgaagugaagggguauacaaaaggaggcccugggcacgaggaacccaucccuauggcuaccuacggauggaaccuggucaagcugcauucuggcaaagauguguuuuucaugccgcccgagaagugugacacgcuccuuugcgauaucggggaaagcuccccuaaucccaccauugaggagggaagaacacugcgcguucugaagaugguggaaccuuggcuccggggcaaccaguuuuguaucaaaauucugaaucccuacaugccgucugucguggagacccuugaacagaugcaaagaaagcacggcgggaugcugguucgcaacccucucagcagaaauuccacacacgagauguauugggugagcugcggaaccggcaacaucgucucugccgugaacaugacauccagaaugcugcugaaucgcuucaccauggcgcaucggaaacccacguacgagagagacguugaucucggggccggaacacgccacguggcugucgaacccgagguggccaaccuggacauuaucggccagagaauugaaaauaucaagaacgagcauaaaagcaccuggcacuaugaugaagacaauccuuacaagaccugggcuuaucacgggucuuacgaggugaagcccuccggaagcgccucuuccauggucaacggcguugugcggcuucugacaaaaccuugggaugugaucccgauggucacgcagauugcuaugaccgacacaacccccuuuggccaacagcgcguguucaaggagaaaguugacacaagaaccccucgggccaagagagggacaacccagaucauggaagugacggcgaaauggcucuggggauuucugagccggaauaagaagccccgcauuuguaccagagaggaguucacacggaaaguccgcuccaacgccgcuaucggcgccguguuuguugaugagaaucaguggaacagcgcuaaggaagccguggaggacgagagauucugggaucuuguccaucgggaacgcgagcugcacaaacaagggaagugcgcuaccugcguguauaauaugaugggaaaaagagaaaagaagcucggcgaguuugggaaagcgaagggcucucgggcuauuugguacauguggcugggagcccgcuuccuggaguucgaggcccucggcuuuaugaacgaggaccauugguucagcagagaaaauucccugucugggguugagggagaaggccuucacaaacugggguacauccuccgggauaucagcaagauuccuggaggcaacauguaugcugacgauacagccgggugggacacccgcaucacggaggaugaccugcagaaugaggcuaaaauuacagaaaucauggagcccgaacaugcccuucuggcgaccuccauuuuuaagcucacauaccagaacaaaguggucagagugcagcggccggccaagaacggcaccgucauggaugugaucucucgcagagaccaacggggaagcggccagguugggacguauggacugaauaccuucacaaacauggaggugcagcugaucagacagauggaauccgagggcauuuuucucccuucugagcuggaaacccccaaucuugcugagcgcguccuggauuggcucgaaaagcacggggccgagcggcugaaaagaauggcuaucagcggagacgacuguguggugaagccuauugaugaccgcuucgccacagcgcuuaccgcccugaacgauaugggcaaaguucggaaggacaucccccaaugggaaccuuccaaaggguggaaugauuggcaacaggugcccuuuugcagccaccauuuccaccagcucauuaugaaggacggcagagagaucgucgugccgugucgcaaccaagaugagcugguuggacgggcuagagugucucagggcgccggguggucccugcgcgaaacagcuugccucggaaagagcuacgcccagauguggcaacugauguauuuucaucggagagaccuucgccuggcugccaaugcgaucuguucugccgucccuguggauuggguccccaccucccggacgacauggagcauucacgcucaccaucaguggaugaccaccgaggacaugcucuccguguggaacagaguuuggaucgaagagaaucccuggauggaagauaaaacacacgugucuagcugggaggaggucccuuaccugggcaagcgggaagaccaguggugcgggucccuuauuggacugaccgccagagccacaugggcuacgaacauccagguggccauuaaucaaguucgccggcucaucggcaacgagaauuaucuggacuacaugaccagcaugaaaagauucaagaacgaaucugauccggagggggcgcugugguga

SEQ ID NO: 18622 - RNA, 9879 nt, Artificial Sequence
  derived and/or modified CDS sequence (opt5) from DENV-1__GQ868519__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuuccucacccaggacgaaaagggggugacacagaacggaagacugaucacggcuaaucccauugucaccgauaaagagaagccugugaacaucgaaacagagccccccuuuggcgagucuuauauugugguuggggccggagaaaaagcccugaagcucuccugguucaagaaaggcagcucuaucgggaagauguuugaggcuaccgcccggggcgcuagacgcauggccauucugggagacacagcgugggauuucggcagcaucgggggagucuuuaccuccgugggcaaacuugugcaucaggucuucgggacggccuacggagugcuguuuucuggcguuagcuggaccaugaagaucgggauuggcauccuccugacauggcugggacuuaauucccggagcaccucucucuccaugacauguauugcugugggcauggucacccuguaccugggggugaugguucaagccgacagcggaugcgugaucaacuggaaaggcagagaacucaagugugggucuggaauuuucgucacaaacgaggugcacaccuggacggaacaguauaaguuucaggcugauuccccuaaacgccugagcgccgcgaucggcaaggccugggaggaggggguuugcggcauucgguccgcuacaagacuugaaaauaucauguggaaacagaucucuaacgagcugaaucauauucuccuggaaaacgacaugaaguucaccguggucgugggagacgccaauggcauccuggcucaagggaaaaagaugauucgcccgcagcccauggagcacaaauacagcuggaaguccuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcuuaagcucagagacucuuacacccaaaugugcgaucaccgccugaugagcgcggccauuaaagacuccaaggcuguccaugccgauaugggcuauuggaucgaaagcgagaaaaacgaaacauggaagcuggcccgggcuucuuucaucgagguuaagaccuguacauggcccaaaucccacacccucuggagcaauggggugcuggaaucugagaugauuaucccgaagauuuacggaggcccuaucucccagcauaacuauagacccggguacuucacgcagaccgccggaccuuggcaccuuggcaaacuggagcucgacuuugaucugugcgaagggacaaccguggucguggacgagcacugcggaaaucgcggccccagccugcggacaaccacgguuacaggcaagauuauccaugaaugguguugcagaucuuguacccuuccuccccuccgguuccgcggggaggauggaugcugguacggcauggagaucagaccggugaaagaaaaggaggaaaaccugguccggagcaugguguccgcggggagcggagagguugacucuuuuucccugggcauucucugugcuagcaucaugauugaagaggugaugagaucccgcuggucucggaagaugcugaugacagggacccuugccgucuuccugcuccuggugaugggacaacugaccuggaaugaccuuaucagacugugcauuaugguuggcgccaacgcuagcgaucgcaugggcauggggacaacguaucucgcccugauggcgaccuuuaaaaugagaccuauguucgcugugggacuccuguuucggcgccuuacauccagagagguccugcuccugaccaucggccugucucuuguggccagcguggaacugcccaacucccucgaggaacugggggacggacucgccaugggcauuaugaugcugaagcuucugacagaguuccagccccaccagcucuggaucacccugcugucucuuacguuuaucaaaacaacccugagccucgauuacgcuuggaagaccacagccauggcucuguccauugucagccucuucccucugugucuuucuaccacaucccagaaaacgaccuggcugccgguucugcucgggagcuuuggaugcaagccccugacaauguuccuuaucaccgaaaauaagauuuggggccggaaaucuuggccucugaacgagggcaucauggccauugggaucguguccauccuccugagcucucuccugaagaaugacgugccccuugcgggaccucugauugccggcgggaugcugaucgcuuguuaugucauuuccggaagcuccgccgaucucagccuggagaaagcugccgaagugucuugggagcaagaagccgagcauagcggcacaucccacaacauccuuguugaagugcaggacgaugggaccaugaagauuaaagacgaggagcgcgaugacacgcugaccauccuccugaaggcuacacuccuggcggucucuggaguguaccccaugagcaucccugccacccuuuuuguuugguauuucuggcagaaaaagaagcagagauccggcgugcugugggauacacccucuccgccugaagucgagcgggcugugcuggacgauggcauuuaccgcauccuccaaagagggcugcuuggacggagccaggucggcguggggguuuuccaggacggaguguuucauaccauguggcacgucacacgcggcgccgugcugauguaucaggggaaaagacucgaacccuccugggccucuguuaagaaagaccugauuagcuacggaggcggcuggcgguuccaaggguccuggaauacgggagaggaggugcaggucaucgcuguggaaccuggcaagaaccccaaaaaugugcagaccaugccggggacauuuaagaccccugagggagaaguuggcgccauugcgcucgauuucaagcccgggaccagcggaucuccuaucgucaacagagagggcaaaauugugggccuguacgggaauggaguggucacaacguccggcaccuaugugagcgcuaucgcccaagccaaggcuucucaggaagggccccuucccgagaucgaggacgaaguuuuuaaaaagcgcaaccugacaauuauggaucugcacccuggauccggcaaaacccggagauaccucccggccauggugcgcgaggcgaucaagcggaagcugagaacacuuauucuggcucccacccgcgucguggccagcgaaauggccgaggcucucaaagggaugccuauccgguaucagacgacagccguuaaguccgaacauaccggcagagagauuguggaccugaugugccacgcuaccuucacaaugcgccugcucucucccguccgggugccuaauuacaacaugaucaucauggaugaggcccauuuuaccgaccccgcgagcauugccgcuagaggauauaucuccacacggguuggcaugggggaagccgcugccauuuucaugaccgccacgccuccgggaagcguggaggcuuuuccccagucuaaugcggucauccaagaugaagagcgcgacauuccugaaagauccuggaacagcggcuacgauuggaucacagacuuccccgggaaaaccgugugguuugugccuucuaucaagagcggaaaugauauugccaacugucuucggaaaaacggcaagcgcgucauccagcuguccagaaagacauucgacaccgaguaucagaaaacgaagaauaacgacugggauuacguugugaccacagacauuucugagaugggggcuaauuuccgggccgauagagugaucgacccccgccggugccugaaaccggucauucucaaggauggcccugaaagagugauccuggccggacccaugcccguuaccguggcuagcgccgcgcagcgccggggcagaauugggcgcaaccaaaauaaagagggagaccaguacgucuauaugggccagccucuuaacaaugaugaagaccacgcucauuggacagaggccaagaugcugcucgauaacaucaauacccccgaggggaucauuccugcccuguuugaaccggagcgggaaaaguccgcugccaucgacggagaguacagacugcgcggcgaagcgagaaaaacauucguggagcucaugcggcgcggggaucuucccguuuggcugucuuauaagguggccagcgagggcuuucaguacuccgacagacgguggugcuucgauggagaacgcaacaaucaaguccuggaggaaaacauggacguggagauuuggaccaaagaaggcgagagaaagaaacuccggccuagauggcuggacgcucgcacguauagcgauccccuugcccugcgggaguuuaaggaauucgcugccgggagacgcucugucuccggagaccucauccuggagauuggcaaacugccucagcaccucacacuucgggcucagaaugcccuggauaaccuggugaugcuccacaauagcgaacaggggggaaaggcguacagacaugccauggaggaacugcccgacaccaucgagacccuuaugcugcucgcucugaucgccguucugacaggcggcgugacccucuuuuuccuuuccgggaagggacugggcaaaacaucuauugggcugcucugugugacggcuagcuccgcccugcuuuggauggccucugucgagccgcacuggaucgcugcgagcauuauccuggaauuuuuccucaugguucugcugauuccugagcccgaucggcaacgcaccccucaggacaaccagcucgccuauguggugaucggacuucuguuuaugauccugacagucgcugccaacgaaaugggccuccuggagaccacaaagaaagaucuugggauuggacauguggccgcugagaaucaccaacacgccaccaugcuggacguugaucucagacccgcguccgccuggacgcuguacgcuguggccaccacagucaucaccccuaugaugcggcauacaauugaaaacaccacggcuaauaucagccugacagccauugcgaaccaggccgcuauccucaugggccuugacaagggcuggcccauuucuaaaauggauaucggggugccgcugcuggcccucggaugcuacucccaggucaauccucugacccuuacagcugccgugcugaugcucguugcucacuaugccaucauuggccccgggcugcaggcgaaggccacccgcgaggcucaaaagagaaccgccgcuggaaucaugaaaaaccccacaguggacggcauugucgccaucgaucuggacccugugguuuacgacgccaaguucgaaaaacagcucgggcagauuaugcuucugauccuguguacgagccagauccuccugaugcggaccacaugggcgcuuugcgagucuauuacccuggcuacaggaccgcucaccacgcugugggaaggcucccccggcaaguuuuggaauacaaccaucgccgugagcauggcuaacauuuuccgcgggucuuaucuggccggagccggccucgcuuucagccuuaugaaaucccuggggggaggcagacgggggaccggagcccaaggcgagacacugggcgagaaguggaagcgccagcucaaucagcugucuaaaagcgaauuuaacaccuacaagagauccgggaucauggaggucgaucggagcgaagcgaaagagggacuuaagagaggcgaaacaacgaaacaugccgugucccgcgggaccgcuaagcugcggugguucguggagagaaaucucguuaagccugagggaaaagucauugaccugggcugugggcgcggaggcuggucuuauuacugcgccggccugaagaaagugacagaagugaagggguauaccaaaggaggccccgggcacgaggaaccuauccccauggcuacauacggauggaaccucgucaagcuucauagcggcaaagauguuuuuuucaugccuccggagaagugugacacccugcugugcgauaucggggaauccucucccaauccuacgauugaggagggacggacccucagagugcugaagaugguggaacccuggcuucgcggcaaccaguuuuguaucaaaauucugaauccuuacaugcccagcgucguggagacacucgaacaaaugcagcggaagcacggcgggaugcugguuagaaacccgcugucccgcaauucuacccacgagauguauugggugagcugcggaacaggcaacaucgucuccgccgugaacaugaccagccggaugcuccugaauagauucacaauggcgcaucgcaaaccuaccuacgagcgggacguugaucuuggggccggaacgagacacguggcugucgaacccgagguggccaaccuggacauuaucggccagcgcauugaaaauaucaagaacgagcauaaaucuacauggcacuaugaugaagacaaucccuacaagaccugggcuuaucacggguccuacgaggugaagccuagcggaucugccuccagcauggucaacggcguugugagacuccugaccaaacccugggaugugaucccuauggucacacaaauugcuaugacggacaccacaccguuuggccagcagcggguguucaaggagaaaguugacacccgcacacccagagccaagcgggggaccacacagaucauggaagugaccgcgaaauggcuuuggggauuucugucuagaaauaagaagccucggauuuguacgcgcgaggaauucaccagaaaaguccgguccaacgccgcuaucggcgccguguuuguugaugagaaucaauggaacagcgcuaaggaagccguggaggacgagcgcuucugggaucucguccauagagaacgggagcugcacaaacaggggaagugcgccacaugcguguauaauaugaugggaaaacgcgaaaagaagcugggcgaguuugggaaagcgaagggcuccagagcuauuugguacauguggcucggagcccgguuccuggaauucgaggcccuuggcuuuaugaacgaggaccauugguucagccgcgaaaauucucugagcgggguugagggagaaggccuccacaaacugggguacauccuuagagauaucuccaagauucccggaggcaacauguaugcugacgauaccgccgggugggacacacggaucaccgaggaugaccugcagaaugaggcuaaaauuacggaaaucauggagccugaacaugcccuccuggcgacaucuauuuuuaagcugaccuaccagaacaaagugguccgcgugcaaagacccgccaagaacggcacagucauggaugugaucagccggcgcgaccagagaggauccggccagguugggaccuauggacucaauacguucaccaacauggaggugcagcugauccggcaaauggaaucugagggcauuuuucuuccgagcgagcuggaaacaccuaaucucgcugagagaguccuggauuggcuugaaaagcacggggccgagcgccugaaacggauggcuaucuccggagacgacuguguggugaagcccauugaugacagauucgccaccgcgcucacagcccugaacgauaugggcaaaguucgcaaggacaucccucagugggaacccucuaaaggguggaaugauuggcagcaggugccuuuuugcagccaccauuuccaccaacugauuaugaaggacggccgggagaucgucgugcccuguagaaaccaggaugagcucguuggacgcgcucgggugucccagggcgccggguggagccugagagaaaccgcuugccuuggaaagucuuacgcccaaauguggcagcugauguauuuucaucgccgggaccucagacuggcugccaaugcgaucuguuccgccgucccgguggauugggucccuacaagccgcaccacguggucuauucacgcucaccaucaguggaugacaaccgaggacaugcuuuccguguggaaccggguuuggaucgaagagaaucccuggauggaagauaaaacccacgugagcuccugggaggagguccccuaccugggcaagagagaagaccaguggugcgggucucucauuggacugacagcccgggccaccugggcuacaaacauccaaguggccauuaaucagguuagacgccugaucggcaacgagaauuaucucgacuacaugacgagcaugaaacgguucaagaacgaauccgauccugagggggcgcugugguga

SEQ ID NO: 18623 - RNA, 9879 nt, Artificial Sequence
  derived and/or modified CDS sequence (opt5) from DENV-1__KF955443__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaugagcggaaccacaaccauuuuugcuggccaucuuaaaugccgccugaagauggacaaacucacacugaaggggaccuccuauguuauguguacgggcagcuucaaacuggagaaggaaguggccgagacacagcacggaaccguccuugugcaaguuaaguacgagggcaccgaugcgccgugcaaaaucccuuucucuacacaggacgaaaagggggugacccagaacggaagacucaucacagcuaaucccauugucacggauaaagagaagccugugaacaucgaaaccgagccccccuuuggcgaguccuauauugugguuggggccggagaaaaagcccugaagcugagcugguucaagaaaggcucuagcaucgggaagauguuugaggcuacagcccggggcgcuagacgcauggccauucucggagacaccgcgugggauuucggcuccaucgggggagucuuuacaucugugggcaaacuggugcaucaggucuucgggaccgccuacggagugcuuuuuagcggcguuuccuggacgaugaagaucgggauuggcauccugcucaccuggcugggacugaauagccggucuacaucccuuagcaugaccuguauugcugugggcauggucacacucuaccugggggugaugguucaagccgacucuggaugcgugaucaacuggaaaggcagagaacugaaguguggguccggaauuuucgucaccaacgaggugcacacauggaccgaacaguauaaguuucaggcugauagcccuaaacgccucuccgccgcgaucggcaaggccugggaggaggggguuugcggcauucggucugugacgagacuggaaaauaucauguggaaacagaucagcaacgagcuuaaucauauucugcucgaaaacgacaugaaguucacagucguggugggagacgcuaauggcauccuggcccaagggaaaaagaugauucgcccgcagcccauggagcacaaauacuccuggaagucuuggggaaaggcuaaaaucauuggcgccgauauccagaacaccaccuuuaucauugacgggccugauacacccgaauguccugacaaucagcgggccuggaacaucugggaggucgaggauuauggauucggcauuuuuaccacgaauaucuggcugaagcuuagagacagcuacacacaaaugugcgaucaccgccucauguccgcugcgauuaaagacagcaaggccguucaugcugauaugggcuauuggaucgaaucugagaaaaacgaaaccuggaagcuggcccgggccuccuucaucgaggugaagacauguaccuggcccaaaagccacacacuguggucuaauggggugcucgaauccgagaugauuaucccgaagauuuacggaggcccuaucagccagcauaacuauagacccggguacuucacccagacggcuggaccuuggcaccugggcaaacuugagcuggacuuugaucucugcgaagggaccacagucgugguugacgagcacugcggaaaucgcggccccucucugcggaccacaaccgugacgggcaagauuauccaugaaugguguugcagaagcuguacacugccuccccuucgguuccgcggggaggauggaugcugguacggcauggagaucagaccggucaaagaaaaggaggaaaaccucgugcgguccaugguuagcgccgggucuggagagguggacuccuuuagccugggcauucugugugcguccaucaugauugaagaggucaugagaucucgcuggagccggaagaugcucaugaccgggacacuggcuguguuccuucugcucaucaugggacaacugaccuggaaugaccugauuagacuuugcaucaugguuggcgccaacgccuccgaucgcaugggcauggggaccacauaucuggcucucauggccacguuuaaaaugagaccuauguucgcggugggacugcucuuucggcgccugaccucuagagagguccuucugcucacaauuggccugagccugguggcuuccguggaacuucccaacucucuggaggaacucggggacggacuggccaugggcaucaugaugcucaagcugcuuaccgaguuccagccccaccagcuguggacaacccuccugagccugacguuuaucaaaacaacccuuucccuggauuacgccuggaagaccacagcuauggcccucagcauugucucucuguucccucucugucuguccaccacaagccagaaaacgaccuggcuuccgguucugcuggggucuuuuggaugcaagccccucacaauguuccugaucaccgaaaauaagauuuggggccggaaauccuggccucuuaacgagggcaucauggcuauugggaucgugagcauccugcucucuucccugcucaagaaugacgugccccuggccggaccucuuauugcgggcgggaugcugaucgccuguuaugucauuagcggauccagcgcugaucugucucucgagaaagccgcugaagugagcugggagcaagaagccgagcauuccggcacaucucacaacauccugguugaagugcaggacgaugggaccaugaagauuaaagacgaggagcgcgaugacacgcuuaccauccugcucaaggccacacugcucgcugucagcggaguguaccccauguccaucccugcgacccuguuucuuugguauuucuggcagaaaaagaagcagagaucuggcguucugugggauacacccagcccgccugaaguggagcgggccguccuggacgauggcauuuaccgcauccuccaaagagggcugcuuggacggucccaggugggcgucgggguguuccaggacggaguuuuucauaccauguggcacgugacacgcggcgcuguccugauguaucaggggaaaagacucgaacccucuugggccagcgugaagaaagaccugauuuccuacggaggcggcuggcgguuccaagggagcuggaauacgggagaggagguucaggugaucgccgucgaaccuggcaagaaccccaaaaaugugcagaccacaccggggaccuuuaagaccccugagggagaagugggcgcuauugcccucgauuucaagcccgggacaucuggauccccuaucguuaacagagagggcaaaauugucggccuguacgggaauggaguggugacgaccagcggcacauaugucucugcgaucgcucaagccaaggccucccaggaagggccccuucccgagaucgaggacgaaguguuuaaaaagcgcaaccugaccauuauggaucugcacccuggaagcggcaaaacacggagauaccucccggcuaucguucgcgaggccauuaagcggaagcugagaacccuuauccuggcgcccacgcgcguggucgcuuccgaaauggccgaggcccucaaagggaugccuauucgguaucagacaaccgcugugaagucugaacauaccggcagagagaucguugaccugaugugccacgccacauucaccaugcgccugcucagccccgugcgggucccuaauuacaacaugaucauuauggaugaggcucauuuuacagaccccgccuccaucgcggccagaggauauauuagcacccgggugggcaugggggaagcugccgcuaucuucaugacggccacaccuccgggaucuguugaggccuuuccccaguccaaugcugugauucaagaugaagagcgcgacaucccugaaagaagcuggaacucuggcuacgauuggaucaccgacuuccccgggaaaacagucugguuugugccuagcauuaaguccggaaaugauaucgcgaacugucuucggaaaaacggcaagcgcgugauucagcugucuagaaagaccuucgacacggaguaucagaaaaccaagaauaacgacugggauuacgucguuacaaccgacaucagcgagaugggggccaauuuccgggcugauagagugauugacccccgccggugccugaaaccggugauccucaaggauggcccugaaagagucauucuggccggacccaugcccgugacaguugccuccgcugcccagcgccggggcagaaucgggcgcaaccaaaauaaagagggagaccaguacguguauaugggccagccucuuaacaaugaugaagaccacgcgcauuggaccgaggcuaagaugcugcucgauaacaucaauacacccgaggggauuaucccugcccuguuugaaccggagcgggaaaagucugccgcuauugacggagaguacagacugcgcggcgaagccagaaaaaccuucgucgagcucaugcggcgcggggaucuucccguguggcugagcuauaagguugcguccgagggcuuucaguacagcgacagacgguggugcuucgauggagaacgcaacaaucaagugcuggaggaaaacauggacgucgagaucuggacgaaagaaggcgagagaaagaaacuccggccuagauggcuggacgcccgcacauauucugauccccuugcucugcgggaguuuaaggaauucgccgcugggagacgcuccgugagcggagaccucauucuggagaucggcaaacugccucagcaccucacccuucgggcccagaaugcucuggauaaccuggucaugcuccacaauuccgaacaggggggaaaggccuacagacaugcgauggaggaacugcccgacaccaucgagacacuuaugcugcucgcccugauugcugugcugaccggcggcguuacacucuuuuuccuuucugggaagggacugggcaaaacgagcaucgggcugcucugugugaccgccuccucugcucugcuuuggauggccagcguggagccgcacuggauugccgcuuccaucauucuggaauuuuuccucaugguccugcugaucccugagcccgaucggcaacgcacaccucaggacaaccagcucgcguauguugugaucggacuucuguuuaugauucugaccguggccgcuaacgaaaugggccuccuggagacaaccaagaaagaucuugggaucggacaugucgccgccgagaaucaccaacacgcuacgaugcuggacguggaucucagacccgccagcgcguggacccuguacgccguugcuacaaccgugauuacaccuaugaugcggcauaccaucgaaaacacgacagccaauauuucucugaccgcuaucgccaaccaggcggccauucucaugggccuugacaagggcuggcccaucuccaaaauggauaucggggucccgcugcuggcucucggaugcuacagccaggugaauccucugacacuuaccgccgcuguccugaugcucguggcccacuaugcuauuaucggccccgggcugcaggccaaggcgacccgcgaggcccaaaagagaacagcugccggaauuaugaaaaaccccacgguugacggcaucguggcuauugaucuggacccugucguguacgacgccaaguucgaaaaacagcucgggcagaucaugcuucugauccuguguaccucucagauucuccugaugcggacaaccugggcccuuugcgaguccaucacacuggcgaccggaccgcucacgacacugugggaaggcagccccggcaaguuuuggaauaccaccauugcuguuucuauggccaacaucuuccgcgggagcuaucuggcuggagccggccucgccuucucccuuaugaaaucucuggggggaggcagacgggggacaggagcucaaggcgagacccugggcgagaaguggaagcgccagcucaaucagcugagcaaauccgaauuuaacacauacaagagaagcgggauuauggagguggaucgguccgaagccaaagagggacuuaagagaggcgaaacgaccaaacaugcggucucucgcgggacagccaagcugcggugguucguggagagaaaucucgugaagccugagggaaaaguuaucgaccugggcugugggcgcggaggcuggagcuauuacugcgcuggccugaagaaagucaccgaagugaagggguauacaaaaggaggccccgggcacgaggaaccuauccccauggccaccuacggauggacgcucgugaagcuucauuccggcaaagaugucuuuuucaugccuccggagaagugugacacccugcugugcgauauuggggaaucuagccccaacccuacaaucgaggagggacggacccucagaguucugaagaugguggaacccuggcuucgcggcaaucaguuuuguauuaaaauccugaacccuuacaugcccuccguggucgagacacucgaacaaaugcagcggaagcacggcgggaugcuggugagaaauccgcugucucgcaacagcacccacgagauguauuggguuuccugcggaacaggcaauauugugagcgcugucaacaugaccucucggaugcuccugaacagauucacgauggcccaucgcaaaccuacauuugagcgggacguggaucuuggggcgggaaccagacacguugccguggaacccgaggucgcuaaucuggacaucauuggccagcgcaucgaaaacaucaagaaugagcauaaauccaccuggcacuacgaugaagacaaccccuauaagacaugggccuaccacgggagcuaugaggugaagccuucuggauccgcuagcucuauggugaauggcgucguuagacuccugacgaaacccugggaugugauuccuauggugacccaaaucgccaugacagacaccacaccguucggccagcagcgggucuuuaaggagaaaguggacacccgcacacccagagcuaagcgggggaccacgcagauuauggaaguuaccgccaaauggcuuuggggauuccuguccagaaacaagaagccucggaucuguacacgcgaggaauuuaccagaaaagugcggagcaaugcggccauuggcgcugucuucguggaugagaaccaauggaauuccgccaaggaagcuguugaggacgagcgcuuuugggaucucgugcauagagaacgggagcugcacaaacaggggaagugcgccacaugcgucuacaacaugaugggaaaacgcgaaaagaagcugggcgaguucgggaaagccaagggcagcagagcgaucugguauauguggcucggagcucgguuccuggaauuugaggcccuuggcuucaugaaugaggaccauugguuuucucgcgaaaacagccuguccgggguggagggagaaggccuccacaaacugggguacauccuuagagauauuucuaagauccccggaggcaauauguacgccgacgauaccgcugggugggacacgcggauuacagaggaugaccugcagaacgaggccaaaaucaccgauauuauggaaccugagcaugcucuccuggccacaagcaucuucaagcugaccuaucagaauaaaguugugcgcguccaaagacccgcgaagaacggcacggugauggacgucaucucccggcgcgaucagagaggaucuggccagguggggaccuacggacucaacacauuuaccaauauggaaguucagcugauucggcaaauggagagcgaaggcaucuuccuuccguccgagcuggagacaccuaaccucgccgaaagagugcuggacuggcuugagaagcacggggcugaacgccugaaacggauggccauuucuggagacgauugugucgugaagcccaucgacgauagauuugcuaccgcccucacagcgcugaaugacaugggcaaagugcgcaaggauauuccucagugggagcccagcaaaggguggaacgacuggcagcagguuccuuucugcucccaccauuuucaccaacugaucaugaaggauggccgggaaaucgugguccccuguagaaaucaggacgagcucgugggacgcgcccggguuagccagggcgcuggguggucucugagagagaccgccugccuuggaaaguccuaugcucaaauguggcagcugauguacuuccaucgccgggaucucagacuggccgcuaacgccauuuguagcgcggugccggucgacugggugccuacgucucgcacaaccugguccauccacgcccaccaucaguggaugaccacagaagauaugcuuagcgucuggaaucggguguggauugaggaaaaccccuggauggaggacaaaacccacguuuccucuugggaagaggugcccuaucugggcaagagagaggaccaguggugcgggagccucaucggacugacagcucgggccacgugggccaccaauauucaagucgcuaucaaccaggugagacgccugauuggcaaugaaaacuaccucgauuauaugacauccaugaaacgguuuaagaaugagagcgacccugaaggggcccugugguga

SEQ ID NO: 18624 - RNA, 9879 nt, Artificial Sequence
  derived and/or modified CDS sequence (opt5) from DENV-1__GQ868520__SS-prME
agcgugaccaugcugcucaugcugcuucccacagcccuggcuuuccaccucacgaccagaggcggggaaccucauaugaucgucuccaagcaggaacggggaaagucucugcuuuuuaagacaagcgccggcguuaacaugugcacccugauugcgauggaccucggggagcugugugaagauacaaugaccuacaagugcccccagaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagaacaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccgcccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaaacuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucgugaugggacaacugaccuggaaugaccugaucagacuuugcauuaugguuggcgccaacgcuuccgaucgcaugggcauggggacaacguaucuggcccucauggcgaccuuuaaaaugagaccuauguucgcugugggacugcucuuucggcgccugacaucuagagagguccuucugcucaccaucggccugagccugguggccuccguggaacuucccaacucucuggaggaacucggggacggacuggccaugggcauuaugaugcucaagcugcuuacagaguuccagccccaccagcuguggaccacgcuccugagccugacauuuaucaaaaccacccuuucccuggauuacgcuuggaagacaaccgccauggcucucagcaucgucucucuguucccucucugucuguccacaacgagccagaaaaccacauggcuuccgguucugcuggggucuuuuggaugcaagccccucaccauguuccugauuacagaaaauaagaucuggggccggaaauccuggccucuuaacgagggcauuauggccaucgggauugugagcauccugcucucuucccugcucaagaaugacgugccccuggcgggaccucuuaucgccggcgggaugcugauugcuuguuaugucaucagcggauccagcgccgaucugucucucgagaaagcugccgaagugagcugggagcaagaagccgagcauuccggcaccucucacaacauucugguugaagugcaggacgaugggacgaugaagaucaaagacgaggagcgcgaugacacccuuacaauucugcucaaggcuacccugcucgcggucagcggaguguaccccauguccaucccugccacacuguuuguuugguauuucuggcagaaaaagaagcagagaucuggcgugcuuugggauacccccagcccgccugaagucgagcgggcugugcuggacgauggcaucuaccgcauucugcaaagagggcuccugggacggucccaggucggcguggggguuuuccaggacggaguguuucauacaauguggcacgucacgcgcggcgccgugcuuauguaucaggggaaaagacuggaacccucuugggccagcguuaagaaagaccucaucuccuacggaggcggcuggcgguuccaagggagcuggaauaccggagaggaggugcaggucauugcuguggaaccuggcaagaaccccaaaaaugugcagacaaugccggggaccuuuaagaccccugagggagaaguuggcgccaucgcgcuggauuucaagcccgggacaucuggauccccuauugucaacagagagggcaaaaucgugggccucuacgggaauggaguggucacgaccagcggcacauaugugucugcuauugcccaagccaaggcuucccaggaagggccccugcccgagaucgaggacgaaguuuuuaaaaagcgcaaccuuaccaucauggaucugcacccuggaagcggcaaaacacggagauaccugccggccauggugcgcgaggcgauuaagcggaagcucagaacccugauccuugcucccacgcgcgucguggccuccgaaauggccgaggcucugaaagggaugccuauucgguaucagacaaccgccguuaagucugaacauaccggcagagagaucguggaccucaugugccacgcuacauucaccaugcgccugcugagccccguccgggugccuaauuacaacaugauuaucauggaugaggcccauuuuacagaccccgcguccaucgccgcuagaggauauauuagcacccggguuggcaugggggaagccgcugccaucuucaugacggccacaccuccgggaucuguggaggcuuuuccccaguccaaugcggucauucaagaugaagaacgcgacaucccugaaagaagcuggaacucuggcuacgauuggauuaccgacuuccccgggaaaacagugugguuugugccuagcaucaaguccggaaaugauaucgccaacugucuccggaaaaacggcaagcgcgucauucagcuuucuagaaagaccuucgacacggaguaucagaaaaccaagaauaacgacugggauuacguugugacaaccgacaucagcgagaugggggcuaauuuccgggccgauagagugauugacccccgccggugccugaaaccggucauccugaaggauggcccugaaagagugauucucgccggacccaugcccguuacaguggcuuccgccgcgcagcgccggggcagaaucgggcgcaaccaaaauaaagagggagaccaguacgucuauaugggccagccucugaacaaugaugaagaccacgcucauuggaccgaggccaagaugcuucuggauaacauuaauacacccgaggggaucaucccugcccucuuugaaccggagcgggaaaagucugcugccauugacggagaguacagacugcgcggcgaagcgagaaaaaccuucguggagcugaugcggcgcggggaucuccccguuuggcuuagcuauaagguggccuccgagggcuuucaguacagcgacagacgguggugcuucgauggagaacgcaacaaucaaguccuggaggaaaacauggacguggagaucuggacgaaagaaggcgagagaaagaaacugcggccuagauggcucgacgcucgcacauauucugauccccuggcccuucgggaguuuaaggaguucgcugccgggagacgcuccgucagcggagaccugauucucgagaucggcaaacugccucagcaccugacccuccgggcucagaaugcccuugauaaccuggugaugcugcacaauuccgaacaagggggaaaggcguacagacaugccauggaggaacuccccgacaccauugagacacugaugcuucuggcucucaucgccguucugaccggcggcgugacacuguuuuuccucucugggaagggacuuggcaaaacgagcaucgggcugcugugugugaccgcuuccucugcccuccuguggauggccagcgucgagccgcacuggauugcugcguccaucauucuugaauuuuuccugaugguucuccugaucccugagcccgaucggcaacgcacaccucaggacaaccagcuggccuauguggugauuggacuccuuuuuaugauccugaccgucgcugccaacgaaaugggccugcucgagacaaccaagaaagaucuggggaucggacauguggccgcugagaaucaccaacacgccacgaugcuugacguugaucugagacccgcgagcgccuggacccucuacgcuguggccacaaccgucauuacaccuaugaugcggcauaccaucgaaaacacgacagcuaauauuucucugaccgccaucgcgaaccaggccgcuauucugaugggccucgacaagggcuggcccaucuccaaaauggauauuggggugccgcuucuggcccugggaugcuacagccaggucaauccucucacacugaccgcugccgugcuuaugcugguugcucacuaugccaucaucggccccgggcuccaggcgaaggccacccgcgaggcucaaaagagaacagccgcuggaauuaugaaaaaccccacgguggacggcaucgucgccauugaucuggacccugugguuuacgacgccaaguucgaaaaacagcuggggcagaucaugcuccuuauucuguguaccucucagauccugcucaugcggacaaccugggcgcugugcgaguccaucacacuugcuaccggaccgcugacgacacucugggaaggcagccccggcaaguuuuggaauaccaccauugccgugucuauggcuaacaucuuccgcgggagcuaucuggccggagccggccuggcuuucucccucaugaaaucucuugggggaggcagacgggggacaggagcccaaggcgagacccugggcgagaaguggaagcgccagcugaaucagcucagcaaauccgaauuuaacacauacaagagaagcgggauuauggaggucgaucgguccgaagcgaaagagggacugaagagaggcgaaacgaccaaacaugccgugucucgcgggacagcuaaacuucggugguucguggagagaaaucugguuaagccugagggaaaagucaucgaccucggcugugggcgcggaggcuggagcuauuacugcgccggccugaagaaagugaccgaagugaagggguauacaaaaggaggccccgggcacgaggaaccuauucccauggcuaccuacggauggaaccuggucaagcuccauuccggcaaagauguguuuuucaugccuccggagaagugugacacgcuucugugcgauaucggggaaucuagccccaauccuaccaucgaggagggacggacacugagaguucucaagaugguggaacccuggcugcgcggcaaccaguuuuguauuaaaauccuuaauccuuacaugcccuccgucguggagacccuggaacaaaugcagcggaagcacggcgggaugcucguuagaaacccgcugucucgcaauagcacacacgagauguauuggguguccugcggaaccggcaacauugucagcgccgugaacaugacaucucggaugcugcucaauagauucaccauggcgcaucgcaaaccuacguacgagcgggacguugaucugggggccggaacaagacacguggcugucgaacccgagguggccaaccuugacaucauuggccagcgcaucgaaaauauuaagaacgagcauaaauccaccuggcacuaugaugaagacaaucccuacaagaccugggcuuaucacgggagcuacgaggugaagccuucuggauccgccagcucuauggucaacggcguugugagacugcucacaaaacccugggaugugaucccuauggucacgcaaaucgcuaugaccgacacaaccccguuuggccagcagcggguguucaaggagaaaguugacacacgcacccccagagccaagcgggggacaacccagauuauggaagugacggcgaaauggcuguggggauuucuuuccagaaauaagaagccucggaucuguacccgcgaggaguucacaagaaaaguccggagcaacgccgcuauuggcgccguguuuguugaugagaaucaauggaacuccgcuaaggaagccguggaggacgagcgcuucugggaucugguccauagagaacgggagcuccacaaacaggggaagugcgcuaccugcguguauaauaugaugggaaaacgcgaaaagaagcugggcgaguuugggaaagcgaagggcagcagagcuaucugguacauguggcugggagcccgguuccucgaguucgaggcccugggcuuuaugaacgaggaccauugguucucucgcgaaaauagccuuuccgggguugagggagaaggccugcacaaacucggguacauucugagagauaucucuaagauccccggaggcaacauguaugcugacgauacagccgggugggacacccggauuacggaggaugaccuucagaaugaggcuaaaaucacagaaauuauggagccugaacaugcccugcucgcgaccagcaucuuuaagcugacauaccagaacaaagugguccgcgugcaaagacccgccaagaacggcaccgucauggaugugauuucccggcgcgaccagagaggaucuggccagguugggacguauggacugaauaccuucacaaacauggaggugcagcucauccggcaaauggaaagcgagggcaucuuucugccguccgagcuugaaaccccuaaucuggcugagagaguccucgauuggcuggaaaagcacggggccgagcgccuuaaacggauggcuauuucuggagacgacuguguggugaagcccaucgaugacagauucgccacagcgcugaccgcccucaacgauaugggcaaaguucgcaaggacauuccucagugggaacccagcaaaggguggaaugauuggcaacaggugccuuuuugcucccaccauuuccaccaacugaucaugaaggacggccgggagauugucgugcccuguagaaaccaggaugagcugguuggacgcgcucgggugagccagggcgccggguggucucucagagaaacagcuugccugggaaaguccuacgcccaaauguggcagcuuauguauuuucaucgccgggaccugagacucgcugccaaugcgaucuguagcgccgucccgguggauugggucccuaccucucgcacgacaugguccauccacgcucaccaucaguggaugaccaccgaggacaugcugagcguguggaaccggguuuggauugaagagaaucccuggauggaagauaaaacacacguguccucuugggaggagguccccuaccuuggcaagagagaagaccaguggugcgggagccugaucggacucaccgcccgggccacaugggcuacgaacauucaaguggccaucaaucagguuagacgccugauuggcaacgagaauuaucuggacuacaugaccuccaugaaacgguucaagaacgaaagcgauccugagggggcgcucugguga

SEQ ID NO: 18625 - RNA, 9879 nt, Artificial Sequence
  derived and/or modified CDS sequence (opt5) from DENV-1__GQ868522__SS-prME
agcgugaccaugcugcucaugcugcuucccacagcucuggcuuuccaccucacgaccagaggcggggaaccucauaugaucgucuccaagcaggaacggggaaagucucugcuuuuuaagacaagcgccggcguuaacaugugcacccugauugcgauggaccucggggagcugugugaagauacaaugaccuacaagugcccccagaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagaacaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccgcccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaaacuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucgugaugggacaacugaccuggaaugaccugaucagacuuugcauuaugguuggcgccaacgcuuccgaucgcaugggcauggggacaacguaucuggcccucauggcgaccuuuaaaaugagaccuauguucgcugugggacugcucuuucggcgccugacaucuagagagguccuucugcucaccaucggccugagccugguggccuccguggaacuucccaacucucuggaggaacucggggacggacuggccaugggcauuaugaugcucaagcugcuuacagaguuccagccccaccagcuguggaucacccuccugagccugacguuuaucaaaacaacccuuucccuggauuacgcuuggaagaccacagccauggcucucagcauugucucucuguucccucucugucuguccaccacaagccagaaaacgaccuggcuuccgguucugcuggggucuuuuggaugcaagccccucacaauguuccugaucaccgaaaauaagauuuggggccggaaauccuggccucuuaacgagggcaucauggccauugggaucgugagcauccugcucucuucccugcucaagaaugacgugccccuggcgggaccucuuauugccggcgggaugcugaucgcuuguuaugucauuagcggauccagcgccgaucugucucucgagaaagcugccgaagugagcugggagcaagaagccgagcauuccggcacaucucacaacauccugguugaagugcaggacgaugggaccaugaagauuaaagacgaggagcgcgaugacacgcuuaccauccugcucaaggcuacacugcucgcggucagcggaguguaccccauguccaucccugccacccuguuuguuugguauuucuggcagaaaaagaagcagagaucuggcgugcuuugggauacacccagcccgccugaagucgagcgggcugugcuggacgauggcauuuaccgcauccugcaaagagggcuccugggacggucccaggucggcguggggguuuuccaggacggaguguuucauaccauguggcacgucacacgcggcgccgugcuuauguaucaggggaaaagacuggaacccucuugggccagcguuaagaaagaccucauuuccuacggaggcggcuggcgguuccaagggagcuggaauacgggagaggaggugcaggucaucgcuguggaaccuggcaagaaccccaaaaaugugcagaccaugccggggacauuuaagaccccugagggagaaguuggcgccauugcgcuggauuucaagcccgggaccucuggauccccuaucgucaacagagagggcaaaauugugggccucuacgggaauggaguggucacaacgagcggcaccuaugugucugcuaucgcccaagccaaggcuucccaggaagggccccugcccgagaucgaggacgaaguuuuuaaaaagcgcaaccuuacaauuauggaucugcacccuggaagcggcaaaacccggagauaccugccggccauggugcgcgaggcgaucaagcggaagcucagaacacugauucuugcucccacccgcgucguggccuccgaaauggccgaggcucugaaagggaugccuauccgguaucagacgacagccguuaagucugaacauaccggcagagagauuguggaccucaugugccacgcuaccuucacaaugcgccugcugagccccguccgggugccuaauuacaacaugaucaucauggaugaggcccauuuuaccgaccccgcguccauugccgcuagaggauauaucagcacacggguuggcaugggggaagccgcugccauuuucaugaccgccacgccuccgggaucuguggaggcuuuuccccaguccaaugcggucauccaagaugaagaacgcgacauuccugaaagaagcuggaacucuggcuacgauuggaucacagacuuccccgggaaaaccgugugguuugugccuagcaucaaguccggaaaugauauugccaacugucuccggaaaaacggcaagcgcgucauccagcuuucuagaaagacauucgacaccgaguaucagaaaacgaagaauaacgacugggauuacguugugaccacagacauuagcgagaugggggcuaauuuccgggccgauagagugaucgacccccgccggugccugaaaccggucauucugaaggauggcccugaaagagugauccucgccggacccaugcccguuaccguggcuuccgccgcgcagcgccggggcagaauugggcgcaaccaaaauaaagagggagaccaguacgucuauaugggccagccucugaacaaugaugaagaccacgcucauuggacagaggccaagaugcuucuggauaacaucaauacccccgaggggaucauuccugcccucuuugaaccggagcgggaaaagucugcugccaucgacggagaguacagacugcgcggcgaagcgagaaaaacauucguggagcugaugcggcgcggggaucuccccguuuggcuuagcuauaagguggccuccgagggcuuucaguacagcgacagacgguggugcuucgauggagaacgcaacaaucaaguccuggaggaaaacauggacguggagauuuggaccaaagaaggcgagagaaagaaacugcggccuagauggcucgacgcucgcacguauucugauccccuggcccuucgggaguuuaaggaguucgcugccgggagacgcuccgucagcggagaccugauccucgagauuggcaaacugccucagcaccugacacuccgggcucagaaugcccuugauaaccuggugaugcugcacaauuccgaacaagggggaaaggcguacagacaugccauggaggaacuccccgacaccaucgagacccugaugcuucuggcucucaucgccguucugacaggcggcgugacccuguuuuuccucucugggaagggacuuggcaaaacaagcauugggcugcugugugugacggcuuccucugcccuccuguggauggccagcgucgagccgcacuggaucgcugcguccauuauccuugaauuuuuccugaugguucuccugauuccugagcccgaucggcaacgcaccccucaggacaaccagcuggccuauguggugaucggacuccuuuuuaugauccugacagucgcugccaacgaaaugggccugcucgagaccacaaagaaagaucuggggauuggacauguggccgcugagaaucaccaacacgccaccaugcuugacguugaucugagacccgcgagcgccuggacgcucuacgcuguggccaccacagucaucaccccuaugaugcggcauacaauugaaaacaccacggcuaauaucucucugacagccauugcgaaccaggccgcuauccugaugggccucgacaagggcuggcccauuuccaaaauggauaucggggugccgcuucuggcccugggaugcuacagccaggucaauccucucacccugacagcugccgugcuuaugcugguugcucacuaugccaucauuggccccgggcuccaggcgaaggccacccgcgaggcucaaaagagaaccgccgcuggaaucaugaaaaaccccacaguggacggcauugucgccaucgaucuggacccugugguuuacgacgccaaguucgaaaaacagcuggggcagauuaugcuccuuauccuguguacgucucagauccugcucaugcggaccacaugggcgcugugcgaguccauuacccuugcuacaggaccgcugaccacgcucugggaaggcagccccggcaaguuuuggaauacaaccaucgccgugucuauggcuaacauuuuccgcgggagcuaucuggccggagccggccuggcuuucucccucaugaaaucucuugggggaggcagacgggggaccggagcccaaggcgagacacugggcgagaaguggaagcgccagcugaaucagcucagcaaauccgaauuuaacaccuacaagagaagcgggaucauggaggucgaucgguccgaagcgaaagagggacugaagagaggcgaaacaacgaaacaugccgugucucgcgggaccgcuaaacuucggugguucguggagagaaaucugguuaagccugagggaaaagucauugaccucggcugugggcgcggaggcuggagcuauuacugcgccggccugaagaaagugacagaagugaagggguauaccaaaggaggccccgggcacgaggaaccuauccccauggcuacauacggauggaaccuggucaagcuccauuccggcaaagauguguuuuucaugccuccggagaagugugacacccuucugugcgauaucggggaaucuagccccaauccuacgauugaggagggacggacccugagaguucucaagaugguggaacccuggcugcgcggcaaccaguuuuguaucaaaauucuuaauccuuacaugcccuccgucguggagacacuggaacaaaugcagcggaagcacggcgggaugcucguuagaaacccgcugucucgcaauagcacccacgagauguauuggguguccugcggaacaggcaacaucgucagcgccgugaacaugaccucucggaugcugcucaauagauucacaauggcgcaucgcaaaccuaccuacgagcgggacguugaucugggggccggaacgagacacguggcugucgaacccgagguggccaaccuugacauuaucggccagcgcauugaaaauaucaagaacgagcauaaauccacauggcacuaugaugaagacaaucccuacaagaccugggcuuaucacgggagcuacgaggugaagccuucuggauccgccagcucuauggucaacggcguugugagacugcucaccaaacccugggaugugaucccuauggucacacaaauugcuaugacggacaccacaccguuuggccagcagcggguguucaaggagaaaguugacacccgcacacccagagccaagcgggggaccacacagaucauggaagugaccgcgaaauggcuguggggauuucuuuccagaaauaagaagccucggauuuguacgcgcgaggaguucaccagaaaaguccggagcaacgccgcuaucggcgccguguuuguugaugagaaucaauggaacuccgcuaaggaagccguggaggacgagcgcuucugggaucugguccauagagaacgggagcuccacaaacaggggaagugcgccacaugcguguauaauaugaugggaaaacgcgaaaagaagcugggcgaguuugggaaagcgaagggcagcagagcuauuugguacauguggcugggagcccgguuccucgaguucgaggcccugggcuuuaugaacgaggaccauugguucucucgcgaaaauagccuuuccgggguugagggagaaggccugcacaaacucggguacauccugagagauaucucuaagauucccggaggcaacauguaugcugacgauaccgccgggugggacacacggaucaccgaggaugaccuucagaaugaggcuaaaauuacggaaaucauggagccugaacaugcccugcucgcgacaagcauuuuuaagcugaccuaccagaacaaagugguccgcgugcaaagacccgccaagaacggcacagucauggaugugaucucccggcgcgaccagagaggaucuggccagguugggaccuauggacugaauacguucaccaacauggaggugcagcucauccggcaaauggaaagcgagggcauuuuucugccguccgagcuugaaacaccuaaucuggcugagagaguccucgauuggcuggaaaagcacggggccgagcgccuuaaacggauggcuaucucuggagacgacuguguggugaagcccauugaugacagauucgccaccgcgcugacagcccucaacgauaugggcaaaguucgcaaggacaucccucagugggaacccagcaaaggguggaaugauuggcagcaggcuccuuuuugcucccaccauuuccaccaacugauuaugaaggacggccgggagaucgugguccccuguagaaaccaggaugagcuggugggacgcgcccggguuagccagggcgcuggguggucucucagagaaaccgccugccugggaaaguccuacgcucaaauguggcagcuuauguauuuucaucgccgggaccugagacucgccgcgaaugccaucuguagcgcugugccggucgauugggugccuacaucucgcaccacgugguccauucacgcccaccaucaguggaugacaaccgaggacaugcugagcgucuggaaccggguguggaucgaagagaaucccuggauggaagauaaaacccacguuuccucuugggaggaggugcccuaccuuggcaagagagaagaccaguggugcgggagccugauuggacucacagcccgggcuaccugggccacaaacauccaagucgcgauuaaucaggugagacgccugaucggcaacgagaauuaucuggacuacaugacguccaugaaacgguucaagaacgaaagcgauccugagggggcucucugguga

SEQ ID NO: 18626 - RNA, 9879 nt, Artificial Sequence
  derived and/or modified CDS sequence (opt5) from DENV-1__HQ166036__SS-prME
agcgugaccaugcugcucaugcugcuucccacagcucuggcuuuccaccucacgacccggggcggggaaccucauaugaucgucuccaagcaggaacggggaaagucucugcuuuuuaagacaagcgccggcguuaacaugugcacccugauugcgauggaccucggggaacugugugaagauacaaugaccuacaaaugcccccagaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagaacaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccgcccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaaacuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucgugaugggacaacugaccuggaaugaccugaucagacuuugcauuaugguuggcgccaacgcuuccgaucgcaugggcauggggacaacguaucuggcccucauggcgaccuuuaaaaugagaccuauguucgcugugggacugcucuuucggcgccugacaucuagagagguccuucugcucaccaucggccugagccugguggccuccguggaacuucccaacucucuggaggaacucggggacggacuggccaugggcauuaugaugcucaagcugcuuacagaguuccagccccaccagcuguggaccacgcuccugagccugacauuuaucaaaaccacccuuucccuggauuacgcuuggaagacaaccgccauggcucucagcaucgucucucuguucccucucugucuguccacaacgagccagaaaaccacauggcuuccgguucugcuggggucuuuuggaugcaagccccucaccauguuccugauuacagaaaauaagaucuggggccggaaauccuggccucuuaacgagggcauuauggccaucgggauugugagcauccugcucucuucccugcucaagaaugacgugccccuggcgggaccucuuaucgccggcgggaugcugauugcuuguuaugucaucagcggauccagcgccgaucugucucucgagaaagcugccgaagugagcugggagcaagaagccgagcauuccggcaccucucacaacauucugguugaagugcaggacgaugggacgaugaagaucaaagacgaggagcgcgaugacacccuuacaauucugcucaaggcuacccugcucgcggucagcggaguguaccccauguccaucccugccacacuguuuguuugguauuucuggcagaaaaagaagcagagaucuggcgugcuuugggauacccccagcccgccugaagucgagcgggcugugcuggacgauggcaucuaccgcauucugcaaagagggcuccugggacggucccaggucggcguggggguuuuccaggacggaguguuucauacaauguggcacgucacgcgcggcgccgugcuuauguaucaggggaaaagacuggaacccucuugggccagcguuaagaaagaccucaucuccuacggaggcggcuggcgguucagagggagcuggaauaccggagaggaggugcaagucauugcuguggaaccuggcaagaaccccaaaaaugugcagacaaccccggggaccuuuaagacaccugagggagaaguuggcgccaucgcgcuggauuucaagcccgggacgucuggauccccuauugucaaccgcgagggcaaaaucgugggccucuacgggaauggaguggucaccacaagcggcaccuaugugucugcuauugcccaggccaaggcuucccaagaagggccccugcccgagaucgaggacgaaguuuuuaaaaagcggaaccuuacaaucauggaucugcacccuggaagcggcaaaaccagacgcuaccugccggccauugugcgggaggcgaucaagagaaagcuccgcacgcugauucuugcucccacacgggucguggccuccgaaauggccgaggcucugaaagggaugccuaucagauaucagaccaccgccguuaagucugaacauacaggccgcgagauuguggaccucaugugccacgcuaccuucacaaugcggcugcugagccccgucagagugccuaauuacaacaugaucaucauggaugaggcccauuuuaccgaccccgcguccauugccgcucggggauauaucagcacgcgcguuggcaugggggaagccgcugccauuuucaugacagccaccccuccgggaucuguggaggcuuuuccccaguccaaugcggucauccaggaugaagagagagacauuccugaacggagcuggaacucuggcuacgauuggaucacagacuuccccgggaaaaccgugugguuugugccuagcaucaaguccggaaaugauauugccaacugucuccgcaaaaacggcaagagagucauccaacuuucucggaagacguucgacaccgaguaucagaaaacaaagaauaacgacugggauuacguugugaccacagacauuagcgagaugggggcuaauuucagagccgaucgcgugaucgacccccggagaugccugaaaccggucauucugaaggauggcccugaacgcgugauccucgccggacccaugcccguuaccguggcuuccgccgcgcagcggagaggccgcauugggcggaaccagaauaaagagggagaccaauacgucuauaugggccagccucugaacaaugaugaagaccacgcucauuggacagaggccaagaugcuucuggauaacaucaauacccccgaggggaucauuccugcccucuuugaaccggagagagaaaagucugcugccaucgacggagaguaccgccugagaggcgaagcgcggaaaacguucguggagcugaugcgcagaggggaucuccccguuuggcuuagcuauaagguggccuccgagggcuuucaguacagcgaccggcgcuggugcuucgauggagaaagaaacaaucagguccuggaggaaaacauggacguggagauuuggacaaaagaaggcgagcggaagaaacugagaccucgcuggcucgacgcucggaccuauucugauccccuggcccuuagagaguuuaaggaguucgcugccgggcgccgguccgucagcggagaccugauccucgagauuggcaaacugccucaacaccugaccuccagagcucagaaugcccucgauaaccuugugaugcugcacaauucugaacaagggggaaaggcguaccggcaugccauggaggaacugcccgacacaaucgagacccucaugcugcuugcucugaucgccguucucacaggcggcgugacgcuguuuuuccugagcgggaagggacucggcaaaaccuccauugggcuucugugugugacagcuucuagcgcccugcucuggauggccuccgucgagccgcacuggaucgcugcgagcauuauccuggaauuuuuccuuaugguucugcucauuccugagcccgaucgccagagaaccccucaagacaaccagcuggccuauguggugaucggacugcucuuuaugauccuuacagucgcugccaacgaaaugggccugcuggagaccacgaagaaagaucucgggauuggacauguggccgcugagaaucaccagcacgccaccaugcuggacguugaucuucggcccgcgucugccuggacacuguacgcuguggccaccacagucaucaccccuaugaugcgccauacgauugaaaacacaaccgcuaauaucucccucacagccauugcgaaccaagccgcuauccugaugggccuggacaagggcuggcccauuagcaaaauggauaucggggugccgcuccuugcccugggaugcuacucucaggucaauccucugacccucaccgcugccgugcugaugcuuguugcucacuaugccaucauuggccccgggcugcaggcgaaggccacaagagaggcucagaagcggacggccgcuggaaucaugaaaaaccccaccguggacggcauugucgccaucgaucucgacccugugguuuacgacgccaaguucgaaaaacaacuggggcagauuaugcugcucauccuuuguacaucccagauccugcugaugcgcaccacaugggcgcucugcgagagcauuacccuggcuacgggaccgcuuacaacccugugggaaggcucucccggcaaguuuuggaauaccacaaucgccgugagcauggcuaacauuuucagaggguccuaucucgccggagccggccuggcuuucucucugaugaaaagccucgggggaggccggcgcgggaccggagcccagggcgagacacuuggcgagaaguggaagagacaacugaaucagcuguccaaaagcgaauuuaacacguacaagcgguccgggaucauggaggucgauagaucugaagcgaaagagggacucaagcgcggcgaaaccacaaaacaugccgugagccgggggaccgcuaagcugagaugguucguggagcgcaaucuuguuaagccugagggaaaagucauugaccugggcugugggcggggaggcugguccuauuacugcgccggccucaagaaagugacagaagugaagggguauaccaaaggaggccccgggcacgaggaaccuauccccauggcuacguacggauggaaccuggucaagcugcauucuggcaaagauguguuuuucaugccuccggagaagugugacacccuccuuugcgauaucggggaaagcucccccaauccuacaauugaggagggaagaacccugcgcguucugaagaugguggaacccuggcuccggggcaaccaguuuuguaucaaaauucugaauccuuacaugcccucugucguggagacacuugaacagaugcaaagaaagcacggcgggaugcugguucgcaacccgcucagcagaaauuccacccacgagauguauugggugagcugcggaacaggcaacaucgucucugccgugaacaugaccuccagaaugcugcugaaucgcuucacgauggcgcaucggaaaccuacauacgagagagacguugaucucggggccggaacccgccacguggcugucgaacccgagguggccaaccuggacauuaucggccagagaauugaaaauaucaagaacgagcauaaaagcaccuggcacuaugaugaagacaaucccuacaagacaugggcuuaucacgggucuuacgaggugaagccuuccggaagcgccucuuccauggucaacggcguugugcggcuucugacgaaacccugggaugugaucccuauggucacccagauugcuaugacagacaccacaccguuuggccaacagcgcguguucaaggagaaaguugacaccagaacaccccgggccaagagagggaccacgcagaucauggaagugaccgcgaaauggcucuggggauuucugagccggaauaagaagccucgcauuuguacaagagaggaguucacccggaaaguccgcuccaacgccgcuaucggcgccguguuuguugaugagaaucaguggaacagcgcuaaggaagccguggaggacgagagauucugggaucuuguccaucgggaacgcgagcugcacaaacaagggaagugcgccacaugcguguauaauaugaugggaaaaagagaaaagaagcucggcgaguuugggaaagcgaagggcucucgggcuauuugguacauguggcugggagcccgcuuccuggaguucgaggcccucggcuuuaugaacgaggaccauugguucagcagagaaaauucccugucugggguugagggagaaggccuucacaaacugggguacauccuccgggauaucagcaagauucccggaggcaacauguaugcugacgauaccgccgggugggacacgcgcaucacagaggaugaccugcagaaugaggcuaaaauuaccgaaaucauggagccugaacaugcccuucuggcgacauccauuuuuaagcucaccuaccagaacaaaguggucagagugcagcggcccgccaagaacggcacggucauggaugugaucucucgcagagaccaacggggaagcggccagguugggaccuauggacugaauacauucaccaacauggaggugcagcugaucagacagauggaauccgagggcauuuuucucccgucugagcuggaaacaccuaaucuugcugagcgcguccuggauuggcucgaaaagcacggggccgagcggcugaaaagaauggcuaucagcggagacgacuguguggugaagcccauugaugaccgcuucgccaccgcgcuuacagcccugaacgauaugggcaaaguucggaaggacaucccucaaugggaacccuccaaaggguggaaugauuggcaacaggugccuuuuugcagccaccauuuccaccagcucauuaugaaggacggcagagagaucgucgugcccugucgcaaccaagaugagcugguuggacgggcuagagugucucagggcgccggguggucccugcgcgaaaccgcuugccucggaaagagcuacgcccagauguggcaacugauguauuuucaucggagagaccuucgccuggcugccaaugcgaucuguucugccgucccgguggauugggucccuacgucccggacaaccuggagcauucacgcucaccaucaguggaugaccacagaggacaugcucuccguguggaacagaguuuggaucgaagagaaucccuggauggaagauaaaacccacgugucuagcugggaggagguccccuaccugggcaagcgggaagaccaguggugcgggucccuuauuggacugacagccagagccacgugggcuaccaacauccagguggccauuaaucaaguucgccggcucaucggcaacgagaauuaucuggacuacaugacaagcaugaaaagauucaagaacgaaucugauccugagggggcgcugugguga

SEQ ID NO: 18627 - RNA, 9879 nt, Artificial Sequence
  derived and/or modified CDS sequence (opt5) from DENV-1__GU131981__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauuauggugggggccggagaaaaagcccugaagcugagcugguucaagaaaggcucuagcaucgggaagauguuugaggcuaccgcccggggcgcuagacgcauggccauucucggagacacagcgugggauuucggcuccaucgggggaguuuuuaccucugucggcaaacuggugcaucagguguucgggacggccuacggaguccuuuuuagcggcguguccuggaccaugaagaucgggauuggcauccugcucacauggcugggacugaauagccggucuaccucccuuagcaugacauguauugcuguuggcauggugacccucuaccugggggucauggugcaagccgacucuggaugcguuaucaacuggaaaggcagagaacugaaguguggguccggaauuuucgugacaaacgagguccacaccuggacggaacaguauaaguuucaggcugauagcccuaaacgccucuccgccgcgaucggcaaggccugggaggagggggugugcggcauucggucugcuacaagacuggaaaauaucauguggaaacagaucagcaacgagcuuaaucauauucugcucgaaaacgacaugaaguucaccguuguggucggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcugugcaugccgauaugggcuauuggaucgaaucugagaaaaacgaaacauggaagcuggcccgggcuuccuucaucgaggucaagaccuguacauggcccaaaagccacacccuguggucuaaugggguucucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccgugguggucgacgagcacugcggaaaucgcggccccucucugcggacaaccacggugacaggcaagauuauccaugaaugguguugcagaagcuguacccugccuccccuucgguuccgcggggaggauggaugcugguacggcauggagaucagaccgguuaaagaaaaggaggaaaaccucgugcgguccauggucagcgcggggucuggagagguggacuccuuuagccugggcauucugugugcuuccaucaugauugaagagguuaugagaucucgcuggagccggaagaugcucaugacagggacccuggccguguuccuucugcucgucaugggacaacugaccuggaaugaccugaucagacuuugcauuauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccaucggccugagccuggucgccuccguggaacuucccaacucucuggaggaacucggggacggacuggccaugggcauuaugaugcucaagcugcuuacagaguuccagccccaccagcuguggaucacccuccugagccugacguuuaucaaaacaacccuuucccuggauuacgcuuggaagaccacagccauggcucucagcauugugucucuguucccucucugucuguccaccacaagccagaaaacgaccuggcuuccgguccugcuggggucuuuuggaugcaagccccucacaauguuccugaucaccgaaaauaagauuuggggccggaaauccuggccucuuaacgagggcaucauggccauugggaucguuagcauccugcucucuucccugcucaagaaugacgugccccuggcgggaccucuuauugccggcgggaugcugaucgcuuguuaugugauuagcggauccagcgccgaucugucucucgagaaagcugccgaagucagcugggagcaagaagccgagcauuccggcacaucucacaacauccugguggaaguucaggacgaugggaccaugaagauuaaagacgaggagcgcgaugacacgcuuaccauccugcucaaggcuacacugcucgcggugagcggagucuaccccauguccaucccugccacccuguuugugugguauuucuggcagaaaaagaagcagagaucuggcguucuuugggauacacccagcccgccugaaguggagcgggcuguccuggacgauggcauuuaccgcauccugcaaagagggcuccugggacggucccaggugggcgucgggguguuccaggacggaguuuuucauaccauguggcacgugacacgcggcgccguccuuauguaucaggggaaaagacuggaacccucuugggccagcgugaagaaagaccucauuuccuacggaggcggcuggcgguuccaagggagcuggaauacgggagaggagguucaggugaucgcugucgaaccuggcaagaaccccaaaaaugugcagaccaugccggggacauuuaagaccccugagggagaagugggcgccauugcgcuggauuucaagcccgggaccucuggauccccuaucguuaacagagagggcaaaauugucggccucuacgggaauggaguggugacaacgagcggcaccuaugucucugcuaucgcccaagccaaggcuucccaggaagggccccugcccgagaucgaggacgaaguguuuaaaaagcgcaaccuuacaauuauggaucugcacccuggaagcggcaaaacccggagauaccugccggccaugguucgcgaggcgaucaagcggaagcucagaacacugauucuugcucccacccgcguggucgccuccgaaauggccgaggcucugaaagggaugccuauccgguaucagacgacagccgugaagucugaacauaccggcagagagauuguugaccucaugugccacgcuaccuucacaaugcgccugcugagccccgugcgggucccuaauuacaacaugaucaucauggaugaggcccauuuuaccgaccccgcguccauugccgcuagaggauauaucagcacacgggugggcaugggggaagccgcugccauuuucaugaccgccacgccuccgggaucuguugaggcuuuuccccaguccaaugcggugauccaagaugaagagcgcgacauuccugaaagaagcuggaacucuggcuacgauuggaucacagacuuccccgggaaaaccgucugguuugugccuagcaucaaguccggaaaugauauugccaacugucuccggaaaaacggcaagcgcgugauccagcuuucuagaaagacauucgacaccgaguaucagaaaacgaagaauaacgacugggauuacgucguuaccacagacauuagcgagaugggggcuaauuuccgggccgauagagugaucgacccccgccggugccugaaaccggugauucugaaggauggcccugaaagagucauccucgccggacccaugcccgugaccguugcuuccgccgcgcagcgccggggcagaauugggcgcaaccaaaauaaagagggagaccaguacguguauaugggccagccucugaacaaugaugaagaccacgcucauuggacagaggccaagaugcuucuggauaacaucaauacccccgaggggaucauuccugcccucuuugaaccggagcgggaaaagucugcugccaucgacggagaguacagacugcgcggcgaagcgagaaaaacauucgucgagcugaugcggcgcggggaucuccccguguggcuuagcuauaagguugccuccgagggcuuucaguacagcgacagacgguggugcuucgauggagaacgcaacaaucaagugcuggaggaaaacauggacgucgagauuuggaccaaagaaggcgagagaaagaaacugcggccuagauggcucgacgcucgcacguauucugauccccuggcccuucgggaguuuaaggaauucgcugccgggagacgcuccgugagcggagaccugauccucgagauuggcaaacugccucagcaccugacacuccgggcucagaaugcccuugauaaccuggucaugcugcacaauuccgaacaggggggaaaggcguacagacaugccauggaggaacuccccgacaccaucgagacccugaugcuucuggcucucaucgccgugcugacaggcggcguuacccuguuuuuccucucugggaagggacuuggcaaaacaagcauugggcugcugugugugacggcuuccucugcccuccuguggauggccagcguggagccgcacuggaucgcugcguccauuauccuugaauuuuuccugaugguccuccugauuccugagcccgaucggcaacgcaccccucaggacaaccagcuggccuauguugugaucggacuccuuuuuaugauccugacaguggcugccaacgaaaugggccugcucgagaccacaaagaaagaucuggggauuggacaugucgccgcugagaaucaccaacacgccaccaugcuugacguggaucugagacccgcgagcgccuggacgcucuacgcuguugccaccacagugaucaccccuaugaugcggcauacaauugaaaacaccacggcuaauaucucucugacagccauugcgaaccaggccgcuauccugaugggccucgacaagggcuggcccauuuccaaaauggauaucggggucccgcuucuggcccugggaugcuacagccaggugaauccucucacccugacagcugccguccuuaugcugguggcucacuaugccaucauuggccccgggcuccaggcgaaggccacccgcgaggcucaaaagagaaccgccgcuggaaucaugaaaaaccccacaguugacggcauuguggccaucgaucuggacccugucguguacgacgccaaguucgaaaaacagcuggggcagauuaugcuccuuauccuguguacgucucagauccugcucaugcggaccacaugggcgcugugcgaguccauuacccuugcuacaggaccgcugaccacgcucugggaaggcagccccggcaaguuuuggaauacaaccaucgccguuucuauggcuaacauuuuccgcgggagcuaucuggccggagccggccuggcuuucucccucaugaaaucucuugggggaggcagacgggggaccggagcccaaggcgagacacugggcgagaaguggaagcgccagcugaaucagcucagcaaauccgaauuuaacaccuacaagagaagcgggaucauggagguggaucgguccgaagcgaaagagggacugaagagaggcgaaacaacgaaacaugccgucucucgcgggaccgcuaagcuucggugguucguggagagaaaucuggugaagccugagggaaaaguuauugaccucggcugugggcgcggaggcuggagcuauuacugcgccggccugaagaaagucacagaagugaagggguauaccaaaggaggccccgggcacgaggaaccuauccccauggcuacauacggauggaaccuggugaagcuccauuccggcaaagaugucuuuuucaugccuccggagaagugugacacccuucugugcgauaucggggaaucuagccccaauccuacgauugaggagggacggacccugagaguucucaagaugguggaacccuggcugcgcggcaaccaguuuuguaucaaaauucuuaauccuuacaugcccuccguggucgagacacuggaacaaaugcagcggaagcacggcgggaugcucgugagaaacccgcugucucgcaauagcacccacgagauguauuggguuuccugcggaacaggcaacaucgugagcgccgucaacaugaccucucggaugcugcucaauagauucacaauggcgcaucgcaaaccuaccuacgagcgggacguggaucugggggccggaacgagacacguugcuguggaacccgaggucgccaaccuugacauuaucggccagcgcauugaaaauaucaagaacgagcauaaauccacauggcacuaugaugaagacaaucccuacaagaccugggcuuaucacgggagcuacgaggugaagccuucuggauccgccagcucuauggugaacggcgucguuagacugcucaccaaacccugggaugugaucccuauggugacacaaauugcuaugacggacaccacaccguuuggccagcagcgggucuucaaggagaaaguggacacccgcacacccagagccaagcgggggaccacacagaucauggaaguuaccgcgaaauggcuguggggauuucuuuccagaaauaagaagccucggauuuguacgcgcgaggaauucaccagaaaagugcggagcaacgccgcuaucggcgccgucuuuguggaugagaaucaauggaacuccgcuaaggaagccguugaggacgagcgcuucugggaucuggugcauagagaacgggagcuccacaaacaggggaagugcgccacaugcgucuauaauaugaugggaaaacgcgaaaagaagcugggcgaguuugggaaagcgaagggcagcagagcuauuugguacauguggcugggagcccgguuccucgaauucgaggcccugggcuuuaugaacgaggaccauugguucucucgcgaaaauagccuuuccgggguggagggagaaggccugcacaaacucggguacauccugagagauaucucuaagauucccggaggcaacauguaugcugacgauaccgccgggugggacacacggaucaccgaggaugaccuucagaaugaggcuaaaauuacggaaaucauggagccugaacaugcccugcucgcgacaagcauuuuuaagcugaccuaccagaacaaaguugugcgcguccaaagacccgccaagaacggcacagugauggaugucaucucccggcgcgaccagagaggaucuggccagguggggaccuauggacugaauacguucaccaacauggagguucagcucauccggcaaauggaaagcgagggcauuuuucugccguccgagcuugaaacaccuaaucuggcugagagagugcucgauuggcuggaaaagcacggggccgagcgccuuaaacggauggcuaucucuggagacgacugugucgugaagcccauugaugacagauucgccaccgcgcugacagcccucaacgauaugggcaaagugcgcaaggacaucccucagugggaacccagcaaaggguggaaugauuggcagcagguuccuuuuugcucccaccauuuccaccaacugauuaugaaggacggccgggagaucgugguccccuguagaaaccaggaugagcuggugggacgcgcucggguuagccagggcgccggguggucucucagagaaaccgcuugccugggaaaguccuacgcccaaauguggcagcuuauguauuuucaucgccgggaccugagacucgcugccaaugcgaucuguagcgccgugccggucgauugggugccuacaucucgcaccacgugguccauucacgcucaccaucaguggaugacaaccgaggacaugcugagcgucuggaaccggguguggaucgaagagaaucccuggauggaagauaaaacccacguuuccucuugggaggaggugcccuaccuuggcaagagagaagaccaguggugcgggagccugauuggacucacagcccgggccaccugggcuacaaacauccaagucgccauuaaucaggugagacgccugaucggcaacgagaauuaucuggacuacaugacguccaugaaacgguucaagaacgaaagcgauccugagggggcgcucugguga

SEQ ID NO: 18628 - RNA, 9879 nt, Artificial Sequence
  derived and/or modified CDS sequence (opt5) from DENV-1__GQ868529__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgccuuuuuccuggcgcaugccauugggacaucuaucacccaaaagggaaucauuuuuauccuccugaugcuugucaccccuagcauggcuaugcgcugcgugggcauugggaacagagauuucguugagggacuguccggcgccacauggguggacgucgugcucgagcacgggagcugugugacgaccauggcuaagaauaaacccacacuggauaucgaacugcucaagaccgaggucacaaacccugccauucugcggaaacuuugcaucgaagcgaagauuucuaauaccacgacagacucccgcuguccgacccagggagaggccacccugguugaagagcaggaugcuaacuuugugugcagacggacauucguggaccgcggcuggggcaauggguguggacucuuuggcaaagggagccugcuuaccugcgccaaguucaagugcgucacaaaacuggagggaaagacggugcaguacgaaaaccucaaauauucuguuaucgugaccguccacacaggcgaucaacaucagguggggaaugagaccacagaacacggaaccaucgcuacgauuaccccccaggccccuacauccgagauccagcugaccgacuacggcgcccugacacucgacuguagccccagaaccggccuggauuuuaacgaaaugguucuucugacgaugaaggagaaaucuuggcucgugcauaagcaaugguuccuggaccuuccucugcccuggacauccggggcuagcaccucccaggagacauggaaucggcaggaucuccuggucaccuuuaaaaccgcgcacgccaagaagcaagaaguggucgugcugggaucucaggagggcgcuaugcacacagcccucacgggggccaccgaaauucagacaagcggaaccacaaccaucuucgcuggccaucugaaaugccgccuuaagauggacaaacugacgcucaaggggacauccuauguuauguguaccggcagcuucaaacuggagaaggaaguggccgagacccagcacggaacaguccuggugcaaguuaaguacgagggcaccgaugcgccgugcaaaauuccuuuuucuacacaggacgaaaagggggugacgcagaacggaagacuuaucaccgcuaaucccaucgucacagauaaagagaagccugugaacauugaaaccgagccccccuucggcgaguccuauaucgugguuggggccggagaaaaagcccucaagcugagcugguuuaagaaaggcucuagcauugggaagauguucgaggcuacagcccggggcgcuagacgcauggccauccugggagacaccgcgugggauuuuggcuccauugggggagucuucacgucugugggcaaacucgugcaucaggucuuugggaccgccuacggagugcuguucagcggcguuuccuggacaaugaagaucgggaucggcauucuucugaccuggcucggacugaauagccggucuacaucccugagcaugaccuguaucgcugugggcauggucacacuuuaccucggggugaugguucaagccgacucuggaugcgugauuaacuggaaaggcagagaacugaaguguggguccggaaucuuugucaccaacgaggugcacacguggacagaacaguauaaguuccaggcugauagcccuaaacgccuguccgccgcgauuggcaaggccugggaggaggggguuugcggcauccggucugcuaccagacucgaaaauauuauguggaaacagaucagcaacgagcugaaucauauccuucuggaaaacgacaugaaguuuaccguggucgugggagacgccaauggcauucucgcucaagggaaaaagaugauccgcccgcagcccauggagcacaaauacuccuggaagucuuggggaaaggccaaaauuaucggcgccgauauucagaacacaaccuucaucaucgacgggccugauacgcccgaauguccugacaaucagcgggcuuggaacauuugggagguggaggauuauggauuuggcaucuucacaaccaauauuuggcugaagcugagagacagcuacacacaaaugugcgaucaccgccuuauguccgcggccaucaaagacagcaaggcuguccaugccgauaugggcuauuggauugaaucugagaaaaacgaaaccuggaagcucgcccgggcuuccuucaucgagguuaagacauguaccuggcccaaaagccacacgcuguggucuaauggggugcuggaauccgagaugaucauuccgaagaucuacggaggcccuauuagccagcauaacuauagacccggguacuuuacccagaucgccggaccuuggcaccucggcaaacuggagcuugacuucgaucugugcgaagggacaaccguggucguggacgagcacugcggaaaucgcggccccucucuccggacaaccacgguuacaggcaagauuauccaugaaugguguugcagaagcuguacccugccuccccugcgguuucgcggggaggauggaugcugguacggcauggagaucagaccggugaaagaaaaggaggaaaaccuuguccgguccauggugagcgcggggucuggagagguugacuccuucagccucggcauucugugugcuuccaucaugauugaagaggugaugagaucucgcuggagccggaagaugcugaugacagggacccucgccgucuuucugcuucuggugaugggacaacucaccuggaaugaccugaucagacugugcauuaugguuggcgccaacgcuuccgaucgcaugggcauggggacaacguaucuugcccugauggcgaccuucaaaaugagaccuauguuugcugugggacuccuguuccggcgccucacaucuagagagguccugcuucugaccaucggccucagccugguggccuccguggaacugcccaacucucuugaggaacugggggacggacucgccaugggcauuaugaugcugaagcuccugacagaguuucagccccaccagcuuuggaccacgcugcucagccugacauucaucaaaaccacccugucccuugauuacgcuuggaagacaaccgccauggcucugagcaucgucucucucuuuccucugugucucuccacaacgagccagaaaaccacauggcugccgguucuucuggggucuuucggaugcaagccccugaccauguuucucauuacagaaaauaagaucuggggccggaaauccuggccucugaacgagggcauuauggccaucgggauugugagcauccuucugucuucccuccugaagaaugacgugccccucgcgggaccucugaucgccggcgggaugcuuauugcuuguuaugucaucagcggauccagcgccgaucugucucuggagaaagcugccgaagugagcugggagcaagaagccgagcauuccggcaccucucacaacauucucguugaagugcaggacgaugggacgaugaagaucaaagacgaggagcgcgaugacacccugacaauucuucugaaggcuacccuccuggcggucagcggaguguaccccauguccaucccugccacacucuucguuugguauuucuggcagaaaaagaagcagagaucuggcgugcugugggauacccccagcccgccugaagucgagcgggcugugcuugacgauggcaucuaccgcauucugcaaagagggcugcucggacggucccaggucggcguggggguuuuucaggacggaguguuccauacaauguggcacgucacgcgcggcgccgugcugauguaucaggggaaaagacuugaacccucuugggccagcguuaagaaagaccugaucuccuacggaggcggcuggcgguuucaagggagcuggaauaccggagaggaggugcaggucauugcuguggaaccuggcaagaaccccaaaaaugugcagacaaccccggggaccuucaagacaccugagggagaaguuggcgccaucgcgcucgauuuuaagcccgggacgucuggauccccuauugucaacagagagggcaaaaucgugggccuguacgggaauggaguggucaccacaagcggcaccuaugugucugcuauugcccaagccaaggcuucccaggaagggccccuccccgagaucgaggacgaaguuuucaaaaagcgcaaccugacaaucauggaucuucacccuggaagcggcaaaacccggagauaccugccggccauggugcgcgaggcgauuaagcggaagcugagaacgcucauccuggcucccacacgcgucguggccuccgaaauggccgaggcucuuaaagggaugccuauucgguaucagaccaccgccguuaagucugaacauacaggcagagagaucguggaccugaugugccacgcuaccuuuacaaugcgccuccugagccccguccgggugccuaauuacaacaugauuaucauggaugaggcccauuucaccgaccccgcguccaucgccgcuagaggauauauuagcacgcggguuggcaugggggaagccgcugccaucuuuaugacagccaccccuccgggaucuguggaggcuuucccccaguccaaugcggucauucaagaugaagagcgcgacaucccugaaagaagcuggaacucuggcuacgauuggauuacagacuuucccgggaaaaccgugugguucgugccuagcaucaaguccggaaaugauaucgccaacugucugcggaaaaacggcaagcgcgucauucagcucucuagaaagacguucgacaccgaguaucagaaaacaaagaauaacgacugggauuacguugugaccacagacaucagcgagaugggggcuaauuuucgggccgauagagugauugacccccgccggugccuuaaaccggucauccugaaggauggcccugaaagagugauucuggccggacccaugcccguuaccguggcuuccgccgcgcagcgccggggcagaaucgggcgcaaccaaaauaaagagggagaccaguacgucuauaugggccagccucucaacaaugaugaagaccacgcucauuggacagaggccaagaugcugcuugauaacauuaauacccccgaggggaucaucccugcccuguucgaaccggagcgggaaaagucugcugccauugacggagaguacagacuccgcggcgaagcgagaaaaacguuuguggagcugaugcggcgcggggaucugcccguuuggcucagcuauaagguggccuccgagggcuuccaguacagcgacagacgguggugcuuugauggagaacgcaacaaucaaguccuugaggaaaacauggacguggagaucuggacaaaagaaggcgagagaaagaaacugcggccuagauggcuggacgcucgcaccuauucugauccccucgcccugcgggaguucaaggaauuugcugccgggagacgcuccgucagcggagaccuuaugcuggagauuggcaaacucccucagcaccugacccugcgggcucagaaugcccucgauaaccuugugaugcugcacaauuccgaacaggggggaaaggcguacagacaugccauggaggaacugcccgacacaaucgagacccucaugcugcuugcucugauugccguucucacaggcggcgugacgcuguucuuucugucugggaagggacucggcaaaaccagcaucgggcuucugugugugacagcuuccucugcccugcucuggauggccagcgucgagccgcacuggaucgcugcguccauuauccuggaauucuuucuuaugguucugcucauuccugagcccgaucggcaacgcaccccucaggacaaccagcuggccuauguggugaucggacugcucuucaugauucuuacagucgcugccaacgaaaugggccugcuggagaccacgaagaaagaucucgggaucggacauguggccgcugagaaucaccaacacgccaccaugcuggacguugaucuuagacccgcgagcgccuggacacuguacgcuguggccaccacagucaucaccccuaugaugcggcauacgauugaaaacacaaccgcuaauaucucucucacagccauugcgaaccaggccgcuauccugaugggccuggacaagggcuggcccauuuccaaaauggauaucggggugccgcuccuugcccugggaugcuacagccaggucaauccucugacccucaccgcugccgugcugaugcuuguugcucacuaugccauuaucggccccgggcugcaggcgaaggccacacgcgaggcucaaaagagaacggccgcuggaaucaugaaaaaccccaccguggacggcauugucgccaucgaucucgacccugugguuuacgacgccaaguuugaaaaacagcuggggcagauuaugcugcucauccuuuguacaucucagauucugcugaugcggaccacaugggcgcucugcgaguccaucacccuggcuacgggaccgcuuacaacccugugggaaggcagccccggcaaguucuggaauaccacaaucgccgugucuauggcuaacauuuuccgcgggagcuaucucgccggagccggccuggcuuuuucccugaugaaaucucucgggggaggcagacgggggaccggagcccaaggcgagacacuuggcgagaaguggaagcgccagcugaaucagcugagcaaauccgaauucaacacguacaagagaagcgggaucauggaggucgaucgguccgaagcgaaagagggacucaagagaggcgaaaccacaaaacaugccgugucucgcgggaccgcuaagcugcggugguuuguggagagaaaucuuguuaagccugagggaaaagucauugaccugggcugugggcgcggaggcuggagcuauuacugcgccggccucaagaaagugacagaagugaagggguauaccaaaggaggccuggggcacgaggaucccaucccuauggcuacguacggauggaaccuggucaagcuccuugccggcaaagacguuuucuuuaugcccccugaaaagugugauacccugcugugcgacauuggggaguccucuccgaaucccacaaucgaagagggacggacccucagagugcugaagaugguggagccuuggcuucgcggcaaccaguucuguaucaaaauucugaaucccuacaugccuagcgucguggaaacacucgagcaaaugcagcggaagcauggcgggaugcugguuagaaacccccugucccgcaauucuacccacgaaauguauugggugagcugcggaacaggcaacaucgucuccgcggugaacaugaccagccggaugcuccugaauagauuuacgauggcccaccgcaaaccgacauacgagcgggauguugaccuuggggcuggaaccagacauguggccgucgagccugaaguggcuaaccuggauauuaucggccagcgcauugagaauaucaagaacgaacacaaaucuaccuggcauuaugacgaggauaaucccuacaagacaugggccuaucacggguccuacgaagugaagcccagcggaucugcuuccagcauggucaacggcguugugagacuccugacgaaaccuugggacgugauucccauggucacccaaaucgccaugacagacaccacaccuuucggccagcagcggguguuuaaggagaaaguugauacccgcacaccgagagcgaagcgggggaccacgcagaucauggaggugaccgccaaauggcuuuggggauuccugucuagaaauaagaagccccggauuuguacacgcgaagaguuuaccagaaaaguccgguccaacgcugccaucggcgcuguguucguugacgaaaaucaauggaacagcgccaaggaggccguggaagaugagcgcuuuugggaccucguccacagagagcgggaacugcauaaacaggggaagugcgcgacaugcguguauaauaugaugggaaaacgcgagaagaagcugggcgaauucgggaaagcuaagggcuccagagccauuugguacauguggcucggagcccgguuccuggaguuugaagcucuuggcuucaugaacgaggaucacugguuuagccgcgagaauucucugagcgggguugaaggagagggccuccauaaacugggguacauccuuagagacauuuccaagaucccuggaggcaacauguaugccgaugacaccgcugggugggauacgcggaucacagaagacgaucugcagaaugaggccaaaauuaccgagaucauggaacccgagcacgcgcuccuggccacaucuauuuucaagcugaccuaccagaacaaagugguccgcgugcaaagaccugcuaagaacggcacggucauggacgugaucagccggcgcgaucagagaggauccggccagguugggaccuauggacucaauacauuuaccaacauggaagugcagcugauucggcaaauggagucugaaggcaucuuccuucccagcgagcuggagacaccgaaucucgccgaaagaguccuggacuggcuugagaagcauggggcugaacgccugaaacggauggccaucuccggagacgauuguguggugaagccuauugacgauagauuugcgaccgcccucacagcucugaacgacaugggcaaaguucgcaaggauaucccccagugggagccuucuaaaggguggaaugacuggcagcaggugcccuucugcagccaccacuuucaucaacugauuaugaaggauggccgggaaaucgucgugccuuguagaaaccaggacgagcucguuggacgcgcccgggugucccagggcgcuggguggagccugagagagaccgccugccuuggaaagucuuacgcucaaauguggcagcugauguauuuccaccgccgggaucucagacuggccgcgaaugccauuuguuccgcuguccccguggacugggucccgacgagccgcacaaccuggucuauccaugcccaccaccaguggaugaccacagaagauaugcuuuccguguggaaccggguuuggaucgaggaaaauccuuggauggaggacaaaacccaugugagcuccugggaagagguccccuaccugggcaagagagaggaccaguggugcgggucucucauuggacugacagcccgggcuacgugggccaccaacauccaaguggcgauuaaucagguuagacgccugaucggcaacgaaaauuaucucgauuacaugacaagcaugaaacgguuuaagaacgaguccgaccccgaaggggcucugugguga

SEQ ID NO: 18629 - RNA, 9879 nt, Artificial Sequence
  derived and/or modified CDS sequence (opt5) from DENV-1__GQ868531__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucuguguguguccaucaugauugaagaggucaugagaucucgcuggagccggaagaugcucaugacagggacccuggcuguguuccuucugcucguuaugggacaacugaccuggaaugaccugaucagacuuugcauuauggugggcgccaacgccuccgaucgcaugggcauggggacaacguaucuggcucucauggccaccuuuaaaaugagaccuauguucgcggucggacugcucuuucggcgccugacaucuagagaggugcuucugcucaccaucggccugagccugguggcuuccgucgaacuucccaacucucuggaggaacucggggacggacuggccaugggcauuaugaugcucaagcugcuuacagaguuccagccccaccagcuguggaccacgcuccugagccugacauuuaucaaaaccacccuuucccuggauuacgccuggaagacaaccgcuauggcccucagcaucguuucucuguucccucucugucuguccacaacgagccagaaaaccacauggcuuccggugcugcuggggucuuuuggaugcaagccccucaccauguuccugauuacagaaaauaagaucuggggccggaaauccuggccucuuaacgagggcauuauggcuaucgggauugugagcauccugcucucuucccugcucaagaaugacgucccccuggccggaccucuuaucgcgggcgggaugcugauugccuguuaugugaucagcggauccagcgcugaucugucucucgagaaagccgcugaaguuagcugggagcaagaagccgagcauuccggcaccucucacaacauucugguggaaguccaggacgaugggacgaugaagaucaaagacgaggagcgcgaugacacccuuacaauucugcucaaggccacccugcucgcugugagcggaguuuaccccauguccaucccugcgacacuguuugugugguauuucuggcagaaaaagaagcagagaucuggcguccuuugggauacccccagcccgccugaaguggagcgggccguccuggacgauggcaucuaccgcauucugcaaagagggcuccugggacggucccaggugggcguugggguguuccaggacggagucuuucauacaauguggcacgugacgcgcggcgcuguucuuauguaucaggggaaaagacuggaacccucuugggccagcgugaagaaagaccucaucuccuacggaggcggcuggcgguuccaagggagcuggaauaccggagaggagguccaggugauugccguggaaccuggcaagaaccccaaaaauguucagacaaccccggggaccuuuaagacaccugagggagaagucggcgcuaucgcccuggauuucaagcccgggacgucuggauccccuauugugaacagagagggcaaaaucgugggccucuacgggaauggagucgugaccacaagcggcaccuauguuucugcgauugcucaagccaaggccucccaggaagggccccugcccgagaucgaggacgaaguguuuaaaaagcgcaaccuuacaaucauggaucugcacccuggaagcggcaaaacccggagauaccugccggcuauuguccgcgaggccaucaagcggaagcucagaacgcugauucuugcgcccacacgcgugguugcuuccgaaauggccgaggcccugaaagggaugccuauccgguaucagaccaccgcugugaagucugaacauacaggcagagagauugucgaccucaugugccacgccaccuucacaaugcgccugcugagccccgugcggguuccuaauuacaacaugaucaucauggaugaggcucauuuuaccgaccccgccuccauugcggccagaggauauaucagcacgcgggugggcaugggggaagcugccgcuauuuucaugacagccaccccuccgggaucugucgaggccuuuccccaguccaaugcugugauccaagaugaagagcgcgacauuccugaaagaagcuggaacucuggcuacgauuggaucacagacuuccccgggaaaaccgugugguuugucccuagcaucaaguccggaaaugauauugcgaacugucuccggaaaaacggcaagcgcguuauccagcuuucuagaaagacguucgacaccgaguaucagaaaacaaagaauaacgacugggauuacguggugaccacagacauuagcgagaugggggccaauuuccgggcugauagagucaucgacccccgccggugccugaaaccggugauucugaaggauggcccugaaagaguuauccucgccggacccaugcccgugaccgucgccuccgcugcccagcgccggggcagaauugggcgcaaccaaaauaaagagggagaccaguacguguauaugggccagccucugaacaaugaugaagaccacgcgcauuggacagaggcuaagaugcuucuggauaacaucaauacccccgaggggaucauuccugcccucuuugaaccggagcgggaaaagucugccgcuaucgacggagaguacagacugcgcggcgaagccagaaaaacguucguugagcugaugcggcgcggggaucuccccguguggcuuagcuauaaggucgcguccgagggcuuucaguacagcgacagacgguggugcuucgauggagaacgcaacaaucaagugcuggaggaaaacauggacgucgagauuuggacaaaagaaggcgagagaaagaaacugcggccuagauggcucgacgcccgcaccuauucugauccccuggcucuucgggaguuuaaggaauucgccgcugggagacgcuccgugagcggagaccugauccucgagauuggcaaacugccucagcaccugacccuccgggcccagaaugcucuugauaaccugguuaugcugcacaauuccgaacaggggggaaaggccuacagacaugcgauggaggaacuccccgacacaaucgagacccugaugcuucuggcccucaucgcugugcugacaggcggcgugacgcuguuuuuccucucugggaagggacuuggcaaaaccagcauugggcugcugugugucacagccuccucugcucuccuguggauggccagcguugagccgcacuggaucgccgcuuccauuauccuugaauuuuuccugauggugcuccugauuccugagcccgaucggcaacgcaccccucaggacaaccagcuggcguauguggucaucggacuccuuuuuaugauccugacaguggccgcuaacgaaaugggccugcucgagaccacgaagaaagaucuggggauuggacauguugccgccgagaaucaccaacacgcuaccaugcuugacguggaucugagacccgccagcgcguggacacucuacgccgucgcuaccacagugaucaccccuaugaugcggcauacgauugaaaacacaaccgccaauaucucucugacagcuauugccaaccaggcggccauccugaugggccucgacaagggcuggcccauuuccaaaauggauaucggggucccgcuucuggcucugggaugcuacagccaggugaauccucucacccugaccgccgcuguucuuaugcugguggcccacuaugcuaucauuggccccgggcuccaggccaaggcgacacgcgaggcccaaaagagaacggcugccggaaucaugaaaaaccccaccgucgacggcauuguggcuaucgaucuggacccuguuguguacgacgccaaguucgaaaaacagcuggggcagauuaugcuccuuauccuguguacaucucagauccugcucaugcggaccacaugggcccugugcgaguccauuacccuugcgacgggaccgcugacaacccucugggaaggcagccccggcaaguuuuggaauaccacaaucgcugucucuauggccaacauuuuccgcgggagcuaucuggcuggagccggccuggccuucucccucaugaaaucucuugggggaggcagacgggggaccggagcucaaggcgagacacugggcgagaaguggaagcgccagcugaaucagcucagcaaauccgaauuuaacacguacaagagaagcgggaucauggagguggaucgguccgaagccaaagagggacugaagagaggcgaaaccacaaaacaugcggugucucgcgggaccgccaagcuucggugguucguugagagaaaucuggucaagccugagggaaaagugauugaccucggcugugggcgcggaggcuggagcuauuacugcgcuggccugaagaaagugacagaagucaagggguauaccaaaggaggccccgggcacgaggaaccuauccccauggccacguacggauggaaccugguuaagcuccauuccggcaaagauguguuuuucaugccuccggagaagugugacacccuucugugcgauaucggggaaucuagccccaauccuacaauugaggagggacggacccugagagugcucaagauggucgaacccuggcugcgcggcaaccaguuuuguaucaaaauucuuaauccuuacaugcccuccgugguugaggcucuggaacaaaugcagcggaagcacggcgggaugcucgugagaaacccgcugucucgcaauagcacacacgagauguauugggucuccugcggaaccggcaacaucgugagcgccguuaacaugacaucucggaugcugcucaauagauucaccauggcgcaucgcaaaccuacguacgagcgggacguggaucugggggccggaacaagacacgucgcuguggaacccgagguggccaaccuugacauuaucggccagcgcauugaaaauaucaagaacgagcauaaauccaccuggcacuaugaugaagacaaucccuacaagaccugggcuuaucacgggagcuacgaggucaagccuucuggauccgccagcucuaugguuaacggcguggugagacugcucacaaaacccugggaugucaucccuauggugacgcaaauugcuaugaccgacacaaccccguuuggccagcagcggguuuucaaggagaaaguggacacacgcacccccagagccaagcgggggacaacccagaucauggaagucacggcgaaauggcuguggggauuucuuuccagaaauaagaagccucggauuuguacccgcgaggaauucacaagaaaagugcggagcaacgccgcuaucggcgccguuuuuguggaugagaaucaauggaacuccgcuaaggaagccgucgaggacgagcgcuucugggaucuggugcauagagaacgggagcuccacaaacaggggaagugcgccaccugcguuuauaauaugaugggaaaacgcgaaaagaagcugggcgaguuugggaaagcgaagggcagcagagcuauuugguacauguggcugggagcccgguuccucgaauucgaggcccugggcuuuaugaacgaggaccauugguucucucgcgaaaauagccuuuccgggguggagggagaaggccugcacaaacucggguacauccugagagauaucucuaagauucccggaggcaacauguaugcugacgauacagccgggugggacacccggaucacggaggaugaccuucagaaugaggcuaaaauuacagaaaucauggagccugaacaugcccugcucgcgaccagcauuuuuaagcugacauaccagaacaaagucgugcgcguccaaagacccgccaagaacggcaccgugauggauguuaucucccggcgcgaccagagaggaucuggccagguggggacguauggacugaauaccuucacaaacauggagguccagcucauccggcaaauggaaagcgagggcauuuuucugccguccgagcuugaaaccccuaaucuggcugagagagugcucgauuggcuggaaaagcacggggccgagcgccuuaaacggauggcuaucucuggagacgacugugugguuaagcccauugaugacagauucgccacagcgcugaccgcccucaacgauaugggcaaagugcgcaaggacaucccucagugggaacccagcaaaggguggaaugauuggcagcaggucccuuuuugcucccaccauuuccaccaacugauuaugaaggacggccgggagaucgugguucccuguagaaaccaggaugagcuggugggacgcgcucgggucagccagggcgccggguggucucucagagaaacagcuugccugggaaaguccuacgcccaaauguggcagcuuauguauuuucaucgccgggaccugagacucgcugccaaugcgaucagcucugccgugccggucgauugggugccuaccucccgcacgacauggagcauucacgcucaccaucaguggaugaccaccgaggacaugcuguccguuuggaaccggguguggaucgaagagaaucccuggauggaagauaaaacacacgucucuagcugggaggaggugcccuaccuuggcaagagagaagaccaguggugugggucccugauuggacucaccgcccgggccacaugggcuacgaacauccaaguugccauuaaucaggugagacgccugaucggcaacgagaauuaucuggacuacaugaccagcaugaaacgguucaagaacgaaucugauccugagggggcgcucugguga

SEQ ID NO: 18630 - RNA, 9879 nt, Artificial Sequence
  derived and/or modified CDS sequence (opt5) from DENV-1__GU131983__SS-prME
agcgugaccaugcugcucaugcugcuucccacagcccuggcuuuccaccucacgaccagaggcggggaaccucauaugaucgucuccaagcaggaacggggaaagucucugcuuuuuaagacaagcgccggcguuaacaugugcacccugauugcgauggaccucggggagcugugugaagauacaaugaccuacaagugcccccagaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagaacaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccgcccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaaacuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugaucgggacacuggccgucuuccuucugcucgugaugggacaacugaccuggaaugaccugauuagacuuugcaucaugguuggcgccaacgcuuccgaucgcaugggcauggggaccacauaucuggcccucauggcgacguuuaaaaugagaccuauguucgcugugggacugcucuuucggcgccugaccucuagagagguccuucugcucacaauuggccugagccugguggccuccguggaacuucccaacucucuggaggaacucggggacggacuggccaugggcaucaugaugcucaagcugcuuaccgaguuccagccccaccagcuguggacaacccuccugagccugacguuuaucaaaacaacccuuucccuggauuacgcuuggaagaccacagccauggcucucagcauugucucucuguucccucucugucuguccaccacaagccagaaaacgaccuggcuuccgguucugcuggggucuuuuggaugcaagccccucacaauguuccugaucaccgaaaauaagauuuggggccggaaauccuggccucuuaacgagggcaucauggccauugggaucgugagcauccugcucucuucccugcucaagaaugacgugccccuggcgggaccucuuauugccggcgggaugcugaucgcuuguuaugucauuagcggauccagcgccgaucugucucucgagaaagcugccgaagugagcugggagcaagaagccgagcauuccggcacaucucacaacauccugguugaagugcaggacgaugggaccaugaagauuaaagacgaggagcgcgaugacacgcuuaccauccugcucaaggcuacacugcucgcggucagcggaguguaccccauguccaucccugccacccuguuuguuugguauuucuggcagaaaaagaagcagagaucuggcgugcuuugggauacacccagcccgccugaagucgagcgggcugugcuggacgauggcauuuaccgcauccugcaaagagggcuccugggacggucccaggucggcguggggguuuuccaggacggaguguuucauaccauguggcacgucacacgcggcgccgugcuuauguaucaggggaaaagacuggaacccucuugggccagcguuaagaaagaccucauuuccuacggaggcggcuggcgguuccaagggagcuggaauacgggagaggaggugcaggucaucgcuguggaaccuggcaagaaccccaaaaaugugcagaccacaccggggaccuuuaagaccccugagggagaaguuggcgccauugcgcuggauuucaagcccgggacaucuggauccccuaucgucaacagagagggcaaaauugugggccucuacgggaauggaguggucacgaccagcggcacauaugugucugcuaucgcccaagccaaggcuucccaggaagggccccugcccgagaucgaggacgaaguuuuuaaaaagcgcaaccuuaccauuauggaucugcacccuggaagcggcaaaacacggagauaccugccggccaucgugcgcgaggcgauuaagcggaagcucagaacccugauccuugcucccacgcgcgucguggccuccgaaauggccgaggcucugaaagggaugccuauucgguaucagacaaccgccguuaagucugaacauaccggcagagagaucguggaccucaugugccacgcuacauucaccaugcgccugcugagccccguccgggugccuaauuacaacaugaucauuauggaugaggcccauuuuacagaccccgcguccaucgccgcuagaggauauauuagcacccggguuggcaugggggaagccgcugccaucuucaugacggccacaccuccgggaucuguggaggcuuuuccccaguccaaugcggucauucaagaugaagaacgcgacaucccugaaagaagcuggaacucuggcuacgauuggaucaccgacuuccccgggaaaacagugugguuugugccuagcauuaaguccggaaaugauaucgccaacugucuccggaaaaacggcaagcgcgucauucagcuuucuagaaagaccuucgacacggaguaucagaaaaccaagaauaacgacugggauuacguugugacaaccgacaucagcgagaugggggcuaauuuccgggccgauagagugauugacccccgccggugccugaaaccggucauccugaaggauggcccugaaagagugauucucgccggacccaugcccguuacaguggcuuccgccgcgcagcgccggggcagaaucgggcgcaaccaaaauaaagagggagaccaguacgucuauaugggccagccucugaacaaugaugaagaccacgcucauuggaccgaggccaagaugcuucuggauaacaucaauacacccgaggggauuaucccugcccucuuugaaccggagcgggaaaagucugcugccauugacggagaguacagacugcgcggcgaagcgagaaaaaccuucguggagcugaugcggcgcggggaucuccccguuuggcuuagcuauaagguggccuccgagggcuuucaguacagcgacagacgguggugcuucgauggagaacgcaacaaucaaguccuggaggaaaacauggacguggagaucuggacgaaagaaggcgagagaaagaaacugcggccuagauggcucgacgcucgcacauauucugauccccuggcccuucgggaguuuaaggaguucgcugccgggagacgcuccgucagcggagaccugauucucgagaucggcaaacugccucagcaccugacccuccgggcucagaaugcccuugauaaccuggugaugcugcacaauuccgaacaagggggaaaggcguacagacaugccauggaggaacuccccgacaccaucgagacacugaugcuucuggcucucauugccguucugaccggcggcgugacacuguuuuuccucucugggaagggacuuggcaaaacgagcaucgggcugcugugugugaccgcuuccucugcccuccuguggauggccagcgucgagccgcacuggauugcugcguccaucauucuugaauuuuuccugaugguucuccugaucccugagcccgaucggcaacgcacaccucaggacaaccagcuggccuauguggugaucggacuccuuuuuaugauucugaccgucgcugccaacgaaaugggccugcucgagacaaccaagaaagaucuggggaucggacauguggccgcugagaaucaccaacacgccacgaugcuugacguugaucugagacccgcgagcgccuggacccucuacgcuguggccacaaccgucauuacaccuaugaugcggcauaccaucgaaaacacgacagcuaauauuucucugaccgccaucgcgaaccaggccgcuauucugaugggccucgacaagggcuggcccaucuccaaaauggauaucggggugccgcuucuggcccugggaugcuacagccaggucaauccucucacacugaccgcugccgugcuuaugcugguugcucacuaugccauuaucggccccgggcuccaggcgaaggccacccgcgaggcucaaaagagaacagccgcuggaauuaugaaaaaccccacgguggacggcaucgucgccauugaucuggacccugugguuuacgacgccaaguucgaaaaacagcuggggcagaucaugcuccuuauccuguguaccucucagauucugcucaugcggacaaccugggcgcugugcgaguccaucacacuugcuaccggaccgcugacgacacucugggaaggcagccccggcaaguuuuggaauaccaccauugccgugucuauggcuaacaucuuccgcgggagcuaucuggccggagccggccuggcuuucucccucaugaaaucucuugggggaggcagacgggggacaggagcccaaggcgagacccugggcgagaaguggaagcgccagcugaaucagcucagcaaauccgaauuuaacacauacaagagaagcgggauuauggaggucgaucgguccgaagcgaaagagggacugaagagaggcgaaacgaccaaacaugccgugucucgcgggacagcuaaacuucggugguucguggagagaaaucugguuaagccugagggaaaagucaucgaccucggcugugggcgcggaggcuggagcuauuacugcgccggccugaagaaagugaccgaagugaagggguauacaaaaggaggccccgggcacgaggaaccuauccccauggcuaccuacggauggaaccuggucaagcuccauuccggcaaagauguguuuuucaugccuccggagaagugugacacgcuucugugcgauauuggggaaucuagccccaauccuaccaucgaggagggacggacacugagaguucucaagaugguggaacccuggcugcgcggcaaccaguuuuguauuaaaauccuuaauccuuacaugcccuccgucguggagacccuggaacaaaugcagcggaagcacggcgggaugcucguuagaaacccgcugucucgcaauagcacacacgagauguauuggguguccugcggaaccggcaacauugucagcgccgugaacaugacaucucggaugcugcucaauagauucaccauggcgcaucgcaaaccuacguacgagcgggacguugaucugggggccggaacaagacacguggcugucgaacccgagguggccaaccuugacaucauuggccagcgcaucgaaaauaucaagaacgagcauaaauccaccuggcacuaugaugaagacaaucccuacaagaccugggcuuaucacgggagcuacgaggugaagccuucuggauccgccagcucuauggucaacggcguugugagacugcucacaaaacccugggaugugauuccuauggucacgcaaaucgcuaugaccgacacaaccccguuuggccagcagcggguguucaaggagaaaguugacacacgcacccccagagccaagcgggggacaacccagauuauggaagugacggcgaaauggcuguggggauuucuuuccagaaauaagaagccucggaucuguacccgcgaggaguucacaagaaaaguccggagcaacgccgcuauuggcgccguguuuguugaugagaaucaauggaacuccgcuaaggaagccguggaggacgagcgcuucugggaucugguccauagagaacgggagcuccacaaacaggggaagugcgcuaccugcguguauaauaugaugggaaaacgcgaaaagaagcugggcgaguuugggaaagcgaagggcagcagagcuaucugguacauguggcugggagcccgguuccucgaguucgaggcccugggcuuuaugaacgaggaccauugguucucucgcgaaaauagccuuuccgggguugagggagaaggccugcacaaacucggguacauccugagagauauuucuaagauccccggaggcaacauguaugcugacgauacagccgggugggacacccggauuacggaggaugaccuucagaaugaggcuaaaaucacagaaauuauggagccugaacaugcccugcucgcgaccagcaucuuuaagcugacauaccagaacaaagugguccgcgugcaaagacccgccaagaacggcaccgucauggaugugaucucccggcgcgaccagagaggaucuggccagguugggacguauggacugaauaccuucacaaacauggaggugcagcucauucggcaaauggaaagcgaggagaucuuucugccguccgaacuugagaccccuaaucuggcugaaagaguccucgauuggcuggagaagcacggcgccgaacgccuuaaacggauggcuauuucuggggacgacuguguggugaagcccaucgaugacagauucgccacagcgcugaccgcccucaacgauaugggaaaaguucgcaaggacauuccucagugggagcccagcaaaggcuggaaugauuggcaacaggugccuuuuugcucccaccauuuccaccaacugaucaugaaggacgggcgggagaucgucgugcccuguagaaaccaggaugaacugguuggccgcgcucgggugagccagggagccggcuggucucucagagagacagcuugccuggggaaguccuacgcccaaauguggcagcuuauguauuuucaucgccgggaccugagacucgcugccaaugcgauuuguagcgccgucccgguggauugggucccuaccucucgcacgacaugguccauccacgcucaccaucaguggaugaccaccgaagacaugcugagcguguggaaccggguuuggauugaggaaaaucccuggauggaggauaaaacacacguguccucuugggaggaaguccccuaccuuggaaagagagaggaccaguggugcggcagccugaucgggcucaccgcccgggccacaugggcuacgaacauucaaguggccaucaaucagguuagacgccugauuggaaacgaaaauuaucuggacuacaugaccuccaugaaacgguucaagaacgagagcgauccugagggcgcgcucugguga

SEQ ID NO: 18631 - RNA, 9879 nt, Artificial Sequence
  derived and/or modified CDS sequence (opt5) from DENV-1__GQ868532__SS-prME
agcgugaccaugcugcucaugcugcuucccacagcucuggcuuuccaccucacgaccagaggcggggaaccucauaugaucgucuccaagcaggaacggggaaagucucugcuuuuuaagacaagcgccggcguuaacaugugcacccugauugcgauggaccucggggagcugugugaagauacaaugaccuacaaaugcccccagaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcugucccacccagggagaggccacccucguugaagaacaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccgcccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaaacuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucgugaugggacaacugaccuggaaugaccugaucagacuuugcauuaugguuggcgccaacgcuuccgaucgcaugggcauggggacaacguaucuggcccucauggcgaccuuuaaaaugagaccuauguucgcugugggacugcucuuucggcgccugacaucuagagagguccuucugcucaccaucggccugagccugguggccuccguggaacuucccaacucucuggaggaacucggggacggacuggccaugggcauuaugaugcucaagcugcuuacagaguuccagccccaccagcuguggaucacccuccugagccugacguuuaucaaaacaacccuuucccuggauuacgcuuggaagaccacagccauggcucucagcauugucucucuguucccucucugucuguccaccacaagccagaaaacgaccuggcuuccgguucugcuggggucuuuuggaugcaagccccucacaauguuccugaucaccgaaaauaagauuuggggccggaaauccuggccucuuaacgagggcaucauggccauugggaucgugagcauccugcucucuucccugcucaagaaugacgugccccuggcgggaccucuuauugccggcgggaugcugaucgcuuguuaugucauuagcggaaacuccgccgaucugagccucgagaaagcugccgaagugucuugggagcaagaagccgagcauagcggcacaucccacaauauccugguugaagugcaggacgaugggaccaugaagauuaaagacgaggagcgcgaugacacgcuuaccauccugcucaaggcuacacugcucgcggucucuggaguguaccccaugagcaucccugccacccuguuuguuugguauuucuggcagaaaaagaagcagagauccggcgugcuuugggauacacccucuccgccugaagucgagcgggcugugcuggacgauggcauuuaccgcauccugcaaagagggcuccugggacggagccaggucggcguggggguuuuccaggacggaguguuucauaccauguggcacgucacacgcggcgccgugcuuauguaucaggggaaaagacuggaacccuccugggccucuguuaagaaagaccucauuagcuacggaggcggcuggcgguuccaaggguccuggaacacgggagaggaggugcaggucaucgcuguggaaccuggcaagaaucccaaaaacgugcagaccaugccggggacauuuaagaccccugagggagaaguuggcgccauugcgcuggauuucaagcccgggaccagcggaucuccuaucgucaauagagagggcaaaauugugggccucuacgggaacggaguggucacaacguccggcaccuaugugagcgcuaucgcccaagccaaggcuucucaggaagggccgcccccugagaucgaggacgaaguuuuuaaaaagcgcaaucugacaauuauggaucuucacccgggauccggcaaaacccggagauaccugcccgccauggugcgcgaggcgaucaagcggaagcugagaacacucauucuggcuccuacccgcgucguggccagcgaaauggccgaggcucuuaaagggaugcccauccgguaucagacgacagccguuaaguccgaacauaccggcagagagauuguggaccugaugugccacgcuaccuucacaaugcgccuccugucuccuguccgggugcccaacuacaauaugaucaucauggaugaggcccauuuuaccgacccugcgagcauugccgcuagaggauauaucuccacacggguuggcaugggggaagccgcugccauuuucaugaccgccacgccgcccggaagcguggaggcuuuuccucagucuaacgcggucauccaagaugaagaacgcgacauucccgaaagauccuggaauagcggcuacgauuggaucacagacuucccugggaaaaccgugugguuugugcccucuaucaagagcggaaacgauauugccaacugucugcggaaaaauggcaagcgcgucauccagcucuccagaaagacauucgacaccgaguaucagaaaacgaagaacaaugacugggauuacguugugaccacagacauuucugagaugggggcuaacuuccgggccgauagagugaucgacccgcgccggugccuuaaaccugucauucugaaggauggccccgaaagagugauccuggccggacccaugccuguuaccguggcuagcgccgcgcagcgccggggcagaauugggcgcaaucaaaacaaagagggagaccaguacgucuauaugggccagccccucaauaacgaugaagaccacgcucauuggacagaggccaagaugcugcuugauaauaucaacaccccugaggggaucauuccggcccuguuugaacccgagcgggaaaaguccgcugccaucgacggagaguacagacuccgcggcgaagcgagaaaaacauucguggagcugaugcggcgcggggaucugccuguuuggcucucuuauaagguggccagcgagggcuuucaguacuccgacagacgguggugcuucgauggagaacgcaauaaccaaguccuugaggaaaauauggacguggagauuuggaccaaagaaggcgagagaaagaaacugcggcccagauggcuggacgcucgcacguauagcgauccucucgcccugcgggaguuuaaggaguucgcugccgggagacgcucugucuccggagaccuuauccuggagauuggcaaacucccccagcaccugacacugcgggcucagaacgcccucgauaaucuugugaugcugcacaacagcgaacaaggcgggaaggcguacagacaugccauggaggaacugccggacaccaucgagacccucaugcugcuuacacugaucgcuguucucaccgggggcgugacacuguuuuuccuguccgggaagggacucggcaaaacgucuauugggcuucugugugugaccgccagcuccgcucugcucuggauggccucugucgagccucacuggaucgccgcuagcauuauccuggaauuuuuccuuaugguucugcucauucccgagccugaucggcaacgcacaccccaggacaaccagcuggcguauguggugaucggacugcucuuuaugauccuuaccgucgccgcuaaugaaaugggccugcuggagacaaccaagaaagaucucgggauuggacauguggccgccgagaaccaccaacacgcuacgaugcuggacguugaucuuagaccugccuccgcguggacccuguacgccguggcuacaaccgucaucacacccaugaugcggcauaccauugaaaauacgacagccaacaucagccucaccgcuauugccaaucaggcggccauccugaugggccuggacaagggcuggccgauuucuaaaauggauaucggggugccucuccuugcucugggaugcuacucccaggucaacccccugacacucaccgccgcugugcugaugcuuguugcccacuaugcuaucauuggccccgggcugcaggccaaggcgacccgcgaggcccaaaagagaacagcugccggaaucaugaaaaauccuacgguggacggcauugucgcuaucgaucucgacccggugguuuacgacgccaaguucgaaaaacagcuggggcagauuaugcugcucauccuuuguaccagccagauccugcugaugcggacaaccugggcccucugcgagucuauuacacuggcgaccggaccccuuacgacacugugggaaggcuccccuggcaaguuuuggaacaccaccaucgcugugagcauggccaauauuuuccgcgggucuuaucucgcuggagccggccuggccuucagccugaugaaaucccucgggggaggcagacgggggacaggagcucaaggcgagacccuuggcgagaaguggaagcgccagcugaaccagcugucuaaaagcgaauuuaauacauacaagagauccgggaucauggaggucgaucggagcgaagccaaagagggacucaagagaggcgaaacgaccaaacaugcggugucccgcgggacagccaagcugcggugguucguggagagaaaccuuguuaagcccgagggaaaagucauugaccugggcugugggcgcggaggcuggucuuauuacugcgcuggccucaagaaagugaccgaagugaagggguauacaaaaggaggcccugggcacgaggaacccaucccuauggccaccuacggauggaaucuggucaagcugcauagcggcaaagauguguuuuucaugccgcccgagaagugugacacgcuccuuugcgauaucggggaauccucuccuaaccccaccauugaggagggacggacacugagaguucugaagaugguggaaccuuggcuccgcggcaaucaguuuuguaucaaaauucugaaccccuacaugccgaaugucguggagacccuugaacaaaugcagcggaagcacggcgggaugcugguuagaaacccucucagccgcaacuccacacacgagauguauugggugucuugcggaaccggcaauaucgucagcgcugugaacaugacaucccggaugcugcugaauagauucaccauggcccaucgcaaacccacguacgagcgggacguugaucucggggcgggaacaagacacguggccgucgaacccgagguggcuaaccuggacauuaucggccagcgcauugaaaauaucaagaacgagcauaaaagcaccuggcacuaugaugaagacaauccuuacaagaccugggccuaucacgggucuuacgaggugaagcccuccggaagcgcuucuuccauggucaacggcguugugagacuucugacaaaaccuugggauggcaucccgauggugacgcaaauugccaugaccgacacaacccccuuugggcagcagcgggucuucaaggagaaaguggacacacgcaccccuagagcuaagcggggaacaacccagaucauggaaguuacggccaaauggcucuggggcuuucugagcagaaauaagaagccccggauuuguacccgcgaggaguucacaagaaaagugcggucuaacgcggccaucggggcugucuuuguggaugagaaucaauggaacuccgccaaggaagcuguugaggacgagcgcuucugggaucuugugcauagagaacgggagcugcacaaacagggaaagugcgcuaccugcgucuauaauaugaugggcaaacgcgaaaagaagcucggggaguuuggcaaagccaagggaagcagagcgauuugguacauguggcugggcgcucgguuccuggaguucgaggcccucggguuuaugaacgaggaccauugguucucccgcgaaaauagccugucuggaguggagggcgaagggcuucacaaacugggauacauccucagagauaucagcaagauuccuggcgggaacauguaugccgacgauacagcuggcugggacacccggaucacggaggaugaccugcagaacgaggccaaaauuacagaaaucauggagcccgaacaugcccuucuggccaccuccauuuuuaagcucacauaccagaauaaaguugugcgcguccaaagaccggcgaagaacggaaccgugauggaugucaucucucggcgcgaccagagaggcagcggacaggugggaacguauggccugaauaccuucacaaacauggagguucagcugauccggcaaauggaauccgaggggauuuuucucccuucugagcuggaaacccccaaucuugccgagagagugcuggauuggcucgaaaagcacggagcugagcgccugaaacggauggccaucagcggcgacgacugugucgugaagccuauugaugacagauucgcuacagcccuuaccgcgcugaacgauauggggaaagugcgcaaggacaucccccagugggaaccuuccaaaggcuggaaugauuggcagcagguucccuuuugcucucaccauuuccaccaacucauuaugaaggacggacgggagaucguggucccguguagaaaccaggaugagcuggugggccgcgcccggguuagccagggggcuggauggucccugagagaaacagccugccucggcaagagcuacgcucaaauguggcagcugauguauuuucaucgccgggaccuuagacuggccgcuaaugccaucuguucugcggugccugucgauugggugcccaccucccgcacgacauggagcauucacgcccaccaucaguggaugaccaccgaggacaugcucucugucuggaaccggguguggaucgaagagaaucccuggauggaagauaaaacacacguuuccagcugggaggaggugccuuaccuggggaagagagaagaccaguggugcggaucccuuauuggccugaccgcucgggccacaugggccacgaacauccaagucgcuauuaaucaggugagacgccucaucgggaacgagaauuaucuggacuacaugaccucuaugaaacgguucaagaacgaaagcgauccggagggcgcccugugguga

SEQ ID NO: 18632 - RNA, 9879 nt, Artificial Sequence
  derived and/or modified CDS sequence (opt5) from DENV-1__GQ868533__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauugaagccgauauccagaacaccacauuuaucauugacggcccugauacccccgaguguccugacaaucagcgggcuuggaacaucugggagguggaagauuauggguucggaauuuuuacgacaaauaucuggcugaagcuuagagacagcuacacccaaaugugcgaucaccgccucauguccgcggccauuaaagacagcaaggcuguccaugccgauaugggcuauuggaucgagucugaaaaaaacgagacauggaagcuggcccgggcuuccuucaucgaaguuaagaccuguacauggcccaaaagccacacccuguggucuaauggcgugcucgaguccgagaugauuaucccgaagauuuacgggggaccuaucagccagcauaacuauagacccggcuacuucacgcagaccgccgggccuuggcaccugggaaaacuugaacuggacuuugaucucugcgagggcacaaccguggucguggacgaacacugcgggaaucgcggacccucucugcggacaaccacgguuacaggcaagauuauccaugagugguguugcagaagcuguacccugccuccccuucgguuccgcggcgaggaugggugcugguacggaauggaaaucagaccggugaaagagaaggaagagaaccucguccgguccauggugagcgcgggcucuggggaaguugacuccuuuagccugggaauucugugugcuuccaucaugauugaggaggugaugagaucucgcuggagccggaagaugcucaugacaggcacccuggccgucuuccuucugcucgugauggggcaacugaccuggaaugaccugaucagacuuugcauuaugguuggagccaacgcuuccgaucgcaugggcaugggcacaacguaucuggcccucauggcgaccuuuaaaaugagaccuauguucgcuguggggcugcucuuucggcgccugacaucuagagaaguccuucugcucaccaucggacugagccugguggccuccguggagcuucccaacucucuggaagagcucggcgacgggcuggccaugggaauuaugaugcucaagcugcuuacagaauuccagccccaccagcuguggaccacgcuccugagccugacauuuaucaaaaccacccuuucccuggauuacgcuuggaagacaaccgccauggcucucagcaucgucucucuguucccucucugucuguccacaacgagccagaaaaccacauggcuuccgguucugcugggcucuuuugggugcaagccccucaccauguuccugauuacagagaauaagaucuggggacggaaauccuggccucuuaacgagggcauuauggccaucggcauugugagcauccugcucucuucccugcucaagaaugacgugccccuggcggggccucuuaucgccggaggcaugcugauugcuuguuaugucaucagcggguccagcgccgaucugucucucgaaaaagcugccgaggugagcugggaacaagaggccgaacauuccggaaccucucacaacauucugguugaggugcaggacgauggcacgaugaagaucaaagacgaggaacgcgaugacacccuuacaauucugcucaaggcuacccugcucgcggucagcgggguguaccccauguccaucccugccacacuguuucuuugguauuucuggcagaaaaagaagcagagaucuggaguucugugggauacccccagcccgccugagguggaacgggcuguccuggacgauggcaucuaccgcauucuccaaagaggccugcuugggcggucccaggugggagucggcguguuccaggacgggguuuuucauacaauguggcacgugacgcgcggagccguccugauguaucagggcaaaagacucgagcccucuugggccagcgugaagaaagaccugaucuccuacgggggaggcuggcgguuccaaggcagcuggaauaccggggaggaaguucaggugauugcugucgagccuggaaagaaccccaaaaaugugcagacaaccccgggcaccuuuaagacaccugaaggggaggugggagccaucgcgcucgauuucaagcccggcacgucuggguccccuauuguuaacagagaaggaaaaaucgucggccuguacggcaaugggguggugaccacaagcggaaccuaugucucugcuauugcccaagccaaggcuucccaggagggcccccuucccgagaucgaagacgagguguuuaaaaagcgcaaccugacaaucauggaucugcacccugggagcggaaaaacccggagauaccucccggccauuguucgcgaagcgaucaagcggaagcugagaacgcuuauucuggcucccacacgcguggucgccuccgagauggccgaagcucucaaaggcaugccuauccgguaucagaccaccgccgugaagucugagcauacagggagagagauuguugaccugaugugccacgcuaccuucacaaugcgccugcucagccccgugcgggucccuaauuacaacaugaucaucauggaugaagcccauuuuaccgaccccgcguccauugccgcuagaggcuauaucagcacgcgggugggaaugggcgaggccgcugccauuuucaugacagccaccccuccggggucuguugaagcuuuuccccaguccaaugcggugauccaagaugaggaacgcgacauuccugagagaagcuggaacucuggauacgauuggaucacagacuuccccggcaaaaccgucugguuugugccuagcaucaaguccgggaaugauauugccaacugucuucggaaaaacggaaagcgcgugauccagcugucuagaaagacguucgacaccgaguaucagaaaacaaagaauaacgacugggauuacgucguuaccacagacauuagcgaaaugggcgcuaauuuccgggccgauagagugaucgacccccgccggugccugaaaccggugauucucaaggaugggccugagagagucauccuggccggccccaugcccgugaccguugcuuccgccgcgcagcgccggggaagaauuggccgcaaccaaaauaaagaaggggaccaguacguguauaugggacagccucuuaacaaugaugaggaccacgcucauuggacagaggccaagaugcugcucgauaacaucaauacccccgaaggcaucauuccugcccuguuugagccggaacgggagaagucugcugccaucgacggggaauacagacugcgcggagaggcgagaaaaacguucgucgagcucaugcggcgcggcgaucuucccguguggcugagcuauaagguugccuccgaaggguuucaguacagcgacagacgguggugcuucgauggcgagcgcaacaaucaagugcuggaagagaacauggacgucgaaauuuggacaaaagagggagagagaaagaaacuccggccuagauggcuggacgcucgcaccuauucugauccccuugcccugcgggaauuuaaggaguucgcugccggcagacgcuccgugagcggggaccucauccuggaaauuggaaaacugccucagcaccucaccucccgggcucagaaugcccuugauaaccuggucaugcugcacaauucugagcagggcgggaaggcguacagacaugccauggaagagcuccccgacacaaucgagacccugaugcuucuggcucucaucgccgugcugacaggaggcguuacgcuguuuuuccucagcggcaaggggcuuggaaaaaccuccauuggccugcugugugugacagcuucuagcgcccuccuguggauggccuccguggaaccgcacuggaucgcugcgagcauuauccuugaguuuuuccugaugguccuccugauuccugaacccgaucggcaacgcaccccucaggacaaccagcuggccuauguugugaucgggcuccuuuuuaugauccugacaguggcugccaacgagaugggacugcucgagaccacgaagaaagaucugggcauugggcaugucgccgcugaaaaucaccaacacgccaccaugcuugacguggaucugagacccgcgucugccuggacacucuacgcuguugccaccacagugaucaccccuaugaugcggcauacgauugagaacacaaccgcuaauaucucccugacagccauugcgaaccaggccgcuauccugaugggacucgacaagggcuggcccauuagcaaaauggauaucggcgucccgcuucuggcccuggggugcuacucucaggugaauccucucacccugaccgcugccguccuuaugcugguggcucacuaugccaucauuggacccggccuccaggcgaaggccacacgcgaagcucaaaagagaacggccgcugggaucaugaaaaaccccaccguugacggaauuguggccaucgaucuggacccugucguguacgacgccaaguucgagaaacagcugggccagauuaugcuccuuauccuguguacaucccagauccugcucaugcggaccacaugggcgcugugcgaaagcauuacccuugcuacggggccgcugacaacccucugggagggaucucccggcaaguuuuggaauaccacaaucgccguuagcauggcuaacauuuuccgcggcuccuaucuggccggggccggacuggcuuucucucucaugaaaagccuuggcgggggaagacggggcaccggggcccaaggagagacacugggcgaaaaguggaagcgccagcugaaucagcucuccaaaagcgaguuuaacacguacaagagauccggcaucauggaaguggaucggucugaggcgaaagaagggcugaagagaggagagaccacaaaacaugccgucagccgcggcaccgcuaagcuucggugguucguggagagaaaucuggugaagccugaagggaaaguuauugaccucggauguggccgcgggggaugguccuauuacugcgccggccugaagaaagucacagaggugaagggcuauaccaaagggggacccggccacgaagagccuauccccauggcuacguacggguggaaccuggccaagcuccauucuggaaaagauguguuuuucaugccuccggaaaagugugacacccuucugugcgauaucggcgagagcucccccaauccuacaauugaggaagggcggacccugagaguccucaagaugguugagcccuggcugcgcggaaaccaguuuuguaucaaaauucuuaauccuuacaugcccucugugguggaaacacuggagcaaaugcagcggaagcacggcggcaugcucgucagaaacccgcugagccgcaauuccacccacgagauguauugggugagcugcgggacaggaaacaucguuucugcggugaacaugaccucccggaugcugcucaauagauucacgauggcccaucgcaaaccuacauacgaacgggacgucgaucugggcgcugggaccagacacguggccguugagcccgaaguggcuaaccuugacauuaucggacagcgcauugagaauaucaagaacgaacauaaaagcaccuggcacuaugaugaggacaaucccuacaagacaugggccuaucacggcucuuacgaggucaaguccagcgggucugcuuccagcauggugaacggaguggucagacugcucacgaaaccuugggauguuauccccauggugacccaaauugccaugacagacaccacaccuuuuggccagcagcggguguucaaggaaaaagucgacacccgcacaccgagagcgaagcggggcaccacgcagaucauggaggugaccgccaaauggcuguggggguuucuuuccagaaauaagaagccccggauuuguacacgcgaagaguucaccagaaaaguucggagcaacgcugccaucggagcuguguuugucgaugaaaaucaauggaacucugccaaggaggccguggaggacgaacgcuucugggaucugguucauagagagcgggaacuccacaaacagggcaagugcgcgacaugcguguauaauaugauggggaaacgcgagaagaagcugggagaauuuggcaaagcuaaggggagcagagccauuugguacauguggcugggcgcccgguuccucgaguucgaggcucugggauuuaugaacgaagaccauugguucucccgcgagaauucucuuagcggcgucgaaggggagggacugcacaaacucggcuacauccugagagauaucuccaagauuccugggggaaacauguaugccgacgauaccgcuggcugggacacgcggaucacagaggaugaccuucagaaugaagccaaaauuaccgagaucauggaacccgagcaugcgcugcucgccacaucuauuuuuaagcugaccuaccagaacaaagugguucgcgugcaaagaccugcuaagaacgggacggucauggaugugaucagccggcgcgaccagagaggcuccggacaggucggcaccuaugggcugaauacauucaccaacauggaagugcagcucauccggcaaauggagucugagggaauuuuucugcccagcgaacuugagacaccgaaucuggccgaaagaguucucgauuggcuggagaagcacggcgcugaacgccuuaaacggauggccaucuccggggacgacuguguggucaagccuauugaugacagauucgcgaccgcccugacagcucucaacgauaugggaaaagugcgcaaggacaucccccagugggagccuagcaaaggcuggaaugauuggcagcaggugcccuuuugcucucaccauuuccaccaacugauuaugaaggacgggcgggagaucguugugccuuguagaaaccaggaugaacuggucggccgcgcccgggugucccagggagcuggcuggagccucagagagaccgccugccuggggaagucuuacgcucaaauguggcagcuuauguauuuucaucgccgggaccugagacucgccgcgaaugccaucuguuccgcuguucccguggauugggucccgacgagccgcacaaccugguccauucacgcccaccaucaguggaugaccacagaagacaugcugucuguguggaaccgggucuggaucgaggaaaauccuuggauggaggauaaaacccacgugagcuccugggaggaaguucccuaccuuggaaagagagaggaccaguggugcggcagccugauugggcucacagcccgggcuacgugggccaccaacauccaaguggcgauuaaucaggucagacgccugaucggaaacgaaaauuaucuggacuacaugacaucuaugaaacgguucaagaacgaguccgaucccgagggcgcucucugguga

SEQ ID NO: 18633 - RNA, 9879 nt, Artificial Sequence
  derived and/or modified CDS sequence (opt5) from DENV-1__GQ868534__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucuguguguguccaucaugauugaagaggucaugagaucucgcuggagccggaagaugcucaugacagggacccuggcuguguuccuucugcucguuaugggacaacugaccuggaaugaccugaucagacuuugcauuauggugggcgccaacgccuccgaucgcaugggcauggggacaacguaucuggcucucauggccaccuuuaaaaugagaccuauguucgcggucggacugcucuuucggcgccugacaucuagagaggugcuucugcucaccaucggccugagccugguggcuuccgucgaacuucccaacucucuggaggaacucggggacggacuggccaugggcauuaugaugcucaagcugcuuacagaguuccagccccaccagcuguggaccacgcuccugagccugacauuuaucaaaaccacccuuucccuggauuacgccuggaagacaaccgcuauggcccucagcaucguuucucuguucccucucugucuguccacaacgagccagaaaaccacauggcuuccggugcugcuggggucuuuuggaugcaagccccucaccauguuccugauuacagaaaauaagaucuggggccggaaauccuggccucuuaacgagggcauuauggcuaucgggauugugagcauccugcucucuucccugcucaagaaugacgucccccuggccggaccucuuaucgcgggcgggaugcugauugccuguuaugugaucagcggauccagcgcugaucugucucucgagaaagccgcugaaguuagcugggagcaagaagccgagcauuccggcaccucucacaacauucugguggaaguccaggacgaugggacgaugaagaucaaagacgaggagcgcgaugacacccuuacaauucugcucaaggccacccugcucgcugugagcggaguuuaccccauguccaucccugcgacacuguuugugugguauuucuggcagaaaaagaagcagagaucuggcguccuuugggauacccccagcccgccugaaguggagcgggccguccuggacgauggcaucuaccgcauucugcaaagagggcuccugggacggucccaggugggcguugggguguuccaggacggagucuuucauacaauguggcacgugacgcgcggcgcuguucuuauguaucaggggaaaagacuggaacccucuugggccagcgugaagaaagaccucaucuccuacggaggcggcuggcgguuccaagggagcuggaauaccggagaggagguccaggugauugccguggaaccuggcaagaaccccaaaaauguucagacaaccccggggaccuuuaagacaccugagggagaagucggcgcuaucgcccuggauuucaagcccgggacgucuggauccccuauugugaacagagagggcaaaaucgugggccucuacgggaauggagucgugaccacaagcggcaccuauguuucugcgauugcucaagccaaggccucccaggaagggccccugcccgagaucgaggacgaaguguuuaaaaagcgcaaccuuacaaucauggaucugcacccuggaagcggcaaaacccggagauaccugccggcuauuguccgcgaggccaucaagcggaagcucagaacgcugauucuugcgcccacacgcgugguugcuuccgaaauggccgaggcccugaaagggaugccuauccgguaucagaccaccgcugugaagucugaacauacaggcagagagauugucgaccucaugugccacgccaccuucacaaugcgccugcugagccccgugcggguuccuaauuacaacaugaucaucauggaugaggcucauuuuaccgaccccgccuccauugcggccagaggauauaucagcacgcgggugggcaugggggaagcugccgcuauuuucaugacagccaccccuccgggaucugucgaggccuuuccccaguccaaugcugugauccaagaugaagagcgcgacauuccugaaagaagcuggaacucuggcuacgauuggaucacagacuuccccgggaaaaccgugugguuugucccuagcaucaaguccggaaaugauauugcgaacugucuccggaaaaacggcaagcgcguuauccagcuuucuagaaagacguucgacaccgaguaucagaaaacaaagaauaacgacugggauuacguggugaccacagacauuagcgagaugggggccaauuuccgggcugauagagucaucgacccccgccggugccugaaaccggugauucugaaggauggcccugaaagaguuauccucgccggacccaugcccgugaccgucgccuccgcugcccagcgccggggcagaauugggcgcaaccaaaauaaagagggagaccaguacguguauaugggccagccucugaacaaugaugaagaccacgcgcauuggacagaggcuaagaugcuucuggauaacaucaauacccccgaggggaucauuccugcccucuuugaaccggagcgggaaaagaacgccgcuaucgacggagaguacagacugcgcggcgaagccagaaaaacguucguugagcugaugcggcgcggggaucuccccguguggcuuucuuauaaggucgcgagcgagggcuuucaguacuccgacagacgguggugcuucgauggagaacgcaauaaccaagugcuggaggaaaauauggacgucgagauuuggacaaaagaaggcgagagaaagaaacugcggccuagauggcucgacgcccgcaccuauagcgauccccuggcucuucgggaguuuaaggaauucgccgcugggagacgcucuguguccggagaccugauccucgagauuggcaaacugccucagcaccugacccuccgggcccagaacgcucuugauaaucugguuaugcugcacaacagcgaacaggggggaaaggccuacagacaugcgauggaggaacuccccgacacaaucgagacccugaugcuucuggcccucaucgcugugcugacaggcggcgugacgcuguuuuuccucuccgggaagggacuuggcaaaaccucuauugggcugcugugugucacagccagcuccgcucuccuguggauggccucuguugagccgcacuggaucgccgcuagcauuauccuugaauuuuuccugauggugcuccugauuccugagcccgaucggcaacgcaccccucaggacaaccagcuggcguauguggucaucggacuccuuuuuaugauccugacaguggccgcuaaugaaaugggccugcucgagaccacgaagaaagaucuggggauuggacauguugccgccgagaaccaccaacacgcuaccaugcuugacguggaucugagacccgccuccgcguggacacucuacgccgucgcuaccacagugaucaccccuaugaugcggcauacgauugaaaauacaaccgccaacaucagccugacagcuauugccaaucaggcggccauccugaugggccucgacaagggcuggcccauuucuaaaauggauaucggggucccgcuucuggcucugggaugcuacucccaggugaacccucucacccugaccgccgcuguucuuaugcugguggcccacuaugcuaucauuggccccgggcuccaggccaaggcgacacgcgaggcccaaaagagaacggcugccggaaucaugaaaaaucccaccgucgacggcauuguggcuaucgaucuggacccuguuguguacgacgccaaguucgaaaaacagcuggggcagauuaugcuccuuauccuguguacaagccagauccugcucaugcggaccacaugggcccugugcgagucuauuacccuugcgacgggaccgcugacaacccucugggaaggcucccccggcaaguuuuggaacaccacaaucgcugucagcauggccaauauuuuccgcgggucuuaucuggcuggagccggccuggccuucagccucaugaaaucccuugggggaggcagacgggggaccggagcucaaggcgagacacugggcgagaaguggaagcgccagcugaaccagcucucuaaaagcgaauuuaauacguacaagagauccgggaucauggagguggaucggagcgaagccaaagagggacugaagagaggcgaaaccacaaaacaugcggugucccgcgggaccgccaagcuucggugguucguugagagaaaccuggucaagccugagggaaaagugauugaccucggcugugggcgcggaggcuggucuuauuacugcgcuggccugaagaaagugacagaagucaagggguauaccaaaggaggccccgggcacgaggaaccuauccccauggccacguacggauggaaucugguuaagcuccauagcggcaaagauguguuuuucaucccuccggagaagugugacacccuucugugcgauauuggggaauccucucccaacccuacaaucgaggagggacggacccugagagugcucaagauggucgaacccuggcugcgcggcaaucaguuuuguauuaaaauccuuaacccuuacaugcccagcgugguugaggcucuggaacaaaugcagcggaagcacggcgggaugcucgugagaaauccgcugucccgcaacucuacacacgagauguauugggucagcugcggaaccggcaacauuguguccgccguuaauaugacaagccggaugcugcucaacagauucaccauggcgcaucgcaaaccuacguacgagcgggacguggaucugggggccggaacaagacacgucgcuguggaacccgagguggccaaucuugacaucauuggccagcgcaucgaaaacaucaagaaugagcauaaaucuaccuggcacuaugaugaagacaaccccuacaagaccugggcuuaucacggguccuacgaggucaagccuagcggaucugccuccagcaugguuaauggcguggugagacugcucacaaaacccugggaugucauuccuauggugacgcaaaucgcuaugaccgacacaaccccguuuggccagcagcggguuuucaaggagaaaguggacacacgcacccccagagccaagcgggggacaacccagauuauggaagucacggcgaaauggcuguggggauuucuuucuagaaacaagaagccucggaucuguacccgcgaggaauucacaagaaaagugcgguccaaugccgcuauuggcgccguuuuuguggaugagaaccaauggaauagcgcuaaggaagccgucgaggacgagcgcuucugggaucuggugcauagagaacgggagcuccacaaacaggggaagugcgccaccugcguuuauaacaugaugggaaaacgcgaaaagaagcugggcgaguuugggaaagcgaagggcuccagagcuaucugguacauguggcugggagcccgguuccucgaauucgaggcccugggcuuuaugaaugaggaccauugguucagccgcgaaaacucucuuagcgggguggagggagaaggccugcacaaacucggguacauccugagagauauuuccaagauccccggaggcaauauguaugcugacgauacagccgggugggacacccggauuacggaggaugaccuucagaacgaggcuaaaaucacagaaauuauggagccugaacaugcccugcucgcgaccucuaucuuuaagcugacauaccagaacaaagucgugcgcguccaaagacccgccaagaauggcaccgugauggauguuaucagccggcgcgaccagagaggauccggccagguggggacguauggacugaacaccuucacaaauauggagguccagcucauucggcaaauggaaucugagggcaucuuucugccgagcgagcuugaaaccccuaaccuggcugagagagcccucgauuggcuggaaaagcacggggcugagcgccuuaaacggauggccauuuccggagacgacuguguggugaagcccaucgaugacagauucgcgacagcccugaccgcucucaaugauaugggcaaaguucgcaaggacauuccucagugggaacccucuaaaggguggaacgauuggcagcaggugccuuuuugcagccaccauuuccaccaacugaucaugaaggacggccgggagaucgucgugcccuguagaaaucaggaugagcugguuggacgcgcccgggugucccagggcgcuggguggagccucagagaaacagccugccugggaaagucuuacgcucaaauguggcagcuuauguauuuucaucgccgggaccugagacucgccgcgaacgccauuuguuccgcugucccgguggauugggucccuaccagccgcacgacauggucuauccacgcccaccaucaguggaugaccaccgaggacaugcuguccguguggaaucggguuuggauugaagagaaccccuggauggaagauaaaacacacgugagcuccugggaggagguccccuaccuuggcaagagagaagaccaguggugcgggucucugaucggacucaccgcccgggcuacaugggccacgaauauucaaguggcgaucaaccagguuagacgccugauuggcaaugagaacuaucuggacuacaugaccagcaugaaacgguucaagaaugaauccgauccugagggggcucucugguga

SEQ ID NO: 18634 - RNA, 9879 nt, Artificial Sequence
  derived and/or modified CDS sequence (opt5) from DENV-1__GQ868535__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucgccaacccugcgauucuucggaaacugugcaucgaagccaagauuucuaauacaaccacggacucccgcuguccgacacagggagaggcuacccucguugaagagcaggaugccaacuucgugugcagacggaccuuuguggaccgcggcuggggcaauggguguggacuguucggcaaagggagccuucugacaugcgcuaaguuuaagugcgucaccaaacucgagggaaagaucgugcaguacgaaaaccugaaauauucuguuaucgugacaguccacacgggcgaucaacaucagguggggaaugagaccacagaacacggaaccauugccacaaucaccccccaggccccuacguccgagauucagcugaccgacuacggcgcucucacacuggacuguagccccagaaccggccuugauuucaacgaaaugguucugcucacaaugaaggagaaaucuuggcuggugcauaagcaaugguuucuugaccugccucuccccuggaccuccggggcgagcacgucccaggagacauggaaucggcaggaucugcuggucaccuucaaaacagcccacgcuaagaagcaagaaguggucgugcucggaucucaggagggcgccaugcacaccgcccugaccggggcuacagaaauccagacgagcggaaccacaaccauuuuugccggccaucuuaaaugccgccugaagauggacaaacucacacugaaggggaccuccuauguuauguguacgggcagcuucaaacuggagaaggaaguggcggagacacagcacggaaccguccuugugcaaguuaaguacgagggcaccgaugcuccgugcaaaaucccuuucucuacacaggacgaaaagggggugacccagaacggaagacucaucacagccaaucccauugucacggauaaagagaagccugugaacaucgaaaccgagccccccuuuggcgaguccuauauugugguuggggccggagaaaaagcucugaagcugagcugguucaagaaaggcucuagcaucgggaagauguuugaggccacagcucggggcgccagacgcauggcgauucucggagacaccgccugggauuucggcuccaucgggggagucuuuacaucugugggcaaacuggugcaucaggucuucgggaccgcuuacggagugcuuuuuagcggcguuuccuggacgaugaagaucgggauuggcauccugcucaccuggcugggacugaauagccggucuacaucccuuagcaugaccuguauugccgugggcauggucacacucuaccugggggugaugguucaagcugacucuggaugcgugaucaacuggaaaggcagagaacugaaguguggguccggaauuuucgucaccaacgaggugcacacauggaccgaacaguauaaguuucaggccgauagcccuaaacgccucuccgcggccaucggcaaggcuugggaggaggggguuugcggcauucggucugccacgagacuggaaaauaucauguggaaacagaucagcaacgagcuuaaucauauucugcucgaaaacgacaugaaguucacaguggucgugggagacgcuaauggcauccuggcccaagggaaaaagaugauucgcccgcagcccauggagcacaaauacuccuggaagucuuggggaaaggccaaaaucauuggcgcugauauccagaacaccaccuuuaucauugacgggccugauacacccgaauguccugacaaucagcgggcguggaacaucugggagguggaggauuauggauucggcauuuuuaccacgaauaucuggcugaagcuuagagacagcuacacacaaaugugcgaucaccgccucauguccgccgcuauuaaagacagcaaggccguccaugccgauaugggcuauuggaucgaaucugagaaaaacgaaaccuggaagcuggcucgggccuccuucaucgagguuaagacauguaccuggcccaaaagccacacacuguggucuaauggggugcucgaauccgagaugauuaucccgaagauuuacggaggcccuaucagccagcauaacuauagacccggguacuucacccagacggcgggaccuuggcaccugggcaaacuugagcuggacuuugaucucugcgaagggaccacaguggucguggacgagcacugcggaaaucgcggccccucucugcggaccacaaccguuacgggcaagauuauccaugaaugguguugcagaagcuguacacugccuccccuucgguuccgcggggaggauggaugcugguacggcauggagaucagaccggugaaagaaaaggaggaaaaccucguccgguccauggugagcgcugggucuggagagguugacuccuuuagccugggcauucugugugccuccaucaugauugaagaggugaugagaucucgcuggagccggaagaugcucaugaccgggacacuggccgucuuccuucugcucaucaugggacaacugaccuggaaugaccugauuagacuuugcaucauggugggcgcuaacgccuccgaucgcaugggcauggggaccacauaucuggcgcucauggcuacguuuaaaaugagaccuauguucgccguuggacugcucuuucggcgccugaccucuagagaggugcuucugcucacaauuggccugagccuggucgccuccguggaacuucccaacucucuggaggaacucggggacggacuggcuaugggcaucaugaugcucaagcugcuuaccgaguuccagccccaccagcuguggacaacccuccugagccugacguuuaucaaaacaacccuuucccuggauuacgccuggaagaccacagcuauggcccucagcauugugucucuguucccucucugucuguccaccacaagccagaaaacgaccuggcuuccgguccugcuggggucuuuuggaugcaagccccucacaauguuccugaucaccgaaaauaagauuuggggccggaaauccuggccucuuaacgagggcaucauggcgauugggaucguuagcauccugcucucuucccugcucaagaaugacgugccccuggccggaccucuuauugcuggcgggaugcugaucgccuguuaugugauuagcggauccagcgcugaucugucucucgagaaagccgccgaagucagcugggagcaagaagcugagcauuccggcacaucucacaacauccugguggaaguucaggacgaugggaccaugaagauuaaagacgaggagcgcgaugacacgcuuaccauccugcucaaggcgacacugcucgccgugagcggagucuaccccauguccaucccugcuacccuguuugugugguauuucuggcagaaaaagaagcagagaucuggcguucuuugggauacacccagcccgccugaaguggagcgggccguccuggacgauggcauuuaccgcauccugcaaagagggcuccugggacggucccaggugggcgucgggguguuccaggacggaguuuuucauaccauguggcacgugacacgcggcgccguccuuauguaucaggggaaaagacuggaacccucuugggcuagcgugaagaaagaccucauuuccuacggaggcggcuggcgguuccaagggagcuggaauaugggagaggagguucaggugaucgccgucgaaccuggcaagaaccccaaaaaugugcagacgaccccggggacauuuaagaccccugagggagaagugggcgcgauugcucuggauuucaagcccgggaccucuggauccccuaucguuaacagagagggcaaaauugucggccucuacgggaauggaguggugacaacgagcggcaccuaugucucugccaucgcccaagcuaaggccucccaggaagggccccugcccgagaucgaggacgaaguguuuaaaaagcgcaaccuuacaauuauggaucugcacccuggaagcggcaaaacccggagauaccugccggcgaucguucgcgaggcuauuaagcggaagcucagaacacugauccuugcccccacccgcguggucgccuccgaaauggcugaggcccugaaagggaugccuauucgguaucagacgacagcugugaagucugaacauaccggcagagagaucguugaccucaugugccacgccaccuucacaaugcgccugcugagccccgugcgggucccuaauuacaacaugaucauuauggaugaggcgcauuuuaccgaccccgccuccaucgcugccagaggauauauuagcacacgggugggcaugggggaagcugccgccaucuucaugaccgcuacgccuccgggaucuguugaggcguuuccccaguccaaugccgugauucaagaugaagagcgcgacaucccugaaagaagcuggaacucuggcuacgauuggaucacagacuuccccgggaaaaccgucugguuugugccuagcauuaaguccggaaaugauaucgcuaacugucuccggaaaaacggcaagcgcgugauucagcuuucuagaaagacauucgacaccgaguaucagaaaacgaagaauaacgacugggauuacgucguuaccacagacaucagcgagaugggggccaauuuccgggccgauagagugauugacccccgccggugccugaaaccggugauccugaaggauggcccugaaagagucauucucgcuggacccaugcccgugaccguugccuccgcggcucagcgccggggcagaaucgggcgcaaccaaaauaaagagggagaccaguacguguauaugggccagccucugaacaaugaugaagaccacgcccauuggacagaggccaagaugcuucuggauaacaucaauacccccgaggggauuaucccugcucucuuugaaccggagcgggaaaagucugccgcgauugacggagaguacagacugcgcggcgaagccagaaaaacauucgucgagcugaugcggcgcggggaucuccccguguggcuuagcuauaagguugcuuccgagggcuuucaguacagcgacagacgguggugcuucgauggagaacgcaacaaucaagugcuggaggaaaacauggacgucgagaucuggaccaaagaaggcgagagaaagaaacugcggccuagauggcucgacgcccgcacguauucugauccccuggcucuucgggaguuuaaggaauucgccgcugggagacgcuccgugagcggagaccugauucucgagaucggcaaacugccucagcaccugacacuccgggcccagaaugcgcuugauaaccuggucaugcugcacaauuccgaacaggggggaaaggccuacagacaugcuauggaggaacuccccgacaccaucgagacccugaugcuucuggcccucauugcugugcugacaggcggcguuacccuguuuuuccucucugggaagggacuuggcaaaacaagcaucgggcugcugugugugacggccuccucugcccuccuguggauggcuagcguggagccgcacuggauugcggccuccaucauucuugaauuuuuccugaugguccuccugaucccugagcccgaucggcaacgcaccccucaggacaaccagcuggcuuauguugugaucggacuccuuuuuaugauucugacaguggccgccaacgaaaugggccugcucgagaccacaaagaaagaucuggggaucggacaugucgcugccgagaaucaccaacacgcgaccaugcuugacguggaucugagacccgccagcgcuuggacgcucuacgccguugcuaccacagugauuaccccuaugaugcggcauacaaucgaaaacaccacggccaauauuucucugacagcgaucgccaaccaggcugccauucugaugggccucgacaagggcuggcccaucuccaaaauggauaucggggucccgcuucuggcucugggaugcuacagccaggugaauccucucacccugacagccgcuguccuuaugcugguggcccacuaugcgauuaucggccccgggcuccaggccaaggcuacccgcgaggcccaaaagagaaccgcugccggaauuaugaaaaaccccacaguugacggcaucguggccauugaucuggacccugucguguacgacgcgaaguucgaaaaacagcuggggcagaucaugcuccuuauccuguguacgucucagauucugcucaugcggaccacaugggcucugugcgaguccaucacccuugccacaggaccgcugaccacgcucugggaaggcagccccggcaaguuuuggaauacaaccauugcuguuucuauggccaacaucuuccgcgggagcuaucuggccggagcuggccuggccuucucccucaugaaaucucuugggggaggcagacgggggaccggagcgcaaggcgagacacugggcgagaaguggaagcgccagcugaaucagcucagcaaauccgaauuuaacaccuacaagagaagcgggauuauggagguggaucgguccgaagccaaagagggacugaagagaggcgaaacaacgaaacaugcugucucucgcgggaccgccaagcuucggugguucguggagagaaaucuggugaagccugagggaaaaguuaucgaccucggcugugggcgcggaggcuggagcuauuacugcgcuggccugaagaaagucacagaagugaagggguauaccaaaggaggccccgggcacgaggaaccuauccccauggccacauacggauggaaccuggugaagcuccauuccggcaaagaugucuuuuucaugccuccggagaagugugacacccuucugugcgauauuggggaaucuagccccaauccuacgaucgaggagggacggacccugagaguucucaagaugguggaacccuggcugcgcggcaaccaguuuuguauuaaaauccuuaauccuuacaugcccuccguggucgagacacuggaacaaaugcagcggaagcacggcgggaugcucgugagaaacccgcugucucgcaauagcacccacgagauguauuggguuuccugcggaacaggcaacauugugagcgcggucaacaugaccucucggaugcugcucaauagauucacaauggcccaucgcaaaccuaccuuugagcgggacguggaucugggggcuggaacgagacacguugccguggaacccgaggucgcuaaccuugacaucauuggccagcgcaucgaaaauaucaagaacgagcauaaauccacauggcacuacgaugaagacaaucccuauaagaccugggccuaccacgggagcuaugaggugaagccuucuggauccgcuagcucuauggugaacggcgucguuagacugcucaccaaacccugggaugugauuccuauggugacacaaaucgccaugacggacaccacaccguucggccagcagcgggucuuuaaggagaaaguggacacccgcacacccagagcgaagcgggggaccacacagauuauggaaguuaccgccaaauggcuguggggauuccuuuccagaaauaagaagccucggaucuguacgcgcgaggaauuuaccagaaaagugcggagcaacgcugccauuggcgcugucuucguggaugagaaucaauggaacuccgccaaggaagccguugaggacgagcgcuuuugggaucuggugcauagagaacgggagcuccacaaacaggggaagugcgcgacaugcgucuacaauaugaugggaaaacgcgaaaagaagcugggcgaguucgggaaagcuaagggcagcagagccaucugguauauguggcugggagcccgguuccucgaauuugaggcucugggcuucaugaacgaggaccauugguuuucucgcgaaaauagccuuuccgggguggagggagaaggccugcacaaacucggguacauccugagagauauuucuaagauccccggaggcaacauguacgccgacgauaccgcugggugggacacacggauuaccgaggaugaccuucagaaugaggccaaaaucacggauauuauggaaccugagcaugcgcugcucgccacaagcaucuucaagcugaccuaucagaacaaaguugugcgcguccaaagacccgcuaagaacggcacagugauggacgucaucucccggcgcgaucagagaggaucuggccagguggggaccuacggacugaauacguuuaccaacauggaaguucagcucauucggcaaauggagagcgaaggcaucuuccugccguccgagcuugagacaccuaaucuggccgaaagagugcucgacuggcuggagaagcacggggcugaacgccuuaaacggauggccauuucuggagacgauugugucgugaagcccaucgacgauagauuugcgaccgcccugacagcucucaacgacaugggcaaagugcgcaaggauauuccucagugggagcccagcaaaggguggaaugacuggcagcagguuccuuucugcucccaccauuuucaccaacugaucaugaaggauggccgggaaaucgugguccccuguagaaaccaggacgagcuggugggacgcgcccggguuagccagggcgcuggguggucucucagagagaccgccugccugggaaaguccuaugcucaaauguggcagcuuauguacuuccaucgccgggaucugagacucgccgcgaaugccauuuguagcgcugugccggucgacugggugccuacaucucgcaccacgugguccauccacgcccaccaucaguggaugacaaccgaagauaugcugagcgucuggaaccggguguggauugaggaaaaucccuggauggaggacaaaacccacguuuccucuugggaagaggugcccuaucuuggcaagagagaggaccaguggugcgggagccugaucggacucacagcccgggcuaccugggccacaaacauucaagucgcgaucaaucaggugagacgccugauuggcaacgaaaauuaccuggauuauaugacguccaugaaacgguuuaagaacgagagcgacccugaaggggcucucugguga

SEQ ID NO: 18635 - RNA, 9879 nt, Artificial Sequence
  derived and/or modified CDS sequence (opt5) from DENV-1__KJ189306__SS-prME
agcgugaccaugcugcucaugcugcuucccacagcucuggcuuuccaccucacgaccagaggcggggaaccucauaugaucgucuccaagcaggaacggggaaaaucucugcuuuuuaagacaagcgccggcguuaauaugugcacccugauugcgauggaccucggggaacugugugaagauacaaugaccuacaaaugcccgcagaucacagaagcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagaacaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcccguucaaacuggagaaggaaguggccgagacccagcacggaaccguccuugugcaaguuaaguacgagggcacagaugcgccuugcaaaauccccuuccucacccaggacgaaaagggggugacacagaacggaagacugaucacggcuaauccuauugucaccgauaaagagaagcccgugaacaucgaaacagagcccccuuuuggcgagagcuauauugugguuggggccggagaaaaagcccugaagcucucuugguucaagaaaggcuccagcaucgggaagauguuugaggcuaccgcccggggcgcuagacgcauggccauucugggagacacagcgugggauuucggcucuaucgggggagucuuuaccagcgugggcaaacuugugcaucaggucuucgggacggccuacggagugcuguuuuccggcguuucuuggaccaugaagaucgggauuggcauccuccugacauggcugggacuuaauagccgguccaccagccucucuaugacauguauugcugugggcauggucacccuguaccugggggugaugguucaagccgacuccggaugcgugaucaacuggaaaggcagagaacucaagugugggagcggaauuuucgucacaaacgaggugcacaccuggacggaacaguauaaguuucaggcugauucuccgaaacgccuguccgccgcgaucggcaaggccugggaggaggggguuugcggcauucggagcgcuacaagacuugaaaauaucauguggaaacagaucuccaacgagcugaaucauauucuccuggaaaacgacaugaaguucaccguggucgugggagacgccaauggcauccuggcucaagggaaaaagaugauucgcccccagccuauggagcacaaauacucuuggaaaagcuggggaaaggccaagaucauuggcgccgauauccagaacaccacauuuaucauugacgggcccgauaccccugaaugucccgacaaucagcgggcuuggaacaucugggagguggaggauuauggauucggcauuuuuacgacaaauaucuggcuuaagcucagagacuccuacacccaaaugugcgaucaccgccugaugucugcggccauuaaagacagcaaggcuguccaugccgauaugggcuauuggaucgaauccgagaaaaacgaaacauggaagcuggcccgggcuagcuucaucgagguuaagaccuguacauggccgaaaucucacacccucugguccaauggggugcuggaaagcgagaugauuaucccuaagauuuacggaggccccaucucucagcauaacuauagaccuggguacuucacgcagaccgccggacccuggcaccuuggcaaacuggagcucgacuuugaucugugcgaagggacaaccguggucguggacgagcacugcggaaaucgcggcccuucccugcggacaaccacgguuacaggcaagauuauccaugaaugguguugcagaagcuguacccuucccccgcuccgguuccgcggggaggauggaugcugguacggcauggagaucagaccugugaaagaaaaggaggaaaaccugguccggucuauggugagcgcgggguccggagagguugacagcuuuucucugggcauucucuguguguccaucaugauugaagaggucaugagaagccgcuggucccggaagaugcugaugacagggacccuugcuguguuccugcuccugguuaugggacaacugaccuggaaugaccuuaucagacugugcauuauggugggcgccaacgccucugaucgcaugggcauggggacaacguaucucgcucugauggccaccuuuaaaaugagacccauguucgcggucggacuccuguuucggcgccuuacaagcagagaggugcugcuccugaccaucggccugucccuuguggcuucugucgaacugcccaacagccucgaggaacugggggacggacucgccaugggcauuaugaugcugaaacuucugacagaguuccagccucaccagcucuggaccacgcugcugucccuuacauuuaucaaaaccacccugucucucgauuacgccuggaagacaaccgcuauggcccugagcaucguuucccucuucccgcugugucuuagcacaacgucucagaaaaccacauggcugcccgugcugcucggguccuuuggaugcaagccucugaccauguuccuuauuacagaaaauaagaucuggggccggaaaagcuggccccugaacgagggcauuauggcuaucgggauugugucuauccuccuguccagccuccugaagaaugacgucccucuugccggaccccugaucgcgggcgggaugcugauugccuguuaugugaucucuggauccagcgcugaucucucccuggagcgcgccgcugaaguuagcugggagcaagaagccgagcauucuggcaccagccacaacauucuuguggaaguccaggacgaugggacgaugaaaaucaaggacgaggagagagaugacacccugacaauucuccugaaagccacccuccuggcuguguccggaguuuacccuaugucuauccccgcgacacuuuuugugugguauuucuggcagaagaaaaagcagcggagcggcguccugugggauaccccguccccucccgaaguggagcgcgccguccuggacgauggcaucuaccggauucugcaaagagggcugcuuggacgcucucaggugggcguugggguguuccaggacggagucuuucauacaauguggcacgugacgagaggcgcuguucugauguaucaggggaagcggcucgaaccuagcugggccuccgugaaaaaggaccugaucucuuacggaggcggcuggagauuccaagggagcuggaauaccggagaggagguccaggugauugccguggaacccggcaaaaacccgaagaauguucagacaaccccugggaccuuuaaaacacccgagggagaagucggcgcuaucgcccucgauuucaagccugggacguccggaagccccauugugaaccgcgagggcaagaucgugggccuguacgggaauggagucgugaccacaucuggcaccuauguuuccgcgauugcucaagccaaagccagccaggaagggccccuuccugagaucgaggacgaaguguuuaagaaacggaaccugacaaucauggaucugcacccgggaucuggcaagaccagacgcuaccuccccgcuauuguccgggaggccaucaaaagaaagcugcgcacgcuuauucuggcgccuacacgggugguugcuuccgaaauggccgaggcccucaaggggaugcccaucagauaucagaccaccgcugugaaaagcgaacauacaggccgcgagauugucgaccugaugugccacgccaccuucacaaugcggcugcucuccccugugagaguucccaauuacaacaugaucaucauggaugaggcucauuuuaccgacccugccucuauugcggcccggggauauaucagcacgcgcgugggcaugggggaagcugccgcuauuuucaugacagccaccccgcccggauccgucgaggccuuuccucagagcaaugcugugauccaagaugaagagagagacauucccgaacggucuuggaacuccggcuacgauuggaucacagacuucccugggaagaccgugugguuuguccccagcaucaaaucuggaaaugauauugcgaacugucuucgcaagaacggcaaaagaguuauccagcugagccggaagacguucgacaccgaguaucagaagaccaagaauaacgacugggauuacguggugaccacagacauuuccgagaugggggccaauuucagagcugaucgcgucaucgacccgcggagaugccugaagccugugauucucaaagauggccccgaacgcguuauccuggccggacccaugccugugaccgucgccucugcugcccagcggagaggccgcauugggcggaaccaaaauaaggagggagaccaguacguguauaugggccagccccuuaacaaugaugaagaccacgcgcauuggacagaggcuaaaaugcugcucgauaacaucaauaccccugaggggaucauuccggcccuguuugaacccgagagagaaaagagcgccgcuaucgacggagaguaccgccugagaggcgaagcccggaagacguucguugagcucaugcgcagaggggaucuuccuguguggcuguccuauaaagucgcgucugagggcuuucaguacagcgaccggcgcuggugcuucgauggagaaagaaacaaucaagugcuggaggaaaacauggacgucgagauuuggacaaaggaaggcgagcggaaaaagcucagaccccgcuggcuggacgcccggaccuauuccgauccucuugcucugagagaguuuaaagaguucgccgcugggcgccggagcgugucuggagaccucauccuggagauuggcaagcugccccagcaccucacccuuagagcccagaaugcucuggauaaccugguuaugcuccacaauuccgaacaagggggaaaagccuaccggcaugcgauggaggaacugccggacacaaucgagacccuuaugcugcucgcccugaucgcugugcugacaggcggcgugacgcucuuuuuccuuagcgggaagggacugggcaagaccuccauugggcugcucugugucacagccucuagcgcucugcuuuggauggccuccguugagccucacuggaucgccgcuucuauuauccuggaauuuuuccucauggugcugcugauucccgagccugaucgccaaagaacaccccaggacaaccagcucgcguauguggucaucggacuucuguuuaugauccugacaguggccgcuaacgaaaugggccuccuggagaccacgaaaaaggaucuugggauuggacauguugccgccgagaaucaccaacacgcuaccaugcuggacguggaucuccggccugccagcgcguggacacuguacgccgucgcuaccacagugaucacccccaugaugcgccauacgauugaaaacacaaccgccaauaucucccugacagcuauugccaaccaggcggccauccucaugggccuugacaaaggcuggccgauuagcaagauggauaucggggucccucugcuggcucucggaugcuacucucaggugaauccccugacccuuaccgccgcuguucugaugcucguggcccacuaugcuaucauuggccccgggcugcaggccaaagcgacaagagaggcccaaaagcggacggcugccggaaucaugaagaacccuaccgucgacggcauuguggcuaucgaucuggacccgguuguguacgacgccaaauucgaaaagcagcucgggcagauuaugcuucugauccuguguacaucccagauccuccugaugcgcaccacaugggcccuuugcgagagcauuacccuggcgacgggaccccucacaacccugugggaaggcucuccuggcaaauuuuggaauaccacaaucgcugucuccauggccaacauuuucagagggagcuaucuggcuggagccggccucgccuucucucuuaugaaaagccucgggggaggccggcgcgggaccggagcucaaggcgagacacugggcgagaaauggaagagacagcucaaucagcuguccaagucugaauuucauaucuacaaacggagcgggauuauggagguggauagauccgaagccaaggagggacuuaaacgcggcgaaacgaccaagcacgcggugagccgggggacagccaaacugagaugguucguugagcgcaaccucgucaagcccgagggaaaggugaucgaccugggcugugggcggggaggcugguccuauuacugcgcuggccugaaaaaggugaccgaagucaaaggguauacaaagggaggcccugggcaugaggaacccaucccuauggccaccuacggauggaaucucguuaaacuucacucuggcaaggauguguuuuucaugccgcccgagaaaugugacacgcugcugugcgauauuggggaaagcuccccuaaccccaccaucgaggagggaagaacacuccgcgugcugaagauggucgaaccuuggcuucggggcaaucaguuuuguauuaagauccugaaccccuacaugccgucugugguugagacccucgaacaaaugcagagaaaacacggcgggaugcuggugcgcaauccucugagccggaacuccacacaugagauguauugggucucuugcggaaccggcaauauugugagcgcuguuaacaugacauccagaaugcuccugaaccgcuucaccauggcccaccggaagcccacguacgagagagacguggaucuuggggcgggaacacgccaugucgccguggaacccgagguggcuaaucuggacaucauuggccagagaaucgaaaacaucaaaaaugagcacaagagcaccuggcacuaugaugaagacaacccuuacaaaaccugggccuaucaugggucuuacgaggucaagcccuccggaagcgcuucuuccaugguuaauggcguggugcggcuccugacaaagccuugggaugucauuccgauggugacgcaaaucgccaugaccgacacaacccccuuuggccagcagcgcguuuucaaagagaagguggacacaagaaccccucgggcuaaaagagggacaacccagauuauggaagucacggccaaguggcuuuggggauuucugagccggaacaaaaagccccgcaucuguaccagagaggaguucauucggaaggugcgcucuaaugcggccaucggcgcuguuuuuguggaugagaaccaauggaacuccgccaaagaagcugucgaggacgagagauucugggaucucgugcaccgggaacgcgagcugcauaagcaggggaaaugcgccacaugcguuuauaacaugaugggaaagagagagaagaagcugggcgaguuugggaaggccaaaggcagccgggcgaucugguacauguggcucggagcucgcuuccuggaguucgaggcccuuggcuuuaugaaugaggaccacugguucuccagagaaaacagccugucugggguggagggagaaggccuccauaagcugggguacauucuucgggauaucagcaaaauuccuggaggcaauauguaugccgacgauaccgcugggugggacacacgcaucaccgaggaugaccugcagaacgaggccaagauuacggaaaucauggagcccgaacacgcucuccuggccacauccaucuuuaaacugaccuaccagaauaaggucgugagaguccaacggccggcgaaaaacggcacagugauggauguuauuucucgcagagaccagcggggaagcggccagguggggaccuauggacucaacacguucaccaauauggagguccagcugaucagacaaauggaauccgagggcauuuuucuuccuucugagcuggaaacacccaaccucgccgagcgcgugcuggauuggcuugaaaagcacggggcugagcggcugaagagaauggccaucagcggagacgacugugugguuaaaccuauugaugaccgcuucgcuaccgcccucacagcgcugaaugauaugggcaaggugcggaaagacaucccccagugggaaccuuccaagggguggaacgauuggcagcagguccccuuuugcucucaucacuuccaucaacugaucaugaaagacggcagagagauugugguuccgugucgcaaucaggaugagcucgugggacgggccagagucagccagggcgcuggguggucccugcgcgaaaccgccugccuuggaaagagcuacgcucaaauguggcagcugauguauuuucaccggagagaccuccgccuggccgcuaacgccaucuguucugcggugccugucgauugggugcccacaucccggaccacguggagcauucacgcccaucaccaguggaugacaaccgaggacaugcuuucuguuuggaauagaguguggaucgaagagaaccccuggauggaagauaagacccaugucuccagcugggaggaggugccuuaccugggcaaacgggaagaccaguggugcgggucccucauuggacugacagcuagagccaccugggccacaaauauccaaguugcuauuaaccaggugcgccggcugaucggcaaugagaacuaucucgacuacaugacgucuaugaagagauucaaaaaugaaagcgauccggagggggcccugugguga

SEQ ID NO: 18636 - RNA, 9879 nt, Artificial Sequence
  derived and/or modified CDS sequence (opt5) from DENV-1__KJ189307__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgccuuuuuccuggcgcaugccauugggacaucuaucacccaaaagggaaucauuuuuauccuccugaugcuugucaccccuagcauggcuaugcgcugcgugggcauugggaacagagauuucguugagggacuguccggcgccacauggguggacgucgugcucgagcacgggagcugugugacgaccauggcuaagaauaaacccacacuggauaucgaacugcucaagaccgaggucacaaacccugccauucugcggaaacuuugcaucgaagcgaagauuucuaauaccacgacagacucccgcuguccgacccagggagaggccacccugguugaagagcaggaugcuaacuuugugugcagacggacauucguggaccgcggcuggggcaauggguguggacucuuuggcaaagggagccugcuuaccugcgccaaguucaagugcgucacaaaacuggagggaaagaucgugcaguacgaaaaccucaaauauucuguuaucgugacgguccacaccggcgaucaacaucagguggggaaugagacaaccgaacacggaacaauugcuaccaucacgccccaggccccuaccuccgagauucagcugacagacuacggcgcccugacccucgacuguagccccagaacaggccuggauuuuaacgaaaugguucuucugaccaugaaggagaaaucuuggcucgugcauaagcaaugguuccuggaccuuccucugcccuggacguccggggcuagcacaucccaggagaccuggaaucggcaggaucuccuggucacauuuaaaaccgcgcacgccaagaagcaagaaguggucgugcugggaucucaggagggcgcuaugcacaccgcccucacaggggccacggaaauccagaccagcggaacaaccacaauuuucgcuggccaucugaaaugccgccuuaagauggacaaacugacccucaaggggacguccuauguuauguguacaggcagcuucaaacuggagaaggaaguggccgagacccagcacggaaccguccuggugcaaguuaaguacgagggcacagaugcgccgugcaaaaucccuuuuucuacccaggacgaaaagggggugacacagaacggaagacuuaucacggcuaaucccauugucaccgauaaagagaagccugugaacaucgaaacagagccccccuucggcgaguccuauauugugguuggggccggagaaaaagcccucaagcugagcugguuuaagaaaggcucuagcaucgggaagauguucgaggcuaccgcccggggcgcuagacgcauggccauucugggagacacagcgugggauuuuggcuccaucgggggagucuucaccucugugggcaaacucgugcaucaggucuuugggacggccuacggagugcuguucagcggcguuuccuggaccaugaagaucgggauuggcauccuucugacauggcucggacugaauagccggucuaccucccugagcaugacauguauugcugugggcauggucacccuuuaccucggggugaugguucaagccgacucuggaugcgugaucaacuggaaaggcagagaacugaaguguggguccggaauuuuugucacaaacgaggugcacaccuggacggaacaguauaaguuccaggcugauagcccuaaacgccuguccgccgcgaucggcaaggccugggaggaggggguuugcggcauucggucugcuacaagacucgaaaauaucauguggaaacagaucagcaacgagcugaaucauauucuucuggaaaacgacaugaaguuuaccguggucgugggagacgccaauggcauccucgcucaagggaaaaagaugauucgcccgcagcccauggagcacaaauacuccuggaagucuuggggaaaggccaaaaucauuggcgccgauauccagaacaccacauucaucauugacgggccugauacccccgaauguccugacaaucagcgggcuuggaacaucugggagguggaggauuauggauuuggcauuuucacgacaaauaucuggcugaagcugagagacagcuacacccaaaugugcgaucaccgccuuauguccgcggccauuaaagacagcaaggcuguccaugccgauaugggcuauuggaucgaaucugagaaaaacgaaacauggaagcucgcccgggcuuccuucaucgagguuaagaccuguacauggcccaaaagccacacccuguggucuaauggggugcuggaauccgagaugauuaucccgaagauuuacggaggcccuaucagccagcauaacuauagacccggguacuuuacgcagaccgccggaccuuggcaccucggcaaacuggagcuugacuucgaucugugcgaagggacaaccguggucguggacgagcacugcggaaaucgcggccccucucuccggacaaccacgguuacaggcaagauuauccaugaaugguguugcagaagcuguacccugccuccccugcgguuucgcggggaggauggaugcugguacggcauggagaucagaccggugaaagaaaaggaggaaaaccuuguccgguccauggugagcgcggggucuggagagguugacuccuucagccucggcauucuguguguguccaucaugauugaagaggucaugagaucucgcuggagccggaagaugcugaugacagggacccucgcuguguuucugcuucugguuaugggacaacucaccuggaaugaccugaucagacugugcauuauggugggcgccaacgccuccgaucgcaugggcauggggacaacguaucuugcucugauggccaccuucaaaaugagaccuauguuugcggucggacuccuguuccggcgccucacaucuagagaggugcugcuucugaccaucggccucagccugguggcuuccgucgaacugcccaacucucuugaggaacugggggacggacucgccaugggcauuaugaugcugaagcuccugacagaguuucagccccaccagcuuuggaccacgcugcucagccugacauucaucaaaaccacccugucccuugauuacgccuggaagacaaccgcuauggcccugagcaucguuucucucuuuccucugugucucuccacaacgagccagaaaaccacauggcugccggugcuucuggggucuuucggaugcaagccccugaccauguuucucauuacagaaaauaagaucuggggccggaaauccuggccucugaacgagggcauuauggcuaucgggauugugagcauccuucugucuucccuccugaagaaugacgucccccucgccggaccucugaucgcgggcgggaugcuuauugccuguuaugugaucagcggauccagcgcugaucugucucuggagaaagccgcugaaguuagcugggagcaagaagccgagcauuccggcaccucucacaacauucccguggaaguccaggacgaugggacgaugaagaucaaagacgaggagcgcgaugacacccucacaauucugcuuaaggccacccugcucgcugugagcggaguuuacccuauguccauccccgcgacacuguucgugugguauuucuggcagaaaaagaagcagagaucuggcguccucugggauaccccgagcccucccgaaguggagcgggccguccuggacgauggcaucuaccgcauucuucaaagagggcugcugggacggucccaggugggcguugggguguuucaggacggagucuuccauacaauguggcacgugacgcgcggcgcuguucucauguaucaggggaaaagacuggaaccuucuugggccagcgugaagaaagaccuuaucuccuacggaggcggcuggcgguuucaagggagcuggaauaccggagaggagguccaggugauugccguggaacccggcaagaacccgaaaaauguucagacaaccccugggaccuucaagacacccgagggagaagucggcgcuaucgcccuggauuuuaagccugggacgucuggaucccccauugugaacagagagggcaaaaucgugggccucuacgggaauggagucgugaccacaagcggcaccuauguuucugcgauugcucaagccaaggccucccaggaagggccccugccugagaucgaggacgaaguguucaaaaagcgcaaccucacaaucauggaucugcacccgggaagcggcaaaacccggagauaccuucccgcuauuguccgcgaggccaucaagcggaagcugagaacgcugauucucgcgccuacacgcgugguugcuuccgaaauggccgaggcccugaaagggaugcccauccgguaucagaccaccgcugugaagucugaacauacaggcagagagauugucgaccuuaugugccacgccaccuuuacaaugcgccugcucagcccugugcggguucccaauuacaacaugaucaucauggaugaggcucauuucaccgacccugccuccauugcggccagaggauauaucagcacgcgggugggcaugggggaagcugccgcuauuuuuaugacagccaccccgcccggaucugucgaggccuucccucaguccaaugcugugauccaagaugaagagcgcgacauucccgaaagaagcuggaacucuggcuacgauuggaucacagacuuuccugggaaaaccgugugguucguccccagcaucaaguccggaaaugauauugcgaacugucugcggaaaaacggcaagcgcguuauccagcugucuagaaagacguucgacaccgaguaucagaaaacaaagaauaacgacugggauuacguggugaccacagacauuagcgagaugggggccaauuuucgggcugauagagucaucgacccgcgccggugccucaaaccugugauucuuaaggauggccccgaaagaguuauccuggccggacccaugccugugaccgucgccuccgcugcccagcgccggggcagaauugggcgcaaccaaaauaaagagggagaccaguacguguauaugggccagccccugaacaaugaugaagaccacgcgcauuggacagaggcuaagaugcuccuggauaacaucaauaccccugaggggaucauuccggcccuuuucgaacccgagcgggaaaagaacgccgcuaucgacggagaguacagacugcgcggcgaagccagaaaaacguuuguugagcucaugcggcgcggggaucugccuguguggcugucuuauaaggucgcgagcgagggcuuccaguacuccgacagacgguggugcuuugauggagaacgcaauaaccaagugcucgaggaaaauauggacgucgagauuuggacaaaagaaggcgagagaaagaaacuucggcccagauggcuggacgcccgcaccuauagcgauccucuggcucuccgggaguucaaggaauuugccgcugggagacgcucuguguccggagaccugauccuugagauuggcaaacugccccagcaccucacccugcgggcccagaacgcucuggauaaucucguuaugcuucacaacagcgaacaggggggaaaggccuacagacaugcgauggaggaacugccggacacaaucgagacccugaugcuccuggcccuuaucgcugugcugacaggcggcgugacgcucuucuuucuguccgggaagggacugggcaaaaccucuauugggcuccuuugugucacagccagcuccgcucugcuguggauggccucuguugagccucacuggaucgccgcuagcauuauccucgaauucuuucugauggugcuucugauucccgagccugaucggcaacgcaccccccaggacaaccagcucgcguauguggucaucggacugcuguucaugauccucacaguggccgcuaaugaaaugggccuucuggagaccacgaagaaagaucuggggauuggacauguugccgccgagaaccaccaacacgcuaccaugcucgacguggaucugagaccugccuccgcguggacacuuuacgccgucgcuaccacagugaucacccccaugaugcggcauacgauugaaaauacaaccgccaacaucagccugacagcuauugccaaucaggcggccauccucaugggccuggacaagggcuggccgauuucuaaaauggauaucggggucccucugcucgcucuuggaugcuacucccaggugaacccccugacccugaccgccgcuguucucaugcugguggcccacuaugcuaucauuggccccgggcuucaggccaaggcgacacgcgaggcccaaaagagaacggcugccggaaucaugaaaaauccuaccgucgacggcauuguggcuaucgaucuggacccgguuguguacgacgccaaguuugaaaaacagcucgggcagauuaugcugcugauccucuguacaagccagauccuucugaugcggaccacaugggcccugugcgagucuauuacccucgcgacgggaccccugacaacccuuugggaaggcuccccuggcaaguucuggaacaccacaaucgcugucagcauggccaauauuuuccgcgggucuuaucuggcuggagccggccucgccuuuagccugaugaaaucccuggggggaggcagacgggggaccggagcucaaggcgagacacucggcgagaaguggaagcgccagcuuaaccagcugucuaaaagcgaauucaauacguacaagagauccgggaucauggagguggaucggagcgaagccaaagagggacugaagagaggcgaaaccacaaaacaugcggugucccgcgggaccgccaagcuccggugguuuguugagagaaaccuggucaagcccgagggaaaagugauugaccuuggcugugggcgcggaggcuggucuuauuacugcgcuggccugaagaaagugacagaagucaagggguauaccaaaggaggcccugggcacgaggaacccaucccuauggccacguacggauggaaucucguuaagcugcauagcggcaaagauguguucuuuaugccgcccgagaagugugacacccugcucugcgauaucggggaauccucuccuaaccccacaauugaggagggacggacccuuagagugcugaagauggucgaaccuuggcugcgcggcaaucaguucuguaucaaaauucucaaccccuacaugccgagcgugguugagacacuggaacaaaugcagcggaagcacggcgggaugcuugugagaaauccucugucccgcaacucuacccacgagauguauugggucagcugcggaacaggcaacaucguguccgcuguuaauaugaccagccggaugcuccugaacagauuuacgauggcccaucgcaaacccacauacgagcgggacguggaucugggggcgggaaccagacacgucgccguggaacccgagguggcuaaucucgacauuaucggccagcgcauugaaaacaucaagaaugagcauaaaucuaccuggcacuaugaugaagacaacccuuacaagacaugggccuaucacggguccuacgaggucaagcccagcggaucugcuuccagcaugguuaauggcguggugagacugcuuacgaaaccuugggaugucaucccgauggugacccaaauugccaugacagacaccacacccuucggccagcagcggguuuuuaaggagaaaguggacacccgcacaccuagagcuaagcgggggaccacgcagaucauggaagucaccgccaaauggcuguggggauuccucucuagaaacaagaagccccggauuuguacacgcgaggaauuuaccagaaaagugcgguccaaugcggccaucggcgcuguuuucguggaugagaaccaauggaauagcgccaaggaagcugucgaggacgagcgcuuuugggaucuggugcauagagaacgggagcuucacaaacaggggaagugcgccacaugcguuuauaacaugaugggaaaacgcgaaaagaagcugggcgaguucgggaaagccaagggcuccagagcgauuugguacauguggcucggagcucgguuccuggaauuugaggcccugggcuucaugaaugaggaccauugguuuagccgcgaaaacucucucagcgggguggagggagaaggccugcacaaacuuggguacauccugagagauaucuccaagauuccuggaggcaauauguaugccgacgauaccgcugggugggacacgcggaucacagaggaugaccuccagaacgaggccaaaauuaccgaaaucauggagcccgaacaugcucugcuugccacaucuauuuucaagcugaccuaccagaacaaagucgugcgcguccaaagaccggcgaagaauggcacggugauggauguuaucagccggcgcgaccagagaggauccggccagguggggaccuauggacucaacacauuuaccaauauggagguccagcugauccggcaaauggaaucugagggcauuuuccugccuagcgagcucgaaacacccaaccuggccgagagagugcuugauuggcuggaaaagcacggggcugagcgccucaaacggauggccaucuccggagacgacugugugguuaagccuauugaugacagauuugcuaccgcccugacagcgcuuaaugauaugggcaaagugcgcaaggacaucccccagugggaaccuucuaaaggguggaacgauuggcagcagguccccuucugcagccaccauuuucaccaacugauuaugaaggacggccgggagaucgugguuccguguagaaaucaggaugagcucgugggacgcgcccgggucucccagggcgcuggguggagccugagagaaaccgccugccugggaaagucuuacgcucaaauguggcagcucauguauuuccaucgccgggaccugagacuugccgcuaacgccaucuguuccgcggugccugucgauugggugcccacgagccgcacaaccuggucuauucacgcccaccaucaguggaugaccacagaggacaugcuguccguuuggaaucggguguggaucgaagagaaccccuggauggaagauaaaacccacgucagcuccugggaggaggugccuuaccucggcaagagagaagaccaguggugcgggucucugauuggacuuacagcucgggccacgugggccaccaauauccaaguugcuauuaaccaggugagacgccugaucggcaaugagaacuaucucgacuacaugacaagcaugaaacgguuuaagaaugaauccgauccggagggggcccugugguga

SEQ ID NO: 18637 - RNA, 9879 nt, Artificial Sequence
  derived and/or modified CDS sequence (opt5) from DENV-1__KJ189318__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauugugucucuguucccucucugucuguccacaacgagccagaaaaccacauggcuuccgguccugcuggggucuuuuggaugcaagccccucaccauguuccugaucacagaaaauaagauuuggggccggaaauccuggccucuuaacgagggcaucauggccauugggaucguuagcauccugcucucuucccugcucaagaaugacgugccccuggcgggaccucuuauugccggcgggaugcugaucgcuuguuaugugauuagcggauccagcgccgaucugucucucgagaaaaccgcugaagucagcugggagcaagaagccgagcauuccggcacgucucacaacauccugguggaaguucaggacgaugggaccaugaagauuaaagacgaggagcgcgaugacacacuuaccauccugcucaaggccacacugcucgcugugagcggagucuaccccauguccaucccugcgacccuguuugugugguauuucuggcagaaaaagaagcagagaucuggcguucuuugggauacacccagcccgccugaaguggagcgggccguccuggacgauggcauuuaccgcauccugcaaagagggcuccugggacggucccaggugggcgucgggguguuccaggacggaguuuuucauacgauguggcacgugacccgcggcgcuguccuuauguaucaggggaaaagacuggaacccucuugggccagcgugaagaaagaccucauuuccuacggaggcggcuggcgguuccaagggagcuggaauacaggagaggagguucaggugaucgccgucgaaccuggcaagaaccccaaaaaugugcagaccaccccggggacauuuaagacgccugagggagaagugggcgcuauugcccuggauuucaagcccgggaccucuggauccccuaucguuaacagagagggcaaaauugucggccucuacgggaauggaguggugacaaccagcggcacauaugucucugcgaucgcucaagccaaggccucccaggaagggccccugcccgagaucgaggacgaaguguuuaaaaagcgcaaccuuaccauuauggaucugcacccuggaagcggcaaaacgcggagauaccugccggcuaucguucgcgaggccauuaagcggaagcucagaacacugauccuugcgcccacccgcguggucgcuuccgaaauggccgaggcccugaaagggaugccuauucgguaucagaccacagcugugaagucugaacauaccggcagagagaucguugaccucaugugccacgccacauucaccaugcgccugcugagccccgugcgggucccuaauuacaacaugaucauuauggaugaggcucauuuuacggaccccgccuccaucgcggccagaggauauauuagcacacgggugggcaugggggaagcugccgcuaucuucaugaccgccacaccuccgggaucuguugaggccuuuccccaguccaaugcugugauucaagaugaagagcgcgacaucccugaaagaagcuggaacucuggcuacgauuggaucaccgacuuccccgggaaaacggucugguuugugccuagcauuaaguccggaaaugauaucgcgaacugucuccggaaaaacggcaagcgcgugauucagcuuucuagaaagaccuucgacacagaguaucagaaaaccaagaauaacgacugggauuacgucguuacaaccgacaucagcgagaugggggccaauuuccgggcugauagagugauugacccccgccggugccugaaaccggugauccugaaggauggcccugaaagagucauucucgccggacccaugcccgugacaguugccuccgcugcccagcgccggggcagaaucgggcgcaaccaaaauaaagagggagaccaguacguguauaugggccagccucugaacaaugaugaagaccacgcgcauuggaccgaggcuaagaugcuucuggauaacaucaauacgcccgaggggauuaucccugcccucuuugaaccggagcgggaaaagucugccgcuauugacggagaguacagacugcgcggcgaagccagaaaaacauucgucgagcugaugcggcgcggggaucuccccguguggcuuagcuauaagguugcguccgagggcuuucaguacagcgacagacgguggugcuucgauggagaacgcaacaaucaagugcuggaggaaaacauggacgucgagaucuggaccaaagaaggcgagagaaagaaacugcggccuagauggcucgacgcccgcaccuauucugauccccuggcucuucgggaguuuaaggaauucgccgcugggagacgcuccgugagcggagaccugauucucgagaucggcaaacugccucagcaccugacacuccgggcccagaaugcucuugauaaccuggucaugcugcacaauuccgaacaggggggaaaggccuacagacaugcgauggaggaacuccccgacaccaucgagacacugaugcuucuggcccucauugcugugcugacgggcggcguuacccuguuuuuccucucugggaagggacuuggcaaaacaagcaucgggcugcugugugugaccgccuccucugcucuccuguggauggccagcguggagccgcacuggauugccgcuuccaucauucuugaauuuuuccugaugguccuccugaucccugagcccgaucggcaacgcacaccucaggacaaccagcuggcguauguugugaucggacuccuuuuuaugauucugaccguggccgcuaacgaaaugggccugcucgagacgaccaagaaagaucuggggaucggacaugucgccgccgagaaucaccaacacgcuacaaugcuugacguggaucugagacccgccagcgcguggacccucuacgccguugcuacaaccgugauuacgccuaugaugcggcauacaaucgaaaacaccacagccaauauuucucugaccgcuaucgccaaccaggcggccauucugaugggccucgacaagggcuggcccaucuccaaaauggauaucggggucccgcuucuggcucugggaugcuacagccaggugaauccucucacccugacagccgcuguccuuaugcugguggcccacuaugcuauuaucggccccgggcuccaggccaaggcgacgcgcgaggcccaaaagagaaccgcugccggaauuaugaaaaaccccacaguugacggcaucguggcuauugaucuggacccugucguguacgacgccaaguucgaaaaacagcuggggcagaucaugcuccuuauccuguguaccucucagauucugcucaugcggacaaccugggcccugugcgaguccaucacgcuugcgacaggaccgcugaccacccucugggaaggcagccccggcaaguuuuggaauacaaccauugcuguuucuauggccaacaucuuccgcgggagcuaucuggcuggagccggccuggccuucucccucaugaaaucucuugggggaggcagacgggggacaggagcucaaggcgagacgcugggcgagaaguggaagcgccagcugaaucagcucagcaaauccgaauuuaacaccuacaagagaagcgggauuauggagguggaucgguccgaagccaaagagggacugaagagaggcgaaacaaccaaacaugcggucucucgcgggacagccaagcuucggugguucguggagagaaaucuggugaagccugagggaaaaguuaucgaccucggcugugggcgcggaggcuggagcuauuacugcgcuggccugaagaaagucaccgaagugaagggguauacgaaaggaggccccgggcacgaggaaccuauccccauggccaccuacggauggaaccuggugaagcuccauuccggcaaagaugucuuuuucaugccuccggagaagugugacacacuucugugcgauauuggggaaucuagccccaauccuaccaucgaggagggacggacacugagaguucucaagaugguggaacccuggcugcgcggcaaccaguuuuguauuaaaauccuuaauccuuacaugcccuccguggucgagacccuggaacaaaugcagcggaagcacggcgggaugcucgugagaaacccgcugucucgcaauagcacacacgagauguauuggguuuccugcggaaccggcaacauugugagcgcugucaacaugacgucucggaugcugcucaauagauucacaauggcccaucgcaaaccuaccuuugagcgggacguggaucugggggcgggaaccagacacguugccguggaacccgaggucgcuaaccuugacaucauuggccagcgcaucgaaaauaucaagaacgagcauaaauccacauggcacuacgaugaagacaaucccuauaagacgugggccuaccacgggagcuaugaggugaagccuucuggauccgcuagcucuauggugaacggcgucguuagacugcucaccaaacccugggaugugauuccuauggugacacaaaucgccaugaccgacacaaccccguucggccagcagcgggucuuuaaggagaaaguggacacacgcacccccagagcuaagcgggggacgacccagauuauggaaguuacagccaaauggcuguggggauuccuuuccagaaauaagaagccucggaucuguacccgcgaggaauuuacaagaaaagugcggagcaacgcggccauuggcgcugucuucguggaugagaaucaauggaacuccgccaaggaagcuguugaggacgagcgcuuuugggaucuggugcauagagaacgggagcuccacaaacaggggaagugcgccaccugcgucuacaauaugaugggaaaacgcgaaaagaagcugggcgaguucgggaaagccaagggcagcagagcgaucugguauauguggcugggagcucgguuccucgaauuugaggcccugggcuucaugaacgaggaccauugguuuucucgcgaaaauagccuuuccgggguggagggagaaggccugcacaaacucggguacauccugagagauauuucuaagauccccggaggcaacauguacgccgacgauacggcugggugggacacacggauuaccgaggaugaccuucagaaugaggccaaaaucacagauauuauggaaccugagcaugcucugcucgccaccagcaucuucaagcugacguaucagaacaaaguugugcgcguccaaagacccgcgaagaacggcaccgugauggacgucaucucccggcgcgaucagagaggaucuggccagguggggacauacggacugaauaccuuuacaaacauggaaguucagcucauucggcaaauggagagcgaaggcaucuuccugccguccgagcuugagaccccuaaucuggccgaaagagugcucgacuggcuggagaagcacggggcugaacgccuuaaacggauggccauuucuggagacgauugugucgugaagcccaucgacgauagauuugcuacagcccugaccgcgcucaacgacaugggcaaagugcgcaaggauauuccucagugggagcccagcaaaggguggaaugacuggcagcagguuccuuucugcucccaccauuuucaccaacugaucaugaaggauggccgggaaaucgugguccccuguagaaaccaggacgagcuggugggacgcgcccggguuagccagggcgcuggguggucucucagagagacggccugccugggaaaguccuaugcucaaauguggcagcuuauguacuuccaucgccgggaucugagacucgccgcuaaugccauuuguagcgcggugccggucgacugggugccuacaucucgcaccaccugguccauccacgcccaccaucaguggaugacaaccgaagauaugcugagcgucuggaaccggguguggauugaggaaaaucccuggauggaggacaaaacacacguuuccucuugggaagaggugcccuaucuuggcaagagagaggaccaguggugcgggagccugaucggacucacggcucgggccaccugggccacaaacauucaagucgcuaucaaucaggugagacgccugauuggcaacgaaaauuaccuggauuauaugaccuccaugaaacgguuuaagaacgagagcgacccugaaggggcccucugguga

SEQ ID NO: 18638 - RNA, 9879 nt, Artificial Sequence
  derived and/or modified CDS sequence (opt5) from DENV-1__KJ189319__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauugugucucuguucccucucugucuguccacaacgagccagaaaaccacauggcuuccgguccugcuggggucucucggaugcaagccccugaccauguuucuuaucacagaaaauaagauuuggggccggaaauccuggccucugaacgagggcaucauggccauugggaucguuagcauccuccugucuucccuccugaagaaugacgugccccuugcgggaccucugauugccggcgggaugcugaucgcuuguuaugugauuagcggauccagcgccgaucucucucuggagaaagcugccgaagucagcugggagcaagaagccgagcauuccggcaccucucacaacauccuuguggaaguucaggacgaugggacgaugaagauuaaagacgaggagcgcgaugacacccugacaauccuccugaaggcuacccuccuggcggugagcggagucuaccccauguccaucccugccacacuuuucgugugguauuuuuggcagaaaaagaagcagagaucuggcguucugugggauacccccagcccgccugaaguggagcgggcuguccuggacgauggcauuuaccgcauccuccaaagagggcugcuuggacggucccaggugggcgucgggguguuccaggacggaguuuuccauacaauguggcacgugacgcgcggcgccguccugauguaucaggggaaaagacucgaacccucuugggccagcgugaagaaagaccugauuuccuacggaggcggcuggcgguuucaagggagcuggaauaccggagaggagguucaggugaucgcugucgaaccuggcaagaaccccaaaaaugugcagacaaccccggggaccuucaagacaccugagggagaagugggcgccauugcgcucgauuuuaagcccgggacgucuggauccccuaucguuaacagagagggcaaaauugucggccuguacgggaauggaguggugaccacaagcggcaccuaugucucugcuaucgcccaagccaaggcuucccaggaagggccccuucccgagaucgaggacgaaguguucaaaaagcgcaaccugacaauuauggaucugcacccuggaagcggcaaaacccggagauaccucccggccaucguucgcgaggcgauuaagcggaagcugagaacgcuuauccuggcucccacacgcguggucgccuccgaaauggccgaggcucucaaagggaugccuauucgguaucagaccaccgccgugaagucugaacauacaggcagagagaucguugaccugaugugccacgcuaccuuuacaaugcgccugcucagccccgugcgggucccuaauuacaacaugaucauuauggaugaggcccauuucaccgaccccgcguccaucgccgcuagaggauauauuagcacgcgggugggcaugggggaagccgcugccaucuuuaugacagccaccccuccgggaucuguugaggcuuucccccaguccaaugcggugauucaagaugaagagcgcgacaucccugaaagaagcuggaacucuggcuacgauuggaucacagacuuucccgggaaaaccgucugguucgugccuagcauuaaguccggaaaugauaucgccaacugucuucggaaaaacggcaagcgcgugauucagcugucuagaaagacguuugacaccgaguaucagaaaacaaagaauaacgacugggauuacgucguuaccacagacaucagcgagaugggggcuaauuuccgggccgauagagugauugacccccgccggugccugaaaccggugauccucaaggauggcccugaaagagucauucuggccggacccaugcccgugaccguugcuuccgccgcgcagcgccggggcagaaucgggcgcaaccaaaauaaagagggagaccaguacguguauaugggccagccucuuaacaaugaugaagaccacgcucauuggacagaggccaagaugcugcucgauaacaucaauacccccgaggggauuaucccugcccuguucgaaccggagcgggaaaagucugcugccauugacggagaguacagacugcgcggcgaagcgagaaaaacguuugucgagcucaugcggcgcggggaucuucccguguggcugagcuauaagguugccuccgagggcuuccaguacagcgacagacgguggugcuuugauggagaacgcaacaaucaagugcuggaggaaaacauggacgucgagaucuggacaaaagaaggcgagagaaagaaacuccggccuagauggcuggacgcucgcaccuauucugauccccuugcccugcgggaguucaaggaauuugcugccgggagacgcuccgugagcggagaccucauucuggagaucggcaaacugccucagcaccucacccuucgggcucagaaugcccuggauaaccuggucaugcuccacaauuccgaacaggggggaaaggcguacagacaugccauggaggaacugcccgacacaaucgagacccuuaugcugcucgcucugauugccgugcugacaggcggcguuacgcucuucuuucuuucugggaagggacugggcaaaaccagcaucgggcugcucugugugacagcuuccucugcccugcuuuggauggccagcguggagccgcacuggauugcugcguccaucauucuggaauucuuucucaugguccugcugaucccugagcccgaucggcaacgcaccccucaggacaaccagcucgccuauguugugaucggacuucuguucaugauucugacaguggcugccaacgaaaugggccuccuggagaccacgaagaaagaucuugggaucggacaugucgccgcugagaaucaccaacacgccaccaugcuggacguggaucucagacccgcgagcgccuggacacuguacgcuguugccaccacagugauuaccccuaugaugcggcauacgaucgaaaacacaaccgcuaauauuucucugacagccaucgcgaaccaggccgcuauucucaugggccuugacaagggcuggcccaucuccaaaauggauaucggggucccgcugcuggcccucggaugcuacagccaggugaauccucugacccuuaccgcugccguccugaugcucguggcucacuaugccauuaucggccccgggcugcaggcgaaggccacacgcgaggcucaaaagagaacggccgcuggaauuaugaaaaaccccaccguugacggcaucguggccauugaucuggacccugucguguacgacgccaaguuugaaaaacagcucgggcagaucaugcuucugauccuguguacaucucagauucuccugaugcggaccacaugggcgcuuugcgaguccaucacccuggcuacgggaccgcucacaacccugugggaaggcagccccggcaaguucuggaauaccacaauugccguuucuauggcuaacaucuuucgcgggagcuaucuggccggagccggccucgcuuucucccuuaugaaaucucuggggggaggcagacgggggaccggagcccaaggcgagacacugggcgagaaguggaagcgccagcucaaucagcugagcaaauccgaauucaacacguacaagagaagcgggauuauggagguggaucgguccgaagcgaaagagggacuuaagagaggcgaaaccacaaaacaugccgucucucgcgggaccgcuaagcugcggugguuuguggagagaaaucucgugaagccugagggaaaaguuaucgaccugggcugugggcgcggaggcuggagcuauuacugcgccggccugaagaaagucacagaagugaagggguauaccaaaggaggccccgggcacgaggaaccuauccccauggcuacguacggauggaaccucgugaagcuucauuccggcaaagaugucuucuuuaugccuccggagaagugugacacccugcugugcgauauuggggaaucuagccccaauccuacaaucgaggagggacggacccucagaguucugaagaugguggaacccuggcuucgcggcaaccaguucuguauuaaaauccugaauccuuacaugcccuccguggucgagacacucgaacaaaugcagcggaagcacggcgggaugcuggugagaaacccgcugucucgcaauagcacccacgagauguauuggguuuccugcggaacaggcaacauugugagcgccgucaacaugaccucucggaugcuccugaauagauuuacgauggcgcaucgcaaaccuacauucgagcgggacguggaucuuggggccggaaccagacacguugcuguggaacccgaggucgccaaccuggacaucauuggccagcgcaucgaaaauaucaagaacgagcauaaauccaccuggcacuacgaugaagacaaucccuauaagacaugggcuuaccacgggagcuaugaggugaagccuucuggauccgccagcucuauggugaacggcgucguuagacuccugacgaaacccugggaugugauuccuauggugacccaaaucgcuaugacagacaccacaccguuuggccagcagcgggucuucaaggagaaaguggacacccgcacacccagagccaagcgggggaccacgcagauuauggaaguuaccgcgaaauggcuuuggggauuucuguccagaaauaagaagccucggaucuguacacgcgaggaauucaccagaaaagugcggagcaacgccgcuauuggcgccgucuuuguggaugagaaucaauggaacuccgcuaaggaagccguugaggacgagcgcuucugggaucucgugcauagagaacgggagcugcacaaacaggggaagugcgccacaugcgucuacaauaugaugggaaaacgcgaaaagaagcugggcgaguuugggaaagcgaagggcagcagagcuaucugguauauguggcucggagcccgguuccuggaauucgaggcccuuggcuuuaugaacgaggaccauugguucucucgcgaaaauagccuguccgggguggagggagaaggccuccacaaacugggguacauccuuagagauauuucuaagauccccggaggcaacauguacgcugacgauaccgccgggugggacacgcggauuacagaggaugaccugcagaaugaggcuaaaaucaccgauauuauggaaccugagcaugcccuccuggcgacaagcaucuuuaagcugaccuaucagaacaaaguugugcgcguccaaagacccgccaagaacggcacggugauggacgucaucucccggcgcgaucagagaggaucuggccagguggggaccuacggacucaauacauucaccaacauggaaguucagcugauucggcaaauggagagcgaaggcaucuuucuuccguccgagcuggagacaccuaaucucgcugaaagagugcuggacuggcuugagaagcacggggccgaacgccugaaacggauggcuauuucuggagacgauugugucgugaagcccaucgacgauagauucgccaccgcgcucacagcccugaacgacaugggcaaagugcgcaaggauauuccucagugggagcccagcaaaggguggaaugacuggcagcagguuccuuuuugcucccaccauuuccaccaacugaucaugaaggauggccgggaaaucgugguccccuguagaaaccaggacgagcucgugggacgcgcucggguuagccagggcgccggguggucucugagagagaccgcuugccuuggaaaguccuaugcccaaauguggcagcugauguacuuucaucgccgggaucucagacuggcugccaaugcgauuuguagcgccgugccggucgacugggugccuacgucucgcacaaccugguccauccacgcucaccaucaguggaugaccacagaagauaugcuuagcgucuggaaccggguguggauugaggaaaaucccuggauggaggacaaaacccacguuuccucuugggaagaggugcccuaucugggcaagagagaggaccaguggugcgggagccucaucggacugacagcccgggccacgugggcuaccaacauucaagucgccaucaaucaggugagacgccugauuggcaacgaaaauuaccucgauuauaugacauccaugaaacgguucaagaacgagagcgacccugaaggggcgcugugguga

SEQ ID NO: 18639 - RNA, 9879 nt, Artificial Sequence
  derived and/or modified CDS sequence (opt5) from DENV-1__KJ189320__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauugugucucuguucccucucugucuguccacaacgagccagaaaaccacauggcuuccgguccugcuggggucuuuuggaugcaagccccucaccauguuccugaucacagaaaauaagauuuggggccggaaauccuggccucuuaacgagggcaucauggccauugggaucguuagcauccugcucucuucccugcucaagaaugacgugccccuggcgggaccucuuauugccggcgggaugcugaucgcuuguuaugugauuagcggauccagcgccgaucugucucucgagaaagcugccgaagucagcugggagcaagaagccgagcauuccggcaccucucacaacauccugguggaaguucaggacgaugggacgaugaagauuaaagacgaggagcgcgaugacacccuuacaauccugcucaaggcuacccugcucgcggugagcggagucuaccccauguccaucccugccacacuguuugugugguauuucuggcagaaaaagaagcagagaucuggcguucuuugggauacccccagcccgccugaaguggagcgggcuguccuggacgauggcauuuaccgcauccugcaaagagggcuccugggacggucccaggugggcgucgggguguuccaggacggaguuuuucauacaauguggcacgugacgcgcggcgccguccuuauguaucaggggaaaagacuggaacccucuugggccagcgugaagaaagaccucauuuccuacggaggcggcuggcgguuccaagggagcuggaauaccggagaggagguucaggugaucgcugucgaaccuggcaagaaccccaaaaaugugcagacaaccccggggaccuuuaagacaccugagggagaagugggcgccauugcgcuggauuucaagcccgggacgucuggauccccuaucguuaacagagagggcaaaauugucggccucuacgggaauggaguggugaccacaagcggcaccuaugucucugcuaucgcccaagccaaggcuucccaggaagggccccugcccgagaucgaggacgaaguguuuaaaaagcgcaaccuuacaauuauggaucugcacccuggaagcggcaaaacccggagauaccugccggccaucguucgcgaggcgauuaagcggaagcucagaacgcugauccuugcucccacacgcguggucgccuccgaaauggccgaggcucugaaagggaugccuauucgguaucagaccaccgccgugaagucugaacauacaggcagagagaucguugaccucaugugccacgcuaccuucacaaugcgccugcugagccccgugcgggucccuaauuacaacaugaucauuauggaugaggcccauuuuaccgaccccgcguccaucgccgcuagaggauauauuagcacgcgggugggcaugggggaagccgcugccaucuucaugacagccaccccuccgggaucuguugaggcuuuuccccaguccaaugcggugauucaagaugaagagcgcgacaucccugaaagaagcuggaacucuggcuacgauuggaucacagacuuccccgggaaaaccgucugguuugugccuagcauuaaguccggaaaugauaucgccaacugucuccggaaaaacggcaagcgcgugauucagcuuucuagaaagacguucgacaccgaguaucagaaaacaaagaauaacgacugggauuacgucguuaccacagacaucagcgagaugggggcuaauuuccgggccgauagagugauugacccccgccggugccugaaaccggugauccugaaggauggcccugaaagagucauucucgccggacccaugcccgugaccguugcuuccgccgcgcagcgccggggcagaaucgggcgcaaccaaaauaaagagggagaccaguacguguauaugggccagccucugaacaaugaugaagaccacgcucauuggacagaggccaagaugcuucuggauaacaucaauacccccgaggggauuaucccugcccucuuugaaccggagcgggaaaagucugcugccauugacggagaguacagacugcgcggcgaagcgagaaaaacguucgucgagcugaugcggcgcggggaucuccccguguggcuuagcuauaagguugccuccgagggcuuucaguacagcgacagacgguggugcuucgauggagaacgcaacaaucaagugcuggaggaaaacauggacgucgagaucuggacaaaagaaggcgagagaaagaaacugcggccuagauggcucgacgcucgcaccuauucugauccccuggcccuucgggaguuuaaggaauucgcugccgggagacgcuccgugagcggagaccugauucucgagaucggcaaacugccucagcaccugacccuccgggcucagaaugcccuugauaaccuggucaugcugcacaauuccgaacaggggggaaaggcguacagacaugccauggaggaacuccccgacacaaucgagacccugaugcuucuggcucucauugccgugcugacaggcggcguuacgcuguuuuuccucucugggaagggacuuggcaaaaccagcaucgggcugcugugugugacagcuuccucugcccuccuguggauggccagcguggagccgcacuggauugcugcguccaucauucuugaauuuuuccugaugguccuccugaucccugagcccgaucggcaacgcaccccucaggacaaccagcuggccuauguugugaucggacuccuuuuuaugauucugacaguggcugccaacgaaaugggccugcucgagaccacgaagaaagaucuggggaucggacaugucgccgcugagaaucaccaacacgccaccaugcuugacguggaucugagacccgcgagcgccuggacacucuacgcuguugccaccacagugauuaccccuaugaugcggcauacgaucgaaaacacaaccgcuaauauuucucugacagccaucgcgaaccaggccgcuauucugaugggccucgacaagggcuggcccaucuccaaaauggauaucggggucccgcuucuggcccugggaugcuacagccaggugaauccucucacccugaccgcugccguccuuaugcugguggcucacuaugccauuaucggccccgggcuccaggcgaaggccacacgcgaggcucaaaagagaacggccgcuggaauuaugaaaaaccccaccguugacggcaucguggccauugaucuggacccugucguguacgacgccaaguucgaaaaacagcuggggcagaucaugcuccuuauccuguguacaucucagauucugcucaugcggaccacaugggcgcugugcgaguccaucacccuugcuacgggaccgcugacaacccucugggaaggcagccccggcaaguuuuggaauaccacaauugccguuucuauggcuaacaucuuccgcgggagcuaucuggccggagccggccuggcuuucucccucaugaaaucucuugggggaggcagacgggggaccggagcccaaggcgagacacugggcgagaaguggaagcgccagcugaaucagcucagcaaauccgaauuuaacacguacaagagaagcgggauuaccgagguggaucgguccgaagcgaaagagggacugaagagaggcgaaacaaccaaacaugccgucucucgcgggacagcuaagcuucggugguucguggagagaaaucuggugaagccugagggaaaaguuaucgaccucggcugugggcgcggaggcuggagcuauuacugcgccggccugaagaaagucaccgaagugaagggguauacgaaaggaggccccgggcacgaggaaccuauccccauggcuaccuacggauggaaccuggugaagcuccauuccggcaaagaugucuuuuucaugccuccggagaagugugacacacuucugugcgauauuggggaaucuagccccaauccuaccaucgaggagggacggacacugagaguucucaagaugguggaacccuggcugcgcggcaaccaguuuuguauuaaaauccuuaauccuuacaugcccuccguggucgagacccuggaacaaaugcagcggaagcacggcgggaugcucgugagaaacccgcugucucgcaauagcacacacgagauguauuggguuuccugcggaaccggcaacauugugagcgccgucaacaugacgucucggaugcugcucaauagauucacaauggcgcaucgcaaaccuaccuuugagcgggacguggaucugggggccggaaccagacacguugcuguggaacccgaggucgccaaccuugacaucauuggccagcgcaucgaaaauaucaagaacgagcauaaauccacauggcacuacgaugaagacaaucccuauaagacgugggcuuaccacgggagcuaugaggugaagccuucuggauccgccagcucuauggugaacggcgucguuagacugcucaccaaacccugggaugugauuccuauggugacacaaaucgcuaugaccgacacaaccccguucggccagcagcgggucuuuaaggagaaaguggacacacgcacccccagagccaagcgggggacgacccagauuauggaaguuacagcgaaauggcuguggggauuccuuuccagaaauaagaagccucggaucuguacccgcgaggaauuuacaagaaaagugcggagcaacgccgcuauuggcgccgucuucguggaugagaaucaauggaacuccgcuaaggaagccguugaggacgagcgcuuuugggaucuggugcauagagaacgggagcuccacaaacaggggaagugcgccaccugcgucuacaauaugaugggaaaacgcgaaaagaagcugggcgaguucgggaaagcgaagggcagcagagcuaucugguauauguggcugggagcccgguuccucgaauuugaggcccugggcuucaugaacgaggaccauugguuuucucgcgaaaauagccuuuccgggguggagggagaaggccugcacaaacucggguacauccugagagauauuucuaagauccccggaggcaacauguacgcugacgauacggccgggugggacacacggauuaccgaggaugaccuucagaaugaggcuaaaaucacagauauuauggaaccugagcaugcccugcucgcgaccagcaucuucaagcugacguaucagaacaaaguugugcgcguccaaagacccgccaagaacggcaccgugauggacgucaucucccggcgcgaucagagaggaucuggccagguggggacauacggacugaauaccuuuacaaacauggaaguucagcucauucggcaaauggagagcgaaggcaucuuccugccguccgagcuugagaccccuaaucuggcugaaagagugcucgacuggcuggagaagcacggggccgaacgccuuaaacggauggcuauuucuggagacgauugugucgugaagcccaucgacgauagauuugccacagcgcugaccgcccucaacgacaugggcaaagugcgcaaggauauuccucagugggagcccagcaaaggguggaaugacuggcagcagguuccuuucugcucccaccauuuucaccaacugaucaugaaggauggccgggaaaucgugguccccuguagaaaccaggacgagcuggugggacgcgcucggguuagccagggcgccggguggucucucagagagacggcuugccugggaaaguccuaugcccaaauguggcagcuuauguacuuccaucgccgggaucugagacucgcugccaaugcgauuuguagcgccgugccggucgacugggugccuacaucucgcaccaccugguccauccacgcucaccaucaguggaugacaaccgaagauaugcugagcgucuggaaccggguguggauugaggaaaaucccuggauggaggacaaaacacacguuuccucuugggaagaggugcccuaucuuggcaagagagaggaccaguggugcgggagccugaucggacucacggcccgggccaccugggcuacaaacauucaagucgccaucaaucaggugagacgccugauuggcaacgaaaauuaccuggauuauaugaccuccaugaaacgguuuaagaacgagagcgacccugaaggggcgcucugguga

SEQ ID NO: 18640 - RNA, 9879 nt, Artificial Sequence
  derived and/or modified CDS sequence (opt5) from DENV-1__KJ189323__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcccguucaaacuggagaaggaaguggccgagacccagcacggaaccguccuugugcaaguuaaguacgagggcacagaugcgccuugcaaaauccccuucagcacccaggacgaaaagggggugacacagaacggaagacucaucacggcuaauccuauugucaccgauaaagagaagcccgugaacaucgaaacagagcccccuuuuggcgagucuuauauugugguuggggccggagaaaaagcccugaagcuguccugguucaagaaaggcagcucuaucgggaagauguuugaggcuaccgcccggggcgcuagacgcauggccauucucggagacacagcgugggauuucggcagcaucgggggagucuuuaccuccgugggcaaacuggugcaucaggucuucgggacggccuacggagugcuuuuuucuggcguuagcuggaccaugaagaucgggauuggcauccugcucacauggcugggacugaauucccggagcaccucucuuuccaugacauguauugcugugggcauggucacccucuaccugggggugaugguucaagccgacagcggaugcgugaucaacuggaaaggcagagaacugaagugugggucuggaauuuucgucacaaacgaggugcacaccuggacggaacaguauaaguuucaggcugauuccccgaaacgccucagcgccgcgaucggcaaggccugggaggaggggguuugcggcauucgguccgcuacaagacuggaaaauaucauguggaaacagaucucuaacgagcuuaaucauauucugcucgaaaacgacaugaaguucaccguggucgugggagacgccaauggcauccuggcucaagggaaaaagaugauucgcccccagccuauggagcacaaauacagcuggaaguccuggggaaaggccaaaaucauuggcgccgauauccagaacaccacauuuaucauugacgggcccgauaccccugaaugucccgacaaucagcgggcuuggaacaucugggagguggaggauuauggauucggcauuuuuacgacaaauaucuggcugaagcuuagagacucuuacacccaaaugugcgaucaccgccucaugagcgcggccauuaaagacuccaaggcuguccaugccgauaugggcuauuggaucgaaagcgagaaaaacgaaacauggaagcuggcccgggcuucuuucaucgagguuaagaccuguacauggccgaaaucccacacccuguggagcaauggggugcucgaaucugagaugauuaucccuaagauuuacggaggccccaucucccagcauaacuauagaccuggguacuucacgcagaccgccggacccuggcaccugggcaaacuugagcuggacuuugaucucugcgaagggacaaccguggucguggacgagcacugcggaaaucgcggcccuagccugcggacaaccacgguuacaggcaagauuauccaugaaugguguugcagaucuuguacccugcccccgcuucgguuccgcggggaggauggaugcugguacggcauggagaucagaccugugaaagaaaaggaggaaaaccucguccggagcaugguguccgcggggagcggagagguugacucuuuuucccugggcauucugugugugagcaucaugauugaagaggucaugagaucccgcuggucucggaagaugcucaugacagggacccuggcuguguuccuucugcucguuaugggacaacugaccuggaaugaccugaucagacuuugcauuauggugggcgccaacgccagcgaucgcaugggcauggggacaacguaucuggcucucauggccaccuuuaaaaugagacccauguucgcggucggacugcucuuucggcgccugacauccagagaggugcuucugcucaccaucggccugucucugguggcuagcgucgaacuucccaacucccuggaggaacucggggacggacuggccaugggcauuaugaugcucaagcugcuuacagaguuccagccucaccagcuguggaccacgcuccugucucugacauuuaucaaaaccacccuuagccuggauuacgccuggaagacaaccgcuauggcccucuccaucguuagccuguucccgcucugucugucuacaacgucccagaaaaccacauggcuucccgugcugcuggggagcuuuggaugcaagccucucaccauguuccugauuacagaaaauaagaucuggggccggaaaucuuggccccuuaacgagggcauuauggcuaucgggauuguguccauccugcucagcucucugcucaagaaugacgucccucuggccggaccccuuaucgcgggcgggaugcugauugccuguuaugugaucuccggaagcuccgcugaucugagccucgagaaagccgcugaaguuucuugggagcaagaagccgagcauagcggcaccucccacaacauucugguggaaguccaggacgaugggacgaugaagaucaaagacgaggagcgcgaugacacccuuacaauucugcucaaggccacccugcucgcugugucuggaguuuacccuaugagcauccccgcgacacuguuugugugguauuucuggcagaaaaagaagcagagauccggcguccuuugggauaccccgucuccucccgaaguggagcgggccguccuggacgauggcaucuaccgcauucugcaaagagggcuccugggacggagccaggugggcguugggguguuccagggaggcgucuuucauacaauguggcacgugacgcgcggggcuguucuuauguaucagggaaaaagacuggaaccuuccugggccucugugaagaaagaccucaucagcuacggcggcggguggcgguuccaaggauccuggaauaccggcgaggagguccaggugauugccguggaacccgggaagaacccgaaaaauguucagacaaccccuggaaccuuuaagacacccgagggcgaagucggggcuaucgcccuggacuucaagccuggaacgagcggcucucccauugugaacagagagggcaaaaucguggggcucuacggaaauggcgucgugaccacauccgggaccuauguuagcgcgauugcucaagccaaggccucucaggaaggaccccugccugagaucgaggaugaaguguuuaaaaagcgcaaccuuacaaucauggaccugcacccgggcuccgggaaaacccggagauaccugcccgcuauuguccgcgaggccaucaagcggaagcucagaacgcugauucuugcgccuacacgcgugguugcuagcgaaauggccgaggcccugaaaggcaugcccauccgguaucagaccaccgcugugaaguccgaacauacaggaagagagauugucgaucucaugugccacgccaccuucacaaugcgccugcugucuccugugcggguucccaauuacaacaugaucaucauggacgaggcucauuuuaccgauccugccagcauugcggccagaggcuauaucuccacgcggguggggaugggagaagcugccgcuauuuucaugacagccaccccgcccggcagcgucgaggccuuuccucagucuaaugcugugauccaagacgaagagcgcgauauucccgaaagauccuggaacagcggguacgacuggaucacagauuucccuggaaaaaccgugugguuuguccccucuaucaagagcggcaaugacauugcgaacugucuccggaaaaacgggaagcgcguuauccagcuuuccagaaagacguucgauaccgaguaucagaaaacaaagaauaacgacugggacuacguggugaccacagauauuucugagaugggcgccaauuuccgggcugacagagucaucgauccgcgccggugccugaaaccugugauucugaaggacggacccgaaagaguuauccucgccggccccaugccugugaccgucgccagcgcugcccagcgccgggggagaauuggacgcaaccaaaauaaagagggcgaucaguacguguauauggggcagccccugaacaaugacgaagaucacgcgcauuggacagaggcuaagaugcuucuggacaacaucaauaccccugagggaaucauuccggcccucuuugaacccgagcgggaaaaguccgccgcuaucgauggcgaguacagacugcgcggggaagccagaaaaacguucguugagcugaugcggcgcggcgaccucccuguguggcuuucuuauaaggucgcgagcgagggauuucaguacuccgauagacgguggugcuucgacggcgaacgcaacaaucaagugcuggaggaaaacauggaugucgagauuuggacaaaagaaggggagagaaagaaacugcggcccagauggcucgacgcccgcaccuauagcgacccucuggcucuucgggaguuuaaggaauucgccgcuggaagacgcucuguguccggcgaucugauccucgagauugggaaacugccccagcaccugacccuccgggcccagaaugcucuugacaaccugguuaugcugcacaauagcgaacagggaggcaaggccuacagacaugcgauggaggaacucccggauacaaucgagacccugaugcuucuggcccucaucgcugugcugacaggcggggugacgcuguuuuuccucuccggaaagggccuugggaaaaccucuauuggacugcugugugucacagccagcuccgcucuccuguggauggccucuguugagccucacuggaucgccgcuagcauuauccuugaauuuuuccugauggugcuccugauucccgagccugaccggcaacgcaccccccaggauaaccagcuggcguauguggucaucggccuccuuuuuaugauccugacaguggccgcuaacgaaauggggcugcucgagaccacgaagaaagaccugggaauuggccauguugccgccgagaaucaccaacacgcuaccaugcuugauguggaccugagaccugccuccgcguggacacucuacgccgucgcuaccacagugaucacccccaugaugcggcauacgauugaaaacacaaccgccaauaucagccugacagcuauugccaaccaggcggccauccugaugggccucgauaagggguggccgauuucuaaaauggacaucggagucccucuucuggcucugggcugcuacucccaggugaauccccucacccugaccgccgcuguucuuaugcugguggcccacuaugcuaucauugggcccggacuccaggccaaggcgacacgcgaggcccaaaagagaacggcugccggcaucaugaaaaacccuaccgucgaugggauuguggcuaucgaccuggauccgguuguguacgacgccaaguucgaaaaacagcugggacagauuaugcuccuuauccuguguacaagccagauccugcucaugcggaccacaugggcccugugcgagucuauuacccuugcgacgggcccccugacaacccucugggaaggcuccccugggaaguuuuggaauaccacaaucgcugucagcauggccaacauuuuccgcggaucuuaucuggcuggcgccgggcuggccuucagccucaugaaaucccuuggaggcgggagacggggaaccggcgcucaaggcgagacacugggggagaaguggaagcgccagcugaaucagcucucuaaaagcgaauuuaacacguacaagagauccggaaucauggagguggaccggagcgaagccaaagagggccugaagagaggggaaaccacaaaacaugcggugucccgcggaaccgccaagcuucggugguucguugagagaaaucuggucaagcccgagggcaaagugauugaucucggguguggacgcggcggcuggucuuauuacugcgcugggcugaagaaagugacagaagucaagggauauaccaaaggcgggccuggacacgaggaacccaucccuauggccacguacggcuggaaccugguuaagcuccauagcgggaaagacguguuuuucaugccgcccgagaagugugauacccuucugugcgacaucggagaauccucuccuaaucccacaauugaggagggccggacccugagagugcucaagauggucgaaccuuggcugcgcggcaaccaguuuuguaucaaaauucuuaaucccuacaugccgagcgugguugagacacuggaacaaaugcagcggaagcacgggggaaugcucgugagaaacccucugucccgcaauucuacccacgagauguauugggucagcugcggcacagggaacaucguguccgcuguuaacaugaccagccggaugcugcucaauagauucacgauggcccaucgcaaacccacauacgagcgggauguggaccugggagcgggcaccagacacgucgccguggaacccgagguggcuaaccuugauauuaucgggcagcgcauugaaaauaucaagaacgagcauaaaucuaccuggcacuaugacgaagauaauccuuacaagacaugggccuaucacggauccuacgaggucagacccagcggcucugcuuccagcaugguuaacggcguggugcggcugcucacgaagccuugggacgucaucccgauggugacccaaauugccaugacagauaccacacccuuugggcagcagcgcguuuucaaagagaagguggacaccagaacaccucgggcuaaaagaggaaccacgcagaucauggaagucaccgccaaguggcuguggggcuuucuuucucggaauaaaaagccccgcauuuguacaagagaggaauucacccggaaggugcgcuccaacgcggccaucggggcuguuuuuguggacgagaaucaauggaacagcgccaaagaagcugucgaggaugagagauucugggaccuggugcaucgggaacgcgagcuccacaagcagggaaaaugcgccacaugcguuuauaauaugaugggcaagagagaaaaaaagcugggggaguuuggcaaggccaaaggaucccgggcgauuugguacauguggcugggcgcucgcuuccucgaauucgaggcccugggguuuaugaacgaggaucauugguucagcagagaaaauucucuuagcggaguggagggcgaagggcugcacaagcucggauacauccugcgggacaucuccaaaauuccuggcgggaacauguaugccgaugacaccgcuggcugggauacgcgcaucacagaggacgaucuucagaaugaggccaagauuaccgaaaucauggagcccgaacaugcucugcucgccacaucuauuuuuaaacugaccuaccagaacaaggucgugagaguccaacggccggcgaaaaacggaacggugauggacguuaucagccgcagagaucagcggggcuccgggcaggugggaaccuauggccugaauacauucaccaacauggagguccagcucaucagacaaauggaaucugaggggauuuuucugccuagcgagcuugaaacacccaaucuggccgagcgcgugcucgacuggcuggaaaagcacggagcugagcggcuuaagagaauggccaucuccggcgaugacugugugguuaaaccuauugacgaucgcuucgcuaccgcccugacagcgcucaacgacauggggaaggugcggaaagauaucccccagugggaaccuucuaagggcuggaaugacuggcagcagguccccuuuugcagccaccauuuccaccaacugauuaugaaagauggaagagagaucgugguuccgugucgcaaccaggacgagcuggugggccgggccagagucucccagggggcuggauggagccuccgcgaaaccgccugccugggcaagucuuacgcucaaauguggcagcuuauguauuuucaucggagagaucugcgccucgccgcuaaugccaucuguuccgcggugccugucgacugggugcccacgagccggacaaccuggucuauucacgcccaccaucaguggaugaccacagaggauaugcuguccguuuggaacagaguguggaucgaagagaaucccuggauggaagacaagacccacgucagcuccugggaggaggugccuuaccuugggaaacgggaagaucaguggugcggaucucugauuggccucacagcuagagccacgugggccaccaacauccaaguugcuauuaaucaggugcgccggcugaucgggaacgagaauuaucuggacuacaugacaagcaugaagagauucaaaaacgaauccgacccggagggcgcccucugguga

SEQ ID NO: 18641 - RNA, 9879 nt, Artificial Sequence
  derived and/or modified CDS sequence (opt5) from DENV-1__KJ189324__SS-prME
agcgugacaaugcugcucaugcugcuucccacagcucuggcuuuccaccucacgaccagaggcggggaaccucauaugaucgucuccaagcaggaacggggaaaaucucugcuuuuuaagacaagcgccggcguuaacaugugcacccugauugcgauggaccucggggaacugugugaagauacaaugaccuacaaaugcccccagaucacagaagcugaacccgacgauguggacuguuggugcaaugccaccgauacgugggugaccuauggaacauguucccagaccggcgagcacagaagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagaacaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccgcccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaaacuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccagaagccacacccuguggucuaauggggugcucgaauccgagaugauuaucccgaaaauuuacggaggcccuaucagccagcauaacuaucgccccggguacuucacgcagaccgccggaccuuggcaccugggcaaacuugagcuggacuuugaucucugcgaagggacaaccguggucguggacgagcacugcggaaaucggggccccucucugagaacaaccacgguuacaggcaaaauuauccaugaaugguguugccggagcuguacccugccuccccuucgcuucagaggggaggauggaugcugguacggcauggagauccggccggugaaggaaaaagaggaaaaccucgucagauccauggugagcgcggggucuggagagguugacuccuuuagccugggcauucugugugcuuccaucaugauugaagaggugaugcgcucucgguggagcagaaagaugcucaugacagggacccuggccgucuuccuucugcucgugaugggacaacugaccuggaaugaccugauccgccuuugcauuaugguuggcgccaacgcuuccgauagaaugggcauggggacaacguaucuggcccucauggcgaccuuuaagaugcggccuauguucgcugugggacugcucuuucgcagacugacaucucgggagguccuucugcucaccaucggccugagccugguggccuccguggaacuucccaacucucuggaggaacucggggacggacuggccaugggcauuaugaugcucaaacugcuuacagaguuccagccccaccagcuguggaccacgcuccugagccugacauuuaucaagaccacccuuucccuggauuacgcuuggaaaacaaccgccauggcucucagcaucgucucucuguucccucucugucuguccacaacgagccagaagaccacauggcuuccgguucugcuggggucuuuuggaugcaaaccccucaccauguuccugauuacagaaaauaagaucuggggccgcaaguccuggccucuuaacgagggcauuauggccaucgggauugugagcauccugcucucuucccugcucaaaaaugacgugccccuggcgggaccucuuaucgccggcgggaugcugauugcuuguuaugucaucagcggauccagcgccgaucugucucucgagaaggcugccgaagugagcugggagcaagaagccgagcauuccggcaccucucacaacauucugguugaagugcaggacgaugggacgaugaaaaucaaggacgaggagagagaugacacccuuacaauucugcucaaagcuacccugcucgcggucagcggaguguaccccauguccaucccugccacacuguuuguuugguauuucuggcagaagaaaaagcagcggucuggcgugcuuugggauacccccagcccgccugaagucgagcgcgcugugcuggacgauggcaucuaccgcauucugcaacgggggcuccugggacgcucccaggucggcguggggguuuuccaggacggaguguuucauacaauguggcacgucacgagaggcgccgugcuuauguaucaggggaagcggcuggaacccucuugggccagcguuaaaaaggaccucaucuccuacggaggcggcuggagauuccaagggagcuggaauaccggagaggaggugcaggucauugcuguggaaccuggcaaaaaccccaagaaugugcagacaaccccggggaccuuuaaaacaccugagggagaaguuggcgccaucgcgcuggauuucaagcccgggacgucuggauccccuauugucaaccgcgagggcaagaucgugggccucuacgggaauggaguggucaccacaagcggcaccuaugugucugcuauugcccaagccaaggcuucccaggaagggccccugcccgagaucgaggacgaaguuuuuaagaaacggaaccuuacaaucauggaucugcacccuggaagcggcaagaccagacgcuaccugccggccauugugcgggaggcgaucaaaagaaagcuccgcacgcugauucuugcucccacacgggucguggccuccgaaauggccgaggcucugaaggggaugccuaucagauaucagaccaccgccguuaaaucugaacauacaggccgcgagauuguggaccucaugugccacgcuaccuucacaaugcggcugcugagccccgucagagugccuaauuacaacaugaucaucauggaugaggcccauuuuaccgaccccgcguccauugccgcucggggauauaucagcacgcgcguuggcaugggggaagccgcugccauuuucaugacagccaccccuccgggaucuguggaggcuuuuccccaguccaaugcggucauccaagaugaagagagagacauuccugaacggagcuggaacucuggcuacgauuggaucacagacuuccccgggaagaccgugugguuugugccuagcaucaaauccggaaaugauauugccaacugucuccgcaagaacggcaaaagagucauccagcuuucucggaagacguucgacaccgaguaucagaagaccaagaauaacgacugggauuacguugugaccacagacauuagcgagaugggggcuaauuucagagccgaucgcgugaucgacccccggagaugccugaagccggucauucugaaagauggcccugaacgcgugauccucgccggacccaugcccguuaccguggcuuccgccgcgcagcggagaggccgcauugggcggaaccaaaauaaggagggagaccaguacgucuauaugggccagccucugaacaaugaugaagaccacgcucauuggacagaggccaaaaugcuucuggauaacaucaauacccccgaggggaucauuccugcccucuuugaaccggagagagaaaagucugcugccaucgacggagaguaccgccugagaggcgaagcgcggaagacguucguggagcugaugcgcagaggggaucuccccguuuggcuuagcuauaaaguggccuccgagggcuuucaguacagcgaccggcgcuggugcuucgauggagaaagaaacaaucaaguccuggaggaaaacauggacguggagauuuggacaaaggaaggcgagcggaaaaagcugagaccucgcuggcucgacgcucggaccuauucugauccccuggcccuuagagaguuuaaagaguucgcugccgggcgccgguccgucagcggagaccugauccucgagauuggcaagcugccucagcaccugacccucagagcucagaaugcccuugauaaccuggugaugcugcacaauuccgaacaagggggaaaagcguaccggcaugccauggaggaacuccccgacacaaucgagacccugaugcuucuggcucucaucgccguucugacaggcggcgugacgcuguuuuuccucucugggaagggacuuggcaagaccagcauugggcugcugugugugacagcuuccucugcccuccuguggauggccagcgucgagccgcacuggaucgcugcguccauuauccuugaauuuuuccugaugguucuccugauuccugagcccgaucgccaaagaaccccucaggacaaccagcuggccuauguggugaucggacuccuuuuuaugauccugacagucgcugccaacgaaaugggccugcucgagaccacgaaaaaggaucuggggauuggacauguggccgcugagaaucaccaacacgccaccaugcuugacguugaucugcggcccgcgagcgccuggacacucuacgcuguggccaccacagucaucaccccuaugaugcgccauacgauugaaaacacaaccgcuaauaucucucugacagccauugcgaaccaggccgcuauccugaugggccucgacaaaggcuggcccauuuccaagauggauaucggggugccgcuucuggcccugggaugcuacagccaggucaauccucucacccugaccgcugccgugcuuaugcugguugcucacuaugccaucauuggccccgggcuccaggcgaaagccacaagagaggcucaaaagcggacggccgcuggaaucaugaagaaccccaccguggacggcauugucgccaucgaucuggacccugugguuuacgacgccaaauucgaaaagcagcuggggcagauuaugcuccuuauccuguguacaucucagauccugcucaugcgcaccacaugggcgcugugcgaguccauuacccuugcuacgggaccgcugacaacccucugggaaggcagccccggcaaauuuuggaauaccacaaucgccgugucuauggcuaacauuuucagagggagcuaucuggccggagccggccuggcuuucucccucaugaagucucuugggggaggccggcgcgggaccggagcccaaggcgagacacugggcgagaaauggaagagacagcugaaucagcucagcaaguccgaauuuaacacguacaaacggagcgggaucauggaggucgauagauccgaagcgaaggagggacugaaacgcggcgaaaccacaaagcaugccgugucucgggggaccgcuaaacuuagaugguucguggagcgcaaucugguuaagccugagggaaaggucauugaccucggcugugggcggggaggcuggagcuauuacugcgccggccugaaaaaggugacagaagugaaaggguauaccaagggaggccccgggcacgaggaaccuauccccauggcuacguacggauggaaccuggucaaacuccauuccggcaaggauguguuuuucaugccuccggagaaaugugacacccuucugugcgauaucggggaaucuagccccaauccuacaauugaggagggaagaacccugcgcguucucaagaugguggaacccuggcugcggggcaaccaguuuuguaucaagauucuuaauccuuacaugcccuccgucguggagacacuggaacaaaugcagagaaaacacggcgggaugcucguucgcaacccgcugucucggaauagcacccacgagauguauuggguguccugcggaacaggcaacaucgucagcgccgugaacaugaccucuagaaugcugcucaaucgcuucacgauggcgcaucggaagccuacauacgagagagacguugaucugggggccggaacccgccacguggcugucgaacccgagguggccaaccuugacauuaucggccagagaauugaaaauaucaaaaacgagcauaaguccaccuggcacuaugaugaagacaaucccuacaaaacaugggcuuaucacgggagcuacgaggugaagccuucuggauccgccagcucuauggucaacggcguugugcggcugcucacgaagcccugggaugugaucccuauggucacccaaauugcuaugacagacaccacaccguuuggccagcagcgcguguucaaagagaagguugacaccagaacaccccgggccaaaagagggaccacgcagaucauggaagugaccgcgaaguggcuguggggauuucuuucccggaauaaaaagccucgcauuuguacaagagaggaguucacccggaagguccgcagcaacgccgcuaucggcgccguguuuguugaugagaaucaauggaacuccgcuaaagaagccguggaggacgagagauucugggaucugguccaucgggaacgcgagcuccacaagcaggggaaaugcgccacaugcguguauaauaugaugggaaagagagagaaaaagcugggcgaguuugggaaggcgaaaggcagccgggcuauuugguacauguggcugggagcccgcuuccucgaguucgaggcccugggcuuuaugaacgaggaccauugguucucuagagaaaauagccuuuccgggguugagggagaaggccugcacaagcucggguacauccugcgggauaucucuaaaauucccggaggcaacauguaugcugacgauaccgccgggugggacacgcgcaucacagaggaugaccuucagaaugaggcuaagauuaccgaaaucauggagccugaacaugcccugcucgcgacaagcauuuuuaaacugaccuaccagaacaagguggucagagugcaacggcccgccaaaaacggcacggucauggaugugaucucccgcagagaccagcggggaucuggccagguugggaccuauggacugaauacauucaccaacauggaggugcagcucaucagacaaauggaaagcgaggagauuuuucugccguccgaacuugagacaccuaaucuggcugaacgcguccucgauuggcuggagaagcacggcgccgaacggcuuaagagaauggcuaucucuggggacgacuguguggugaaacccauugaugaccgcuucgccaccgcgcugacagcccucaacgauaugggaaagguucggaaagacaucccucagugggagcccagcaagggcuggaaugauuggcaacaggugccuuuuugcucccaccauuuccaccaacugauuaugaaagacgggagagagaucgucgugcccugucgcaaccaggaugaacugguuggccgggcuagagugagccagggagccggcuggucucuccgcgagaccgcuugccuggggaaguccuacgcccaaauguggcagcuuauguauuuucaucggagagaccugcgccucgcugccaaugcgaucuguagcgccgucccgguggauugggucccuacgucucggacaaccugguccauucacgcucaccaucaguggaugaccacagaagacaugcugagcguguggaacagaguuuggaucgaggaaaaucccuggauggaggauaagacccacguguccucuugggaggaaguccccuaccuuggaaaacgggaggaccaguggugcggcagccugauugggcucacagccagagccacgugggcuaccaacauccaaguggccauuaaucagguucgccggcugaucggaaacgaaaauuaucuggacuacaugacauccaugaagagauucaaaaacgagagcgauccugagggcgcgcucugguga

SEQ ID NO: 18642 - RNA, 9879 nt, Artificial Sequence
  derived and/or modified CDS sequence (opt5) from DENV-1__KJ189325__SS-prME
agcgugaccaugcugcucaugcugcuucccaccgcccuggcuuuccaccucacgaccagaggcggggaaccucauaugaucgucuccaagcaggaacggggaaagucucugcuuuuuaagacaagcgccggcguuaacaugugcacccugauugcgauggaccucggggagcugugugaagauacaaugaccuacaagugcccccagaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccagaagggaaccaucuucauucugcuuaugcuggucacaccuagcauggcuaugcgcugcgugggcaucgggaacagagauuuuguugagggacucuccggcgccacguggguggacgucgugcuggagcacgggagcugugugaccacaauggcuaagaauaaacccacccuggauauugaacuccugaagacagaggucaccaacccugccauccuucggaaacugugcauugaagcgaagaucucuaauacgacaaccgacucccgcuguccgacccagggagaggccacacucguugaagaacaggaugcuaacuucgugugcagacggaccuuuguggaccgcggcuggggcaauggguguggacuguucggcaaagggagccuucugacaugcgccaaguuuaagugcgucacgaaacucgagggaaagauugugcaguacgaaaaccugaaauauucuguuaucgugaccguccacacaggcgaucaacaucagguggggaaugagaccacagaacacggaaccaucgcuacgauuacaccccaggccccuacauccgagauccagcugaccgacuacggcgcccucacacuggacuguagccccagaaccggccuugauuucaacgaaaugguucugcucacgaugaaggagaaaucuuggcuggugcauaagcaaugguuucuugaccugccucuccccuggacauccggggcuagcaccucccaggagacauggaaucggcaggaucugcuggucaccuucaaaaccgcgcacgccaagaagcaagaaguggucgugcucggaucucaggagggcgcuaugcacacagcccugacgggggccaccgaaauucagacaagcggaaccacaaccaucuuugcuggccaucuuaaaugccgccugaagauggacaaacucacgcugaaggggacauccuauguuauguguaccggcagcuucaaacuggagaaggaaguggccgagacccagcacggaacaguccuugugcaaguuaaguacgagggcaccgaugcgccgugcaaaauuccuuucucuacacaggacgaaaagggggugacgcagaacggaagacucaucaccgcuaaucccaucgucacagauaaagagaagccugugaacauugaaaccgagccgcccuuuggcgaguccuauaucgugguuggggccggagaaaaagcccugaagcugagcugguucaagaaaggcucuagcauugggaagauguuugaggcuacagcccggggcgcuagacgcauggccauccucggagacaccgcgugggauuucggcuccauugggggagucuuuacgucugugggcaaacuggugcaucaggucuucgggaccgccuacggagugcuuuuuagcggcguuuccuggacaaugaagaucgggaucggcauucugcucaccuggcugggacugaauagccggucuacaucccuuagcaugaccuguaucgcugugggcauggucacacucuaccugggggugaugguucaagccgacucuggaugcgugauuaacuggaaaggcagagaacugaaguguggguccggaaucuucgucaccaacgaggugcacacguggacagaacaguauaaguuucaggcugauagcccuaaacgccucuccgccgcgauuggcaaggccugggaggaggggguuugcggcauccggucugcuaccagacuggaaaauauuauguggaaacagaucagcaacgagcuuaaucauauccugcucgaaaacgacaugaaguucaccguggucgugggagacgccaauggcauucuggcucaagggaaaaagaugauccgcccgcagcccauggagcacaaauacuccuggaagucuuggggaaaggccaaaauuaucggcgccgauauucagaacacaaccuuuaucaucgacgggccugauacgcccgaauguccugacaaucagcgggcuuggaacauuugggagguggaggauuauggauucggcaucuuuacaaccaauauuuggcugaaacuuagagacagcuacacacaaaugugcgaucaccgccucauguccgcggccaucaaagacagcaaggcuguccaugccgauaugggcuauuggauugaaucugagaaaaacgaaaccuggaagcuggcccgggcuuccuucaucgagguuaagacauguaccuggcccaaaagccacacgcuguggucuaauggggugcucgaauccgagaugaucauuccgaagaucuacggaggcccuauuagccagcauaacuauagacccggguacuucacccagacagccggaccuuggcaccugggcaaacuugagcuggacuuugaucucugcgaagggaccacaguggucguggacgagcacugcggaaaucgcggccccucucugcggaccacgacaguuaccggcaagaucauucaugaaugguguugcagaagcuguacacugccuccccuucgguuccgcggggaggauggaugcugguacggcauggagaucagaccggugaaagaaaaggaggaaaaccucguccgguccauggugagcgcggggucuggagagguugacuccuuuagccugggcauccugugugcuuccauuaugaucgaagaggugaugagaucucgcuggagccggaagaugcucaugaccgggacccuggccgucuuccuucugcucgugaugggacaacugacauggaaugaccugauuagacuuugcaucaugguuggcgccaacgcuuccgaucgcaugggcauggggacgaccuaucuggcccucauggcgacauuuaaaaugagaccuauguucgcugugggacugcucuuucggcgccugaccucuagagagguccuucugcucacaauuggccugagccugguggccuccguggaacuucccaacucucuggaggaacucggggacggacuggccaugggcaucaugaugcucaagcugcuuaccgaguuccagccccaccagcuguggauuacgcuccugagccugacauuuaucaaaaccacccuuucccuggauuacgcuuggaagacaaccgccauggcucucagcaucgucucucuguucccucucugucuguccacaacgagccagaaaaccacauggcuuccgguucugcuggggucuuuuggaugcaagccccucaccauguuccugauuacagaaaauaagaucuggggccggaaauccuggccucuuaacgagggcauuauggccaucgggauugugagcauccugcucucuucccugcucaagaaugacgugccccuggcgggaccucuuaucgccggcgggaugcugauugcuuguuaugucaucagcggauccagcgccgaucugucucucgagaaagcugccgaagugagcugggagcaagaagccgagcauuccggcaccucucacaacauucugguugaagugcaggacgaugggacgaugaagaucaaagacgaggagcgcgaugacacccuuacaauucugcucaaggcuacccugcucgcggucagcggaguguaccccauguccaucccugccacacuguuuguuugguauuucuggcagaaaaagaagcagagaucuggcgugcuuugggauacccccagcccgccugaagucgagcgggcugugcuggacgauggcaucuaccgcauucugcaaagagggcuccugggacggucccaggucggcguggggguuuuccaggacggaguguuucauacaauguggcacgucacgcgcggcgccgugcuuauguaucaggggaaaagacuggaacccucuugggccagcguuaagaaagaccucaucuccuacggaggcggcuggcgguuccaagggagcuggaauaccggagaggaggugcaggucauugcuguggaaccuggcaagaaccccaaaaaugugcagacaaugccggggaccuuuaagaccccugagggagaaguuggcgccaucgcgcuggauuucaagcccgggacaucuggauccccuauugucaacagagagggcaaaaucgugggccucuacgggaauggaguggucacgaccagcggcacauaugugucugcuauugcccaagccaaggcuucccaggaagggccccugcccgagaucgaggacgaaguuuuuaaaaagcgcaaccuuaccaucauggaucugcacccuggaagcggcaaaacacggagauaccugccggccauggugcgcgaggcgauuaagcggaagcucagaacccugauccuugcucccacgcgcgucguggccuccgaaauggccgaggcucugaaagggaugccuauucgguaucagacaaccgccguuaagucugaacauaccggcagagagaucguggaccucaugugccacgcuacauucaccaugcgccugcugagccccguccgggugccuaauuacaacaugauuaucauggaugaggcccauuuuacagaccccgcguccaucgccgcuagaggauauauuagcacccggguuggcaugggggaagccgcugccaucuucaugacggccacaccuccgggaucuguggaggcuuuuccccaguccaaugcggucauucaagaugaagaacgcgacaucccugaaagaagcuggaacucuggcuacgauuggauuaccgacuuccccgggaaaacagugugguuugugccuagcaucaaguccggaaaugauaucgccaacugucuccggaaaaacggcaagcgcgucauucagcuuucuagaaagaccuucgacacggaguaucagaaaaccaagaauaacgacugggauuacguugugacaaccgacaucagcgagaugggggcuaauuuccgggccgauagagugauugacccccgccggugccugaaaccggucauccugaaggauggcccugaaagagugauucucgccggacccaugcccguuacaguggcuuccgccgcgcagcgccggggcagaaucgggcgcaaccaaaauaaagagggagaccaguacgucuauaugggccagccucugaacaaugaugaagaccacgcucauuggaccgaggccaagaugcuucuggauaacauuaauacacccgaggggaucaucccugcccucuuugaaccggagcgggaaaagucugcugccauugacggagaguacagacugcgcggcgaagcgagaaaaaccuucguggagcugaugcggcgcggggaucuccccguuuggcuuagcuauaagguggccuccgagggcuuucaguacagcgacagacgguggugcuucgauggagaacgcaacaaucaaguccuggaggaaaacauggacguggagaucuggacgaaagaaggcgagagaaagaaacugcggccuagauggcucgacgcucgcacauauucugauccccuggcccuucgggaguuuaaggaguucgcugccgggagacgcuccgucagcggagaccugauucucgagaucggcaaacugccucagcaccugacccuccgggcucagaaugcccuugauaaccuggugaugcugcacaauuccgaacaagggggaaaggcguacagacaugccauggaggaacuccccgacaccauugagacacugaugcuucuggcucucaucgccguucugaccggcggcgugacacuguuuuuccucucugggaagggacuuggcaaaacgagcaucgggcugcugugugugaccgcuuccucugcccuccuguggauggccagcgucgagccgcacuggauugcugcguccaucauucuugaauuuuuccugaugguucuccugaucccugagcccgaucggcaacgcacaccucaggacaaccagcuggccuauguggugauuggacuccuuuuuaugauccugaccgucgcugccaacgaaaugggccugcucgagacaaccaagaaagaucuggggaucggacauguggccgcugagaaucaccaacacgccacgaugcuugacguugaucugagacccgcgagcgccuggacccucuacgcuguggccacaaccgucauuacaccuaugaugcggcauaccaucgaaaacacgacagcuaauauuucucugaccgccaucgcgaaccaggccgcuauucugaugggccucgacaagggcuggcccaucuccaaaauggauauuggggugccgcuucuggcccugggaugcuacagccaggucaauccucucacacugaccgcugccgugcuuaugcugguugcucacuaugccaucaucggccccgggcuccaggcgaaggccacccgcgaggcucaaaagagaacagccgcuggaauuaugaaaaaccccacgguggacggcaucgucgccauugaucuggacccugugguuuacgacgccaaguucgaaaaacagcuggggcagaucaugcuccuuauucuguguaccucucagauccugcucaugcggacaaccugggcgcugugcgaguccaucacacuugcuaccggaccgcugacgacacucugggaaggcagccccggcaaguuuuggaauaccaccauugccgugucuauggcuaacaucuuccgcgggagcuaucuggccggagccggccuggcuuucucccucaugaaaucucuugggggaggcagacgggggacaggagcccaaggcgagacccugggcgagaaguggaagcgccagcugaaucagcucagcaaauccgaauuuaacacauacaagagaagcgggauuauggaggucgaucgguccgaagcgaaagagggacugaagagaggcgaaacgaccaaacaugccgugucucgcgggacagcuaaacuucggugguucguggagagaaaucugguuaagccugagggaaaagucaucgaccucggcugugggcgcggaggcuggagcuauuacugcgccggccugaagaaagugaccgaagugaagggguauacaaaaggaggccccgggcacgaggaaccuauucccauggcuaccuacggauggaaccuggucaagcuccauuccggcaaagauguguuuuucaugccuccggagaagugugacacgcuucugugcgauaucggggaaucuagccccaauccuaccaucgaggagggacggacacugagaguucucaagaugguggaacccuggcugcgcggcaaccaguuuuguauuaaaauccuuaauccuuacaugcccuccgucguggagacccuggaacaaaugcagcggaagcacggcgggaugcucguuagaaacccgcugucucgcaauagcacacacgagauguauuggguguccugcggaaccggcaacauugucagcgccgugaacaugacaucucggaugcugcucaauagauucaccauggcgcaucgcaaaccuacguacgagcgggacguugaucugggggccggaacaagacacguggcugucgaacccgagguggccaaccuugacaucauuggccagcgcaucgaaaauauuaagaacgagcauaaauccaccuggcacuaugaugaagacaaucccuacaagaccugggcuuaucacgggagcuacgaggugaagccuucuggauccgccagcucuauggucaacggcguugugagacugcucacaaaacccugggaugugaucccuauggucacgcaaaucgcuaugaccgacacaaccccguuuggccagcagcggguguucaaggagaaaguugacacacgcacccccagagccaagcgggggacaacccagauuauggaagugacggcgaaauggcuguggggauuucuuuccagaaauaagaagccucggaucuguacccgcgaggaguucacaagaaaaguccggagcaacgccgcuauuggcgccguguuuguugaugagaaucaauggaacuccgcuaaggaagccguggaggacgagcgcuucugggaucugguccauagagaacgggagcuccacaaacaggggaagugcgcuaccugcguguauaauaugaugggaaaacgcgaaaagaagcugggcgaguuugggaaagcgaagggcagcagagcuaucugguacauguggcugggagcccgguuccucgaguucgaggcccugggcuuuaugaacgaggaccauugguucucucgcgaaaauagccuuuccgggguugagggagaaggccugcacaaacucggguacauucugagagauaucucuaagauccccggaggcaacauguaugcugacgauacagccgggugggacacccggauuacggaggaugaccuucagaaugaggcuaaaaucacagaaauuauggagccugaacaugcccugcucgcgaccagcaucuuuaagcugacauaccagaacaaagugguccgcgugcaaagacccgccaagaacggcaccgucauggaugugauuucccggcgcgaccagagaggaucuggccagguugggacguauggacugaauaccuucacaaacauggaggugcagcucauccggcaaauggaaagcgagggcaucuuucugccguccgagcuugaaaccccuaaucuggcugagagaguccucgauuggcuggaaaagcacggggccgagcgccuuaaacggauggcuauuucuggagacgacuguguggugaagcccaucgaugacagauucgccacagcgcugaccgcccucaacgauaugggcaaaguucgcaaggacauuccucagugggaacccagcaaaggguggaaugauuggcaacaggugccuuuuugcucccaccauuuccaccaacugaucaugaaggacggccgggagauugucgugcccuguagaaaccaggaugagcugguuggacgcgcucgggugagccagggcgccggguggucucucagagaaacagcuugccugggaaaguccuacgcccaaauguggcagcuuauguauuuucaucgccgggaccugagacucgcugccaaugcgaucuguagcgccgucccgguggauugggucccuaccucucgcacgacaugguccauccacgcucaccaucaguggaugaccaccgaggacaugcugagcguguggaaccggguuuggauugaagagaaucccuggauggaagauaaaacacacguguccucuugggaggagguccccuaccuuggcaagagagaagaccaguggugcgggagccugaucggacucaccgcccgggccacaugggcuacgaacauucaaguggccaucaaucagguuagacgccugauuggcaacgagaauuaucuggacuacaugaccuccaugaaacgguucaagaacgaaagcgauccugagggggcgcucugguga

SEQ ID NO: 18643 - RNA, 9879 nt, Artificial Sequence
  derived and/or modified CDS sequence (opt5) from DENV-1__KJ189326__SS-prME
agcgugaccaugcugcugaugcugcuucccaccgcccuggcuuuccaccucacgaccagaggcggggaaccucauaugaucgucuccaagcaggaacggggaaagucucugcuuuuuaagacaagcgccggcguuaacaugugcacccugauugcgauggaccucggggagcugugugaagauacaaugaccuacaagugcccccagaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccagaagggaaccaucuucauucugcuuaugcuggucacaccuagcauggcuaugcgcugcgugggcaucgggaacagagauuuuguugagggacucuccggcgccacguggguggacgucgugcuggagcacgggagcugugugaccacaauggcuaagaauaaacccacccuggauauugaacuccugaagacagaggucaccaacccugccauccuucggaaacugugcauugaagcgaagaucucuaauacgacaaccgacucccgcuguccgacccagggagaggccacacucguugaagaacaggaugcuaacuucgugugcagacggaccuuuguggaccgcggcuggggcaauggguguggacuguucggcaaagggagccuucugacaugcgccaaguuuaagugcgucacgaaacucgagggaaagauugugcaguacgaaaaccugaaauauucuguuaucgugaccguccacacaggcgaucaacaucagguggggaaugagaccacagaacacggaaccaucgcuacgauuacaccccaggccccuacauccgagauccagcugaccgacuacggcgcccucacacuggacuguagccccagaaccggccuugauuucaacgaaaugguucugcucacgaugaaggagaaaucuuggcuggugcauaagcaaugguuucuugaccugccucuccccuggacauccggggcuagcaccucccaggagacauggaaucggcaggaucugcuggucaccuucaaaaccgcgcacgccaagaagcaagaaguggucgugcucggaucucaggagggcgcuaugcacacagcccugacgggggccaccgaaauucagacaagcggaaccacaaccaucuuugcuggccaucuuaaaugccgccugaagauggacaaacucacgcugaaggggacauccuauguuauguguaccggcagcuucaaacuggagaaggaaguggccgagacccagcacggaacaguccuugugcaaguuaaguacgagggcaccgaugcgccgugcaaaauuccuuucucuacacaggacgaaaagggggugacgcagaacggaagacucaucaccgcuaaucccaucgucacagauaaagagaagccugugaacauugaaaccgagccgcccuuuggcgaguccuauaucgugguuggggccggagaaaaagcccugaagcugagcugguucaagaaaggcucuagcauugggaagauguuugaggcuacagcccggggcgcuagacgcauggccauccucggagacaccgcgugggauuucggcuccauugggggagucuuuacgucugugggcaaacuggugcaucaggucuucgggaccgccuacggagugcuuuuuagcggcguuuccuggacaaugaagaucgggaucggcauucugcucaccuggcugggacugaauagccggucuacaucccuuagcaugaccuguaucgcugugggcauggucacacucuaccugggggugaugguucaagccgacucuggaugcgugauuaacuggaaaggcagagaacugaaguguggguccggaaucuucgucaccaacgaggugcacacguggacagaacaguauaaguuucaggcugauagcccuaaacgccucuccgccgcgauuggcaaggccugggaggaggggguuugcggcauccggucugcuaccagacuggaaaauauuauguggaaacagaucagcaacgagcuuaaucauauccugcucgaaaacgacaugaaguucaccguggucgugggagacgccaauggcauucuggcucaagggaaaaagaugauccgcccgcagcccauggagcacaaauacuccuggaagucuuggggaaaggccaaaauuaucggcgccgauauucagaacacaaccuuuaucaucgacgggccugauacgcccgaauguccugacaaucagcgggcuuggaacauuugggagguggaggauuauggauucggcaucuuuacaaccaauauuuggcugaaacuuagagacagcuacacacaaaugugcgaucaccgccucauguccgcggccaucaaagacagcaaggcuguccaugccgauaugggcuauuggauugaaucugagaaaaacgaaaccuggaagcuggcccgggcuuccuucaucgagguuaagacauguaccuggcccaaaagccacacgcuguggucuaauggggugcucgaauccgagaugaucauuccgaagaucuacggaggcccuauuagccagcauaacuauagacccggguacuucacccagacagccggaccuuggcaccugggcaaacuugagcuggacuuugaucucugcgaagggaccacaguggucguggacgagcacugcggaaaucgcggccccucucugcggaccacgacaguuaccggcaagaucauucaugaaugguguugcagaagcuguacacugccuccccuucgguuccgcggggaggauggaugcugguacggcauggagaucagaccggugaaagaaaaggaggaaaaccucguccgguccauggugagcgcggggucuggagagguugacuccuuuagccugggcauccugugugcuuccauuaugaucgaagaggugaugagaucucgcuggagccggaagaugcucaugaccgggacccuggccgucuuccuucugcucgugaugggacaacugacauggaaugaccugauuagacuuugcaucaugguuggcgccaacgcuuccgaucgcaugggcauggggacgaccuaucuggcccucauggcgacauuuaaaaugagaccuauguucgcugugggacugcucuuucggcgccugaccucuagagagguccuucugcucacaauuggccugagccugguggccuccguggaacuucccaacucucuggaggaacucggggacggacuggccaugggcaucaugaugcucaagcugcuuaccgaguuccagccccaccagcuguggacgacacuccugagccugaccuuuauuaaaaccacacuuucccuggauuacgcuuggaagaccacagccauggcucucagcaucgucucucuguucccucucugucuguccacgaccagccagaaaacaaccuggcuuccgguucugcuggggucuuuuggaugcaagccccucacaauguuccugaucaccgaaaauaagauuuggggccggaaauccuggccucuuaacgagggcaucauggccauugggaucgugagcauucugcucucuucccugcucaagaaugacgugccccuggcgggaccucuuaucgccggcgggaugcugaucgcuuguuaugucauuagcggauccagcgccgaucugucucucgagaaagcugccgaagugagcugggagcaagaagccgagcauuccggcacgucucacaacauccugguugaagugcaggacgaugggaccaugaagauuaaagacgaggagcgcgaugacacacuuaccauccugcucaaggcuacacugcucgcggucagcggaguguaccccauguccauuccugccacccuguuuguuugguauuucuggcagaaaaagaagcagagaucuggcgugcuuugggauacacccagcccgccugaagucgagcgggcugugcuggacgauggcaucuaccgcauccugcaaagagggcuccugggacggucccaggucggcguggggguuuuccaggacggaguguuucauacgauguggcacgucacccgcggcgccgugcuuauguaucaggggaaaagacuggaacccucuugggccagcguuaagaaagaccucauuuccuacggaggcggcuggcgguuccaagggcuguggaauacaggagaggaggugcaggucaucgcuguggaaccuggcaagaaccccaaaaaugugcagaccaccccggggacauuuaagacgccugagggagaaguuggcgccauugcgcucgauuucaagcccgggaccagcggaucuccuaucgucaacagagagggcaaaauugugggccuguacgggaauggaguggucacaaccuccggcacauaugugagcgcuaucgcccaagccaaggcuucucaggaagggccccuucccgagauugaggacgaaguuuuuaaaaagcgcaaccugaccaucauggaucugcacccuggauccggcaaaacgcggagauaccucccggccauggugcgcgaggcgaucaagcggaagcugagaacacuuauucuggcucccacccgcgucguggccagcgaaauggccgaggcucucaaagggaugccuauccgguaucagaccacagccguuaaguccgaacauaccggcagagagauuguggaccugaugugccacgcuacauucaccaugcgccugcucucucccguccgggugccuaauuacaacaugaucauuauggaugaggcccauuuuacggaccccgcgagcaucgccgcuagaggauauaucuccacacggguuggcaugggggaagccgcugccauuuucaugaccgccacaccuccgggaagcguggaggcuuuuccccagucuaaugcggucauccaagaugaagaacgcgacauuccugaaagauccuggaacagcggcuacgauuggaucaccgacuuccccgggaaaacggugugguuugugccuucuauuaagagcggaaaugauaucgccaacugucuucggaaaaacggcaagcgcgucauccagcuguccagaaagaccuucgacacagaguaucagaaaaccaagaauaacgacugggauuacguugugacaaccgacauuucugagaugggggcuaauuuccgggccgauagagugaucgacccccgccggugccugaaaccggucauucucaaggauggcccugaaagagugauccuggccggacccaugcccguuacaguggcuagcgccgcgcagcgccggggcagaauugggcgcaaccaaaauaaagagggagaccaguacgucuauaugggccagccucuuaacaaugaugaagaccacgcucauuggaccgaggccaagaugcugcucgauaacaucaauacgcccgaggggauuaucccugcccuguuugaaccggagcgggaaaaguccgcugccaucgacggagaguacagacugcgcggcgaagcgagaaaaacauucguggagcucaugcggcgcggggaucuucccguuuggcugucuuauaagguggccagcgagggcuuucaguacuccgacagacgguggugcuucgauggagaacgcaacaaucaaguccuggaggaaaacauggacguggagauuuggaccaaagaaggcgagagaaagaaacuccggccuagauggcuggacgcucgcaccuauagcgauccccuugcccugcgggaguuuaaggaguucgcugccgggagacgcucugucuccggagaccucauccuggagauuggcaaacugccucagcaccucacacuucgggcucagaaugcccuggauaaccuggugaugcuccacaauagcgaacaagggggaaaggcguacagacaugccauggaggaacugcccgacaccaucgagacacuuaugcugcucgcucugauugccguucugacgggcggcgugacccucuuuuuccuuuccgggaagggacugggcaaaacaucuaucgggcugcucugugugaccgcuagcuccgcccugcuuuggauggccucugucgagccgcacuggaucgcugcgagcauuauccuggaauuuuuccucaugguucugcugauuccugagcccgaucggcaacgcacaccucaggacaaccagcucgccuauguggugaucggacuucuguuuaugauucugaccgucgcugccaacgaaaugggccuccuggagacgaccaagaaagaucuugggaucggacauguggccgcugagaaucaccaacacgccacaaugcuggacguugaucucagacccgcguccgccuggacccuguacgcuguggccacaaccgucaucacgccuaugaugcggcauacaauugaaaacaccacagcuaauaucagccugaccgccauugcgaaccaggccgcuauccucaugggccuugacaagggcuggcccauuucuaaaauggauaucggggugccgcugcuggcccucggaugcuacucccaggucaauccucugacccuuacagcugccgugcugaugcucguugcucacuaugccauuaucggccccgggcugcaggcgaaggccacgcgcgaggcucaaaagagaaccgccgcuggaaucaugaaaaaccccacaguggacggcauugucgccaucgaucuggacccugugguuuacgacgccaaguucgaaaaacagcucgggcagauuaugcuucugauccuguguaccagccagauucuccugaugcggacaaccugggcgcuuugcgagucuaucacgcuggcuacaggaccgcucaccacccugugggaaggcucccccggcaaguuuuggaauacaaccaucgccgugagcauggcuaacauuuuccgcgggucuuaucuggccggagccggccucgcuuucagccuuaugaaaucccucgggggaggcagacgggggacaggagcccaaggcgagacgcugggcgagaaguggaagcgccagcucaaucagcugucuaaaagcgaauuuaacaccuacaagagauccgggaucauggaggucgaucggagcgaagcgaaagagggacuuaagagaggcgaaacaaccaaacaugccgugucccgcgggacagcuaagcugcggugguucguggagagaaaucucguuaagccugagggaaaagucauugaccugggcugugggcgcggaggcuggucuuauuacugcgccggccugaagaaagugaccgaagugaagggguauacgaaaggaggccccgggcacgaggaaccuauccccauggcuaccuacggauggaaccucgucaaacuucauagcggcaaagauguguuuuucaugccuccggagaagugugacacacugcugugcgauauuggggaauccucucccaauccuaccaucgaggagggacggacacucagaguucugaagaugguggaacccuggcuucgcggcaaccaguuuuguaucaaaauucugaauccuuacaugcccagcgucguggagacccucgaacaaaugcagcggaagcacggcgggaugcugguuagaaacccgcugucccgcaauucuacacacgagauguauugggugagcugcggaaccggcaacaucgucuccgccgugaacaugacgagccggaugcuccugaauagauucacaauggcgcaucgcaaaccuaccuacgagcgggacguugaucuuggggccggaaccagacacguggcugucgaacccgagguggccaaccuggacauuaucggccagcgcauugaaaauaucaagaacgagcauaaaucuacauggcacuaugaugaagacaaucccuacaagacgugggcuuaucacggguccuacgaggugaagccuagcggaucugccuccagcauggucaacggcguugugagacuccugaccaaacccugggaugugauuccuauggucacacaaaucgcuaugaccgacacaaccccguuuggccagcagcggguguucaaggagaaaguugacacacgcacccccagagccaagcgggggacgacccagaucauggaagugacagcgaaauggcuuuggggauuucugucuagaaauaagaagccucggauuuguacccgcgaggaguucacaagaaaaguccgguccaacgccgcuaucggcgccguguuuguugaugagaaucaauggaacagcgcuaaggaagccguggaggacgagcgcuucugggaucucguccauagagaacgggagcugcacaaacaggggaagugcgcuaccugcguguauaauaugaugggaaaacgcgaaaagaagcugggcgaguuugggaaagcgaagggcuccagagcuauuugguacauguggcucggagcccgguuccuggaguucgaggcccuuggcuuuaugaacgaggaccauugguucagccgcgaaaauucucugagcgggguugagggagaaggccuccacaaacugggguacauccuuagagauauuuccaagauccccggaggcaacauguaugcugacgauacggccgggugggacacacggaucaccgaggaugaccugcagaaugaggcuaaaauuacagaaaucauggagccugaacaugcccuccuggcgaccucuauuuuuaagcugacguaccagaacaaagugguccgcgugcaaagacccgccaagaacggcaccgucauggaugugaucagccggcgcgaccagagaggauccggccagguugggacauauggacucaauaccuucacaaacauggaggugcagcugauucggcaaauggaaucugagggcaucuuucuuccgagcgagcuggaaaccccuaaucucgcugagagaguccuggauuggcuugaaaagcacggggccgagcgccugaaacggauggcuaucuccggagacgacuguguggugaagcccauugaugacagauucgccacagcgcucaccgcccugaacgauaugggcaaaguucgcaaggacaucccucagugggaacccucuaaaggguggaaugauuggcaacaggugccuuuuugcagccaccauuuccaccaacugauuaugaaggacggccgggagaucgucgugcccuguagaaaccaggaugagcucguuggacgcgcucgggugucccagggcgccggguggagccugagagaaacggcuugccuuggaaagucuuacgcccaaauguggcagcugauguauuuucaucgccgggaccucagacuggcugccaaugcgauuuguuccgccgucccgguggauugggucccuacaagccgcaccaccuggucuauccacgcucaccaucaguggaugacaaccgaggacaugcuuuccguguggaaccggguuuggaucgaagagaaucccuggauggaagauaaaacacacgugagcuccugggaggagguccccuaccugggcaagagagaagaccaguggugcgggucucucauuggacugacggcccgggccaccugggcuacaaacauccaaguggccauuaaucagguuagacgccugaucggcaacgagaauuaucucgacuacaugaccagcaugaaacgguucaagaacgaauccgauccugagggggcgcugugguga

SEQ ID NO: 18644 - RNA, 9879 nt, Artificial Sequence
  derived and/or modified CDS sequence (opt5) from DENV-1__KJ189327__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagagaagcggucugucgcccuggcuccucauguggggcucggacuggaaacacgcaccgagacguggaugagcuccgaaggcgccuggaaacagauucagagaguugagacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagacuuuguugagggacucuccggcgccacauggguggaugucgugcuggaacacgggagcugugugacgaccauggcuaagaauaaacccacacuggacaucgagcuccugaagaccgaagucacaaacccugccauucuucggaaacugugcaucgaggcgaagauuucuaauaccacgacagauucccgcuguccgacccagggagaagccacccucguugaggagcaggacgcuaacuucgugugcagacggacauuuguggaucgcggcuggggcaauggguguggacuguucggcaaagggagccuucugaccugcgccaaguuuaagugcgucacaaaacucgaaggaaagaucgugcaguacgagaaccugaaauauucuguuaucgugacgguccacaccggcgaccaacaucagguggggaaugaaacaaccgagcacggaacaauugcuaccaucacgccccaggccccuaccuccgaaauucagcugacagauuacggcgcccucacccuggacuguagccccagaacaggccuugacuucaacgagaugguucugcucaccaugaaggagaaaucuuggcuggugcauaagcaaugguuucuugaucugccucuccccuggacguccggggcuagcacaucccaggaaaccuggaaucggcaggaccugcuggucacauucaaaaccgcgcacgccaagaagcaagagguggucgugcucggaucucaggaaggcgcuaugcacaccgcccugacaggggccacggagauccagaccagcggaacaaccacaauuuuugcuggccaucuuaaaugccgccugaagauggauaaacucacccugaaggggacguccuauguuauguguacaggcagcuucaaacuggaaaaggagguggccgagacccagcacggaaccguccuugugcaaguuaaguacgaaggcacagacgcgccgugcaaaaucccuuucucuacccaggaugagaagggggugacacagaacggaagacucaucacggcuaaucccauugucaccgacaaagaaaagccugugaacaucgagacagagccccccuuuggcgaauccuauauugugguuggggccggagagaaagcccugaagcugagcugguucaagaaaggcucuagcaucgggaagauguuugaagcuaccgcccggggcgcuagacgcauggccauucucggagauacagcgugggacuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgauucuggaugcgugaucaacuggaaaggcagagagcugaaguguggguccggaauuuucgucacaaacgaagugcacaccuggacggagcaguauaaguuucaggcugacagcccuaaacgccucuccgccgcgaucggcaaggccugggaggaagggguuugcggcauucggucugcuacaagacuggagaauaucauguggaaacagaucagcaacgaacuuaaucauauucugcucgagaacgauaugaaguucaccguggucgugggagacgccaauggcauccuggcucaagggaaaaagaugauucgcccgcagcccauggaacacaaauacuccuggaagucuuggggaaaggccaaaaucauuggcgccgacacccagaacacaaccuuuaucaucgaugggccugacacgcccgaguguccugauaaucagcgggcuuggaacauuugggagguggaagacuauggauucggcaucuuuacaaccaauauuuggcugaagcuuagagauagcuacacacaaaugugcgaccaccgccucauguccgcggccaucaaagauagcaaggcuguccaugccgacaugggcuauuggauugagucugaaaaaaacgagaccuggaagcuggcccgggcuuccuucaucgaaguuaagacauguaccuggcccaaaagccacacgcuguggucuaauggggugcucgaguccgagaugaucauuccgaagaucuacggaggcccuauuagccagcauaacuauagacccggguacuucacccagacagccggaccuuggcaccugggcaaacuugaacuggauuuugaccucugcgaggggaccacaguggucguggaugaacacugcggaaaucgcggccccucucugcggaccacgacaguuaccggcaagaucauucaugagugguguugcagaagcuguacacugccuccccuucgguuccgcggggaggacggaugcugguacggcauggaaaucagaccggugaaagagaaggaagagaaccucguccgguccauggugagcgcggggucuggagaaguugauuccuuuagccugggcauccugugugcuuccauuaugaucgaggaggugaugagaucucgcuggagccggaagaugcucaugaccgggacccuggccgucuuccuucugcucauuaugggacaacugacauggaaugaccugaucagacuuugcauuauggugggcgccaacgcuuccgaccgcaugggcauggggacgaccuaucuggcccucauggcgacauuuaaaaugagaccuauguucgcuguuggacugcucuuucggcgccugaccucuagagaagugcuucugcucacaaucggccugagccuggucgccuccguggagcuucccaacucucuggaagagcucggggauggacuggccaugggcauuaugaugcucaagcugcuuaccgaauuccagccccaccagcuguggacgacacuccugagccugaccuuuaucaaaaccacacuuucccuggacuacgcuuggaagaccacagccauggcucucagcaucgugucucuguucccucucugucuguccacgaccagccagaaaacaaccuggcuuccgguccugcuggggucuuuuggaugcaagccccucacaauguuccugauuaccgagaauaagaucuggggccggaaauccuggccucuuaacgagggcauuauggccaucgggauuguuagcauccugcucucuucccugcucaagaaugaugugccccuggcgggaccucuuaucgccggcgggaugcugauugcuuguuaugugaucagcggauccagcgccgaccugucucucgaaaaagcugccgaggucagcugggaacaagaggccgaacauuccggcacgucucacaacauucugguggagguucaggaugacgggaccaugaagaucaaagaugaggaacgcgacgauacacuuaccauucugcucaaggcuacacugcucgcggugagcggagucuaccccauguccaucccugccacccuguuugugugguauuucuggcagaaaaagaagcagagaucuggcguucuuugggacacacccagcccgccugagguggaacgggcuguccuggaugacggcaucuaccgcauucugcaaagagggcuccugggacggucccaggugggcgucgggguguuccaggauggaguuuuucauacgauguggcacgugacccgcggcgccguccuuauguaucaggggaaaagacuggagcccucuugggccagcgugaagaaagaccucaucuccuacggaggcggcuggcgguuccaagggagcuggaauacaggagaggaaguucaggugauugcugucgagccuggcaagaaccccaaaaaugugcagaccaccccggggacauuuaagacgccugaaggagaggugggcgccaucgcgcuggacuucaagcccgggaccucuggauccccuauuguuaacagagaaggcaaaaucgucggccucuacgggaauggaguggugacaaccagcggcacauaugucucugcuauugcccaagccaaggcuucccaggaggggccccugcccgagaucgaagaugagguguuuaaaaagcgcaaccuuaccaucauggaccugcacccuggaagcggcaaaacgcggagauaccugccggccauuguucgcgaagcgaucaagcggaagcucagaacacugauucuugcucccacccgcguggucgccuccgagauggccgaagcucugaaagggaugccuauccgguaucagaccacagccgugaagucugagcauaccggcagagagauuguugaucucaugugccacgcuacauucaccaugcgccugcugagccccgugcgggucccuaauuacaacaugaucaucauggacgaagcccauuuuacggaucccgcguccauugccgcuagaggauauaucagcacacgggugggcaugggggaggccgcugccauuuucaugaccgccacaccuccgggaucuguugaagcuuuuccccaguccaaugcggugauccaagacgaggaacgcgauauuccugagagaagcuggaacucuggcuacgacuggaucaccgauuuccccgggaaaacggucugguuugugccuagcaucaaguccggaaaugacauugccaacugucuccggaaaaacggcaagcgcgugauccagcuuucuagaaagaccuucgauacagaguaucagaaaaccaagaauaacgacugggacuacgucguuacaaccgauauuagcgaaaugggggcuaauuuccgggccgacagagugaucgauccccgccggugccugaaaccggugauucugaaggacggcccugagagagucauccucgccggacccaugcccgugacaguugcuuccgccgcgcagcgccggggcagaauugggcgcaaccaaaauaaagaaggagaucaguacguguauaugggccagccucugaacaaugacgaggaucacgcucauuggaccgaggccaagaugcuucuggacaacaucaauacgcccgaagggaucauuccugcccucuuugagccggaacgggagaagucugcugccaucgauggagaauacagacugcgcggcgaggcgagaaaaacauucgucgagcugaugcggcgcggggaccuccccguguggcuuagcuauaagguugccuccgaaggcuuucaguacagcgauagacgguggugcuucgacggagagcgcaacaaucaagugcuggaagagaacauggaugucgaaauuuggaccaaagagggcgagagaaagaaacugcggccuagauggcucgacgcucgcaccuauucugacccccuggcccuucgggaauuuaaggaguucgcugccgggagacgcuccgugagcggagaucugauccucgaaauuggcaaacugccucagcaccugacacuccgggcucagaaugcccuugacaaccuggucaugcugcacaauuccgagcaggggggaaaggcguacagacaugccauggaagagcuccccgauaccaucgagacacugaugcuucuggcucucaucgccgugcugacgggcggcguuacccuguuuuuccucucugggaagggacuuggcaaaacaagcauugggcugcugugugugaccgcuuccucugcccuccuguggauggccagcguggaaccgcacuggaucgcugcguccauuauccuugaguuuuuccugaugguccuccugauuccugaacccgaccggcaacgcacaccucaggauaaccagcuggccuauguugugaucggacuccuuuuuaugauccugaccguggcugccaacgagaugggccugcucgagacgaccaagaaagaccuggggauuggacaugucgccgcugaaaaucaccaacacgccacaaugcuugauguggaccugagacccgcgagcgccuggacccucuacgcuguugccacaaccgugaucacgccuaugaugcggcauacaauugagaacaccacagcuaauaucucucugaccgccauugcgaaccaggccgcuauccugaugggccucgauaagggcuggcccauuuccaaaauggacaucggggucccgcuucuggcccugggaugcuacagccaggugaauccucucacccugacagcugccguccuuaugcugguggcucacuaugccaucauuggccccgggcuccaggcgaaggccacgcgcgaagcucaaaagagaaccgccgcuggaaucaugaaaaaccccacaguugauggcauuguggccaucgaccuggauccugucguguacgacgccaaguucgagaaacagcuggggcagauuaugcuccuuauccuguguaccucucagauccugcucaugcggacaaccugggcgcugugcgaauccauuacgcuugcuacaggaccgcugaccacccucugggagggcagccccggcaaguuuuggaauacaaccaucgccguuucuauggcuaacauuuuccgcgggagcuaucuggccggagccggccuggcuuucucccucaugaaaucucuugggggaggcagacgggggacaggagcccaaggcgagacgcugggcgaaaaguggaagcgccagcugaaucagcucagcaaauccgaguuuaacaccuacaagagaagcgggaucauggaaguggaccgguccgaggcgaaagaaggacugaagagaggcgagacaaccaaacaugccgucucucgcgggacagcuaagcuucggugguucguggagagaaaucuggugaagccugaaggaaaaguuauugaucucggcugugggcgcggaggcuggagcuauuacugcgccggccugaagaaagucaccgaggugaagggguauacgaaaggaggccccgggcacgaagagccuauccccauggcuaccuacggauggaaccuggugaagcuccauuccggcaaagacgucuuuuucaugccuccggaaaagugugauacacuucugugcgacaucggggagucuagccccaauccuaccauugaggaaggacggacacugagaguucucaagaugguggagcccuggcugcgcggcaaccaguuuuguaucaaaauucuuaauccuuacaugcccuccguggucgaaacccuggagcaaaugcagcggaagcacggcgggaugcucgugagaaacccgcugucucgcaauagcacacacgagauguauuggguuuccugcggaaccggcaacaucgugagcgccgucaacaugacgucucggaugcugcucaauagauucacaauggcgcaucgcaaaccuaccuuugaacgggauguggaccugggggccggaaccagacacguugcuguggagcccgaagucgccaaccuugauauuaucggccagcgcauugagaauaucaagaacgaacauaaauccacauggcacuacgacgaggauaaucccuauaagacgugggcuuaccacgggagcuaugaggugaagccuucuggauccgccagcucuauggugaacggcgucguuagacugcucaccaaacccugggacgugaucccuauggugacacaaauugcuaugaccgauacaaccccguucggccagcagcgggucuuuaaggaaaaaguggacacacgcacccccagagccaagcgggggacgacccagaucauggagguuacagcgaaauggcuguggggauuccuuuccagaaauaagaagccucggauuuguacccgcgaagaguuuacaagaaaagugcggagcaacgccgcuaucggcgccgucuucguggacgaaaaucaauggaacuccgcuaaggaggccguugaggaugaacgcuuuugggaccuggugcauagagagcgggaacuccacaaacaggggaagugcgccaccugcgucuacaauaugaugggaaaacgcgagaagaagcugggcgaauucgggaaagcgaagggcagcagagcuauuugguauauguggcugggagcccgguuccucgaguuugaggcccugggcuucaugaacgaagaucauugguuuucucgcgagaauagccuuuccgggguggaaggagagggccugcacaaacucggguacauccugagagacaucucuaagauucccggaggcaacauguacgcugaugacacggccgggugggauacacggaucaccgaggacgaucuucagaaugaagcuaaaauuacagacaucauggagccugaacaugcccugcucgcgaccagcauuuucaagcugacguaucagaacaaaguugugcgcguccaaagacccgccaagaacggcaccgugauggaugucaucucccggcgcgaccagagaggaucuggccagguggggacauacggacugaauaccuuuacaaacauggagguucagcucauccggcaaauggaaagcgagggcauuuuccugccguccgagcuugaaaccccuaaucuggcugagagagugcucgauuggcuggaaaagcacggggccgagcgccuuaaacggauggcuaucucuggagacgacugugucgugaagcccauugaugacagauuugccacagcgcugaccgcccucaacgauaugggcaaagugcgcaaggacaucccucagugggaacccagcaaaggguggaaugauuggcagcagguuccuuucugcucccaccauuuucaccaacugauuaugaaggacggccgggagaucgugguccccuguagaaaccaggaugagcuggugggacgcgcucggguuagccagggcgccggguggucucucagagaaacggcuugccugggaaaguccuaugcccaaauguggcagcuuauguacuuccaucgccgggaccugagacucgcugccaaugcgaucuguagcgccgugccggucgauugggugccuacaucucgcaccaccugguccauucacgcucaccaucaguggaugacaaccgaggacaugcugagcgucuggaaccggguguggaucgaagagaaucccuggauggaagauaaaacacacguuuccucuugggaggaggugcccuaucuuggcaagagagaagaccaguggugcgggagccugauuggacucacggcccgggccaccugggcuacaaacauccaagucgccauuaaucaggugagacgccugaucggcaacgagaauuaccuggacuauaugaccuccaugaaacgguuuaagaacgaaagcgauccugagggggcgcucugguga

SEQ ID NO: 18645 - RNA, 9879 nt, Artificial Sequence
  derived and/or modified CDS sequence (opt5) from DENV-1__KJ189328__SS-prME
agcgugacaaugcugcucaugcugcuucccacagcucuggcuuuccaccucacgaccagaggcggggagccucauaugaucgucuccaagcaggaacggggaaaaucucugcuuuuuaagacaagcgcuggcguuaacaugugcacccugauugcgauggaccucggggagcugugugaagauacaaugaccuacaaaugcccccagaucacagaggcugaacccgacgauguggacuguuggugcaaugccaccgauacgugggugaccuauggaacauguucccagaccggcgagcacagaagagagaagcggucugucgcccuggcuccucauguggggcucggacuggaaacacgcaccgagacguggaugagcuccgaaggcgccuggaaacagauucagagaguugagacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagacuuuguugagggacucuccggcgccacauggguggaugucgugcuggaacacgggagcugugugacgaccauggcuaagaauaaacccacacuggacaucgagcuccugaagaccgaagucacaaacccugccauucuucggaaacugugcaucgaggcgaagauuucuaauaccacgacagauucccgcuguccgacccagggagaagccacccucguugaggagcaggacgcuaacuucgugugcagacggacauuuguggaucgcggcuggggcaauggguguggacuguucggcaaagggagccuucugaccugcgccaaguuuaagugcgucacaaaacucgaaggaaagaucgugcaguacgagaaccugaaauauucuguuaucgugacgguccacaccggcgaccaacaucagguggggaaugaaacaaccgagcacggaacaauugcuaccaucacgccccaggccccuaccuccgaaauucagcugacagauuacggcgcccucacccuggacuguagccccagaacaggccuugacuucaacgagaugguucugcucaccaugaaggagaaaucuuggcuggugcauaagcaaugguuucuugaucugccucuccccuggacguccggggcuagcacaucccaggaaaccuggaaucggcaggaccugcuggucacauucaaaaccgcgcacgccaagaagcaagagguggucgugcucggaucucaggaaggcgcuaugcacaccgcccugacaggggccacggagauccagaccagcggaacaaccacaauuuuugcuggccaucuuaaaugccgccugaagauggauaaacucacccugaaggggacguccuauguuauguguacaggcagcuucaaacuggaaaaggagguggccgagacccagcacggaaccguccuugugcaaguuaaguacgaaggcacagacgcgccgugcaaaaucccuuucucuacccaggaugagaagggggugacacagaacggaagacucaucacggcuaaucccauugucaccgacaaagaaaagccugugaacaucgagacagagccgcccuuuggcgaauccuauauugugguuggggccggagagaaagcccugaagcugagcugguucaagaaaggcucuagcaucgggaagauguuugaagcuaccgcccggggcgcuagacgcauggccauucucggagauacagcgugggacuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgauucuggaugcgugaucaacuggaaaggcagagagcugaaguguggguccggaauuuucgucacaaacgaagugcacaccuggacggagcaguauaaguuucaggcugacagcccuaaacgccucuccgccgcgaucggcaaggccugggaggaagggguuugcggcauucggucugcuacaagacuggagaauaucauguggaaacagaucagcaacgaacuuaaucauauucugcucgagaacgauaugaaguucaccguggucgugggagacgccaauggcauccuggcucaagggaaaaagaugauucgcccgcagcccauggaacacaaauacuccuggaagucuuggggaaaggccaaaaucauuggcgccgacauccagaacaccacauuuaucauugaugggccugacacccccgaguguccugauaaucagcgggcuuggaacaucugggagguggaagacuauggauucggcauuuuuacgacaaauaucuggcugaaacuuagagauagcuacacccaaaugugcgaccaccgccucauguccgcggccauuaaagauagcaaggcuguccaugccgacaugggcuauuggaucgagucugagaagaaugagacauggaagcuggcccgggcuuccuucaucgaaguuaagaccuguacauggcccaaaagccacacccuguggucuaauggggugcucgaguccgagaugauuaucccgaagauuuacggaggcccuaucagccagcauaacuauagacccggguacuucacgcagaccgccggaccuuggcaccugggcaaacuugaacuggauuuugaccucugcgaggggacaaccguggucguggaugaacacugcggaaaucgcggccccucucugcggacaaccacgguuacaggcaagauuauccaugagugguguugcagaagcuguacccugccuccccuucgguuccgcggggaggacggaugcugguacggcauggaaaucagaccggugaaagagaaggaagagaaccucguccgguccauggugagcgcggggucuggagaaguugauuccuuuagccugggcauucuguguguguccaucaugauugaggaggucaugagaucucgcuggagccggaagaugcucaugacagggacccuggcuguguuccuucugcucaucaugggacaacugaccuggaaagaccugauuagacuuugcaucaugguuggcgccaaugccuccgaccgcaugggcauggggacaacguaucuggcucucauggccaccuuuaagaugagaccuauguucgcggugggacugcucuuucggcgccugacaucuagagaaguccuucugcucaccauuggccugagccugguggcuuccguggagcuucccaacucucuggaagaacucggggauggacuggccaugggcaucaugaugcucaaacugcuuacagaguuccacccccaucagcuguggaccacgcuccugagccugacauuuaucaagaccacccuuucccuggacuacgccuggaaaacaaccgcuauggcccucagcauugucucucuguucccucucugucuguccacaacgagccagaagaccacauggcuuccgguucugcuggggucuuuuggaugcaagccccucaccauguuccugaucacagagaacaaaauuuggggccggaaguccuggccucuuaaugagggcaucauggcuauugggaucgugagcauccugcucucuucccugcucaaaaacgaugugccccuggccggaccucuuauugcgggcgggaugcugaucgccuguuaugucauuagcggauccagcgcugaccugucucucgaaaaggccgcugaggugagcugggaacaggaggccgaacacuccggcaccucucauaauauccugguugaggugcaagaugacgggacgaugaaaauuaaggaugaggaacgcgacgauacccuuacaauccugcucaaagccacccugcucgcugucagcggaguguaccccauguccaucccugcgacacuguuuguuugguauuucuggcagaagaagaaacagagaucuggcgugcuuugggacacccccagcccgccugaggucgaacgggccgugcuggaugacggcauuuaccgcauccugcagagagggcuccugggacggucccaagucggcguggggguuuuccaggauggaguguuucacacaauguggcacgucacgcgcggcgcugugcuuauguaucaggggaagagacuggagcccucuugggccagcguuaaaaaggaccucauuuccuacggaggcggcuggcgguuccaggggagcuggaacaccggagaggaagugcaagucaucgccguggagccuggcaaaaaucccaagaacgugcagacaaccccggggaccuuuaagacaccugaaggagagguuggcgcuauugcccuggacuucaaacccgggacgucuggauccccuaucgucaauagagaaggcaagauugugggccucuacgggaacggaguggucaccacaagcggcaccuaugugucugcgaucgcucaggccaaagccucccaagaggggccccugcccgagaucgaagaugagguuuuuaagaaacgcaaucuuacaauuauggaccugcauccuggaagcggcaagacccggagauaccugccggcuaucgugcgcgaagccauuaagcggaaacucagaacgcugauccuugcgcccacacgcgucguggcuuccgagauggccgaagcccugaaggggaugccuauucgguaucagaccaccgcuguuaaaucugagcacacaggcagagagaucguggaucucaugugccaugccaccuucacaaugcgccugcugagccccguccgggugccuaacuacaauaugaucauuauggacgaagcucacuuuaccgaucccgccuccaucgcggccagaggauauauuagcacgcggguuggcaugggggaggcugccgcuaucuucaugacagccaccccuccgggaucuguggaagccuuuccccaguccaacgcugucauucaggacgaggaacgcgauaucccugagagaagcuggaacucuggcuacgacuggaucacagauuuccccgggaagaccgugugguuugugccuagcauuaaauccggaaacgacaucgcgaauugucuccggaagaacggcaagcgcgucauucaacuuucuagaaaaacguucgauaccgaguaucagaagaccaagaauaaugacugggacuacguugugaccacagauaucagcgaaaugggggccaacuuccgggcugacagagugauugauccccgccggugccugaagccggucauccugaaagacggcccugagagagugauucucgccggacccaugcccguuaccguggccuccgcugcccagcgccggggcagaaucgggcgcaaucagaacaaggaaggagaucaauacgucuauaugggccagccucugaauaacgacgaggaucaugcgcacuggacagaggcuaagaugcuucuggacaauaucaacacccccgaagggauuaucccugcccucuuugagccggaacgggagaaaucugccgcuauugauggagaauacagacugcgcggcgaggccagaaagacguucguggagcugaugcggcgcggggaccuccccguuuggcuuagcuauaaaguggcguccgaaggcuuucaguacagcgauagacgguggugcuucgacggagagcgcaauaaccagguccuggaagagaauauggauguggaaaucuggacaaaggagggcgagcgcaaaaagcugcggccuagauggcucgacgcccgcaccuauucugacccccuggcccuucgggaauuuaaagaguucgccgcugggagacgcuccgucagcggagaucugauucucgaaaucggcaagcugccucaacaccugacccuccgggcccagaacgcucuugacaaucuggugaugcugcauaacuccgagcaagggggaaaggccuacagacacgcgaucgaagaacuccccgauacaauugagacccugaugcuucuggcccucaucgcuguucugacaggcggcgugacgcuguuuuuccucucugggaaaggacuuggcaagaccagcauugggcugcugugugugacagccuccucugcucuccuguggauggccagcgucgaaccgcauuggaucgccgcuuccauuauccuugaguuuuuccugaugguucuccugaucccugaacccgaccggcagcgcaccccucaagauaaucagcuggcguauguggugauuggacuccuuuuuaugauccugacagucgccgcuaacgagaugggccugcucgagaccacgaaaaaggaccuggggauuggacacguggccgccgaaaaccaccagcaugcuaccaugcuugauguugaccugagacccgccagcgcguggacacucuacgccguggcuaccacagucaucaccccuaugaugcggcacacgauugagaauacaaccgccaacaucucucugacagcuauugccaaucaagcggccauccugaugggccucgauaaaggcuggcccaucuccaagauggacauuggggugccgcuucuggcucugggaugcuacagccaggucaacccucucacccugaccgccgcugugcuuaugcugguugcccauuaugcuaucauuggccccgggcuccaggccaaggcgacacgcgaagcccagaaaagaacggcugccggaaucaugaagaaucccaccguggauggcauugucgcuaucgaccuggauccugugguuuacgacgccaaauucgagaagcaacuggggcagaucaugcuccuuauucuguguacaucucagauccugcucaugcggaccacaugggcccugugcgaauccauuacccuugcgacgggaccgcugacaacccucugggagggcagccccggcaaauuuuggaacaccacaaucgcugugucuauggccaauauuuuccgcgggagcuaucuggcuggagccggccuggccuucucccucaugaagucucuugggggaggcagacgggggaccggagcucagggcgagacacugggcgaaaaguggaaacgccaacugaaccagcucagcaaguccgaguuuaauacguacaaaagaagcgggaucauggaagucgaccgguccgaggccaaggaaggacugaaaagaggcgagaccacaaagcacgcggugucucgcgggaccgccaaacuucggugguucguggagagaaaccugguuaaaccugaaggaaaggucaucgaucucggcugugggcgcggaggcuggagcuauuacugcgcuggccugaaaaaggugacagaggugaaaggguauaccaagggaggccccgggcaugaggaaccuauucccauggccacguacggauggaaucuggucaaacuccacuccggcaaggacguguuuuucaugccuccggaaaagugugauacccuucugugcgacaucggggagucuagccccaacccuacaauugaggaaggacggacccugagaguucucaaaaugguggagcccuggcugcgcggcaaucaguuuuguaucaagauucuuaacccuuacaugcccuccgucguggaaacacuggagcagaugcaacggaaacacggcgggaugcucguuagaaauccgcugucucgcaacagcacccaugagauguauuggguguccugcggaacaggcaauaucgucagcgcugugaacaugaccucucggaugcugcucaacagauucacgauggcccaccgcaagccuacauacgaacgggauguugaccugggggcgggaaccagacauguggccgucgagcccgaaguggcuaaucuugauauuaucggccagcgcaucgagaacauuaaaaaugaacacaaguccaccuggcacuaugacgaggauaaccccuacaagacaugggccuaucaugggagcuacgaggugaaaccuucuggauccgcuagcucuauggucaauggcguugugagacugcucacgaagcccugggacgugaucccuauggucacccagauugccaugacagauaccacaccguuuggccaacagcggguguucaaagaaaagguugacacccgcacacccagagcuaaacgggggaccacgcagaucauggaggugaccgccaaguggcuguggggauuucuuuccagaaacaagaaaccucggauuuguacacgcgaagaguucaccagaaagguccggagcaaugcggccaucggcgcuguguuuguugacgaaaaccaguggaacuccgccaaagaggcuguggaggaugaacgcuucugggaccugguccacagagagcgggaacuccauaagcaagggaaaugcgccacaugcguguauaacaugaugggaaagcgcgagaagaaacugggcgaauuugggaaggccaaaggcagcagagcgaucugguacauguggcugggagcucgguuccucgaguucgaggcccugggcuuuaugaaugaagaucacugguucucucgcgagaacagccuuuccgggguugaaggagagggccugcauaagcucggguacauucugagagacaucucuaaaauucccggaggcaauauguaugccgaugacaccgcugggugggauacgcggaucacagaggacgaucuucagaacgaagccaagauuaccgacaucauggagccugaacacgcucugcucgccacaagcaucuuuaaacugaccuaccagaauaaggugguccgcgugcagagacccgcgaagaacggcacggucauggaugugauuucccggcgcgaccaaagaggaucuggccagguugggaccuauggacugaacacauucaccaauauggaggugcagcucauccggcagauggaaagcgagggcauuuuucugccguccgagcuugaaacaccuaaccuggccgagagaguccucgauuggcuggaaaaacacggggcugagcgccuuaagcggauggccaucucuggagacgacuguguggugaaacccauugaugacagauucgcuaccgcccugacagcgcucaaugauaugggcaagguucgcaaagacaucccucaaugggaacccagcaagggguggaacgauuggcaacaggugccuuuuugcucccaucacuuccaucagcugaucaugaaggacggccgggagauugucgugcccuguagaaaucaagaugagcugguuggacgcgcccgggugagccagggcgcuggguggucucucaaagaaaccgccugccugggaaaguccuacgcucagauguggcaacuuauguauuuucacagacgcgaccugcggcucgccgcuaacgccaucuguagcgcggucccgguggauugggucccuacgucuagaacaaccugguccauucacgcccaucaccaguggaugaccacagaggacaugcugagcguguggaaucgcguuuggaucgaagagaaccccuggauggaagauaaaacccauguguccucuugggaggagguccccuaccuuggcaagcgggaagaccaguggugcgggagccugauuggacucacagcuagagccacgugggccaccaauauccagguggcuauuaaccaaguucggagacugaucggcaaugagaacuaucuggacuacaugacauccaugaaacgcuucaagaaugaaagcgauccugagggggcccucugguga

SEQ ID NO: 18646 - RNA, 9879 nt, Artificial Sequence
  derived and/or modified CDS sequence (opt5) from DENV-1__KJ189329__SS-prME
uccgugaccaugcugcugaugcugcuucccaccgcccuggcuuuccaccucacgaccagaggcggggaaccucauaugaucgucuccaagcaggaacggggaaaaucucugcuuuuuaagacaagcgccggcguuaacaugugcacccugauugcgauggaccucggggagcugugugaagauacaaugaccuacaaaugcccgcagaucacagaggcugaacccgacgauguggacuguuggugcaaugccaccgaugccugggugacguauggaaccuguucccagacaggcgagcaccgcagagacaagcggucugucgcucuggccccucauguggggcucggacuggagacccgcacagaaaccuggaugagcuccgagggcgcuuggaaacagauucagagaguugaaacgugggcccuucggcaccccggcuucacagugaucgcguuuuuccuggcccaugcuauugggaccucuaucacacagaagggaaucauuuuuauccuccugaugcuugucaccccuagcauggccaugcgcugcgugggcauugggaacagagauuucguugagggacuguccggcgcuaccuggguggacgucgugcucgagcacgggagcugugugacaacgauggccaagaauaaacccacccuggauaucgaacugcucaagacagaggucaccaacccugcgauucugcggaaacuuugcaucgaagccaagauuucuaauacaaccacggacucccgcuguccgacacagggagaggcuacccugguugaagaacaggaugccaacuuugugugcagacggaccuucguggaccgcggcuggggcaauggguguggacucuuuggcaaagggagccugcuuacaugcgcuaaguucaagugcgucaccaaacuggagggaaagaucgugcaguacgaaaaccucaaauauucuguuaucgugacaguccacacgggcgaucaacaucagguggggaaugagaccacagaacacggaaccauugccacaaucacaccccaggccccuacguccgagauucagcugaccgacuacggcgcucugacacucgacuguagccccagaaccggccuggauuuuaacgaaaugguucuucugacaaugaaggagaaaucuuggcucgugcauaagcaaugguuccuggaccuuccucugcccuggaccuccggggcgagcacgucccaggagacauggaaucggcaggaucuccuggucaccuuuaaaacagcccacgcuaagaagcaagaaguggucgugcugggaucucaggagggcgccaugcacaccgcccucaccggggcuacagaaauccagacgagcggaaccacaaccauuuucgccggccaucugaaaugccgccuuaagauggacaaacugacacucaaggggaccuccuauguuauguguacgggcagcuucaaacuggagaaggaaguggcggagacacagcacggaaccguccuggugcaaguuaaguacgagggcaccgaugcuccgugcaaaaucccuuuuucuacacaggacgaaaagggggugacccagaacggaagacuuaucacagccaaucccauugucacggauaaagagaagccugugaacaucgaaaccgagccgcccuucggcgaguccuauauugugguuggggccggagaaaaagcucucaagcugagcugguuuaagaaaggcucuagcaucgggaagauguucgaggccacagcucggggcgccagacgcauggcgauucugggagacaccgccugggauuuuggcuccaucgggggagucuucacaucugugggcaaacucgugcaucaggucuuugggaccgcuuacggagugcuguucagcggcguuuccuggacgaugaagaucgggauuggcauccuucugaccuggcucggacugaauagccggucuacaucccugagcaugaccuguauugccgugggcauggucacacuuuaccucggggugaugguucaagcugacucuggaugcgugaucaacuggaaaggcagagaacugaaguguggguccggaauuuuugucaccaacgaggugcacacauggaccgaacaguauaaguuccaggccgauagcccuaaacgccuguccgcggccaucggcaaggcuugggaggaggggguuugcggcauucggucugccacgagacucgaaaauaucauguggaaacagaucagcaacgagcugaaucauauucuucuggaaaacgacaugaaguuuacaguggucgugggagacgcuaauggcauccucgcccaagggaaaaagaugauucgcccgcagcccauggagcacaaauacuccuggaagucuuggggaaaggccaaaaucauuggcgcugauauccagaacaccaccuucaucauugacgggccugauacacccgaauguccugacaaucagcgggcguggaacaucugggagguggaggauuauggauuuggcauuuucaccacgaauaucuggcugaagcugagagacagcuacacacaaaugugcgaucaccgccuuauguccgccgcuauuaaagacagcaaggccguccaugccgauaugggcuauuggaucgaaucugagaaaaacgaaaccuggaagcucgcucgggccuccuucaucgagguuaagacauguaccuggcccaaaagccacacacuguggucuaauggggugcuggaauccgagaugauuaucccgaagauuuacggaggcccuaucagccagcauaacuauagaucuggguacuuuacccagacggcgggacccuggcaccucggcaaacuggagcuugacuucgaucugugcgaagggaccacaguggucguggacgagcacugcggaaaucgcggcccuagccuccggaccacaaccguuacgggcaagauuauccaugaaugguguugcagauccuguacacugcccccucugcgguuucgcggggaggauggaugcugguacggcauggagaucagacccgugaaagaaaaggaggaaaaccuuguccggagcauggugucugcuggguccggagagguugacagcuucucccucggcauucugugugccucuaucaugauugaagaggugaugagaagccgcuggucccggaagaugcugaugaccgggacacucgccgucuuucugcuucuggugaugggacaacucaccuggaaugaccugaucagacugugcauuaugguuggcgcuaacgccucugaucgcaugggcauggggaccacauaucuugcgcugauggcuacguucaaaaugagaccgauguuugccgugggacuccuguuccggcgccucaccagcagagagguccugcuucugacaaucggccucucccugguggccucuguggaacugccuaacagccuugaggaacugggggacggacucgcuaugggcauuaugaugcugaagcuccugaccgaguuucagccccaccagcuuuggacaacccugcucucccugacguucaucaaaacaacccugagccuugauuacgccuggaagaccacagcuauggcccugucuaucgucucccucuuuccccugugucucagcaccacaucucagaaaacgaccuggcugccuguucuucugggguccuucggaugcaagccgcugacaauguuucucauuaccgaaaauaagaucuggggccggaaaagcuggccccugaacgagggcauuauggcgaucgggauugugucuauccuucuguccagccuccugaagaaugacgugccucucgccggaccccugaucgcuggcgggaugcuuauugccuguuaugucaucuccggaagcucugcugaucugagccuggagaaagccgccgaaguguccugggagcaagaagcugagcauucuggcacaagccacaacauucucguugaagugcaggacgaugggaccaugaagaucaaagacgaggagcgcgaugacacgcugaccauucuucugaaggcgacacuccuggccgucuccggaguguacccuaugucuauccccgcuacccucuucguuugguauuucuggcagaaaaagaagcagagaagcggcgugcugugggauacaccuagcccucccgaagucgagcgggccgugcuugacgauggcaucuaccgcauucugcaaagagggcugcucggacggucucaggucggcguggggguuuuucaggacggaguguuccauaccauguggcacgucacacgcggcgccgugcugauguaucaggggaaaagacuugaacccagcugggcuuccguuaagaaagaccugaucagcuacggaggcggcuggcgguuucaagggucuuggaauacgggagaggaggugcaggucauugccguggaacccggcaagaacccuaaaaaugugcagaccacacccgggaccuucaagaccccggagggagaaguuggcgcgaucgcucucgauuuuaagccugggacauccggaagccccauugucaacagagagggcaaaaucgugggccuguacgggaauggaguggucacgaccucuggcacauauguguccgccauugcccaagcuaaggccagccaggaagggccucuccccgagaucgaggacgaaguuuucaaaaagcgcaaccugaccaucauggaucuucaccccggauccggcaaaacacggagauaccugccugcgauugugcgcgaggcuaucaagcggaagcugagaacccucauucuggccccgacgcgcgucguggccucugaaauggcugaggcccuuaaagggaugcccauccgguaucagacaaccgcuguuaagagcgaacauaccggcagagagauuguggaccugaugugccacgccacauuuaccaugcgccuccuguccccuguccgggugcccaauuacaacaugaucaucauggaugaggcgcauuucacagacccugccagcauugcugccagaggauauaucucuacccggguuggcaugggggaagcugccgccauuuuuaugacggcuacacccccuggauccguggaggcguucccgcagagcaaugccgucauccaagaugaagaacgcgacauucccgaaagaucuuggaacagcggcuacgauuggaucaccgacuuuccugggaaaacagugugguucgugcccuccaucaagucuggaaaugauauugcuaacugucugcggaaaaacggcaagcgcgucauccagcucagcagaaagaccuucgacacggaguaucagaaaaccaagaauaacgacugggauuacguugugacaaccgacauuuccgagaugggggccaauuuucgggccgauagagugaucgacccucgccggugccuuaaacccgucauucugaaggauggcccggaaagagugauccuggcuggaccuaugcccguuacaguggccucugcggcucagcgccggggcagaauugggcgcaaccaaaauaaagagggagaccaguacgucuauaugggccagccccucaacaaugaugaagaccacgcccauuggaccgaggccaagaugcugcuugauaacaucaauacaccugaggggaucauucccgcucuguucgaaccugagcgggaaaagagcgccgcgaucgacggagaguacagacuccgcggcgaagccagaaaaaccuuuguggagcugaugcggcgcggggaucugccgguuuggcucuccuauaagguggcuagcgagggcuuccaguacucugacagacgguggugcuuugauggagaacgcaacaaucaaguccuugaggaaaacauggacguggagauuuggacgaaagaaggcgagagaaagaaacugcggcccagauggcuggacgcccgcacauauuccgauccucucgcucugcgggaguucaaggaauuugccgcugggagacgcagcgucuccggagaccuuauccuggagauuggcaaacucccccagcaccugaccucucgggcccagaaugcgcuggauaaccucgugaugcuucacaauagcgaacaagggggaaaggccuacagacaugcuauggaggaacugccugacaccaucgagacacugaugcuccuggcccuuaucgcuguucugaccggcggcgugacacucuucuuucuguccgggaagggacugggcaaaacgucuauugggcuccuuugugugaccgccagcuccgcccugcuguggauggcuagcgucgagccccacuggaucgcggccucuauuauccucgaguucuuucugaugguucuucugauuccggagccugaucggcaacgcacaccccaggacaaccagcucgcuuauguggugaucggacugcuguucaugauccucaccgucgccgccaacgaaaugggccuucuggagacaaccaagaaagaucuggggauuggacauguggcugccgagaaucaccaacacgcgacgaugcucgacguugaucugagaccugccuccgcuuggacccuuuacgccguggcuacaaccgucaucacacccaugaugcggcauaccauugaaaacacgacagccaauaucagccugaccgcgauugccaaccaggcugccauccucaugggccuggacaagggcuggccuauuucuaaaauggauaucggggugccccugcucgcucuuggaugcuacucccaggucaauccgcugacacugaccgccgcugugcucaugcugguugcccacuaugcgaucauuggcccugggcuucaggccaaggcuacccgcgaggcccaaaagagaacagcugccggaaucaugaaaaaccccacgguggacggcauugucgccaucgaucuggaccccgugguuuacgacgcgaaguuugaaaaacagcucgggcagauuaugcugcugauccucuguaccagccagauccuucugaugcggacaaccugggcucugugcgagucuauuacacucgccaccggaccucugacgacacuuugggaaggcagcccgggcaaguucuggaauaccaccaucgcuguguccauggccaacauuuuccgcgggucuuaucuggccggagcuggccucgccuuuagccugaugaaaucccucgggggaggcagacgggggacaggagcgcaaggcgagacccucggcgagaaguggaagcgccagcuuaaucagcugagcaaauccgaguucaacacauacaagagaucugggaucauggaggucgaucggagcgaagccaaagagggacugaagagaggcgaaacgaccaaacaugcugugucccgcgggacagccaagcuccggugguuuguggagagaaaucugguuaagcccgagggaaaagucauugaccuuggcugugggcgcggaggcuggucuuauuacugcgcuggccugaagaaagugaccgaagugaagggguauacaaaaggaggcccugggcacgaggaacccaucccuauggccaccuacggauggaaccucgucaagcugcauagcggcaaagauguuuucuuuaugcccccugagaagugugacacgcugcucugcgauaucggggaauccucuccgaaucccaccauugaggagggacggacacuuagagugcugaagaugguggaaccuuggcugcgcggcaaccaguucuguaucaaaauucucaaucccuacaugccuagcgucguggagacccuggaacaaaugcagcggaagcacggcgggaugcuuguuagaaacccccugucccgcaauagcacacacgagauguauugggugucuugcggaaccggcaacaucgucuccgcggugaacaugacaagccggaugcuccugaauagauuuaccauggcccaucgcaaaccgacguacgagcgggacguugaucugggggcuggaacaagacacguggccgucgaaccugagguggcuaaccucgacauuaucggccagcgcauugaaaauaucaagaacgagcauaaaucuaccuggcacuaugaugaagacaaucccuacagaaccugggccuaucacggguccuacgaggugaagcccagcggaucugcuuccagcauggucaacggcguugugcggcugcuuacaaagccuugggaugugauccccauggucacgcaaauugccaugaccgacacaaccccuuucggccagcagcgcguguuuaaagagaagguugacacaagaaccccgcgggcgaaaagagggacaacccagaucauggaagugacggccaaguggcuguggggauuccucucccggaauaaaaagccccgcauuuguaccagagaggaauuuacacggaagguccgcagcaacgcugccaucggcgcuguguucguugaugagaaucaauggaacucugccaaagaagccguggaggacgagagauuuugggaucugguccaucgggaacgcgagcuucacaagcaggggaaaugcgcgaccugcguguauaauaugaugggaaagagagagaagaagcugggcgaguucgggaaggcuaaaggcagccgggccauuugguacauguggcucggagcccgcuuccuggaauuugaggcucugggcuucaugaacgaggaccauugguuuuccagagaaaauucucucagcgggguugagggagaaggccugcacaaacuuggguacauccugcgggauaucuccaaaauuccuggaggcaacauguaugccgacgauacagcugggugggacacccgcaucacggaggaugaccuccagaaugaggccaagauuacagaaaucauggagcccgaacaugcgcugcuugccaccucuauuuucaaacugacauaccagaacaagguggucagagugcaacggccugcuaaaaacggcaccgucauggaugugaucagccgcagagaccagcggggauccggccagguugggacguauggacucaauaccuuuacaaacauggaggugcagcugaucagacaaauggaaucugagggcauuuuccugcccagcgagcucgaaaccccgaaucuggccgagcgcguccuugauuggcuggaaaagcacggggcugagcggcucaagagaauggccaucuccggagacgacuguguggugaaaccuauugaugaccgcuuugcgacagcccugaccgcucuuaacgauaugggcaagguucggaaagacaucccccagugggaaccuagcaagggguggaaugauuggcaacaggugcccuucugcucucaccauuuucaccaacugauuaugaaagacggcagagagaucgucgugccuugucgcaaccaggaugagcucguuggacgggccagagugucccagggcgcuggguggagccugcgcgaaacagccugccugggaaagucuuacgcucaaauguggcagcucauguauuuccaucggagagaccugcgccuugccgcgaaugccaucuguuccgcuguccccguggauugggucccgaccagccggacgacaugguccauucacgcccaccaucaguggaugaccaccgaggacaugcugucuguguggaacagaguuuggaucgaagagaauccuuggauggaagauaagacacacgugagcuccugggaggagguccccuaccucggcaaacgggaagaccaguggugcgggagccugauuggacuuaccgccagagcuacaugggccacgaacauccaaguggcgauuaaucagguucgccggcugaucggcaacgagaauuaucucgacuacaugaccucuaugaagagauuuaaaaacgaauccgaucccgagggggcucugugguga

SEQ ID NO: 18647 - RNA, 9879 nt, Artificial Sequence
  derived and/or modified CDS sequence (opt5) from DENV-1__KJ189331__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugaucgggacacuggccgucuuccuucugcucauuaugggacaacugaccuggaaugaccugaucagacuuugcauuauggugggcgccaacgcuuccgaucgcaugggcauggggaccacauaucuggcccucauggcgacguuuaaaaugagaccuauguucgcuguuggacugcucuuucggcgccugaccucuagagaggugcuucugcucacaaucggccugagccuggucgccuccguggaacuucccaacucucuggaggaacucggggacggacuggccaugggcaucaugaugcucaagcugcuuaccgaguuccagccccaccagcuguggacaacccuccugagccugacguuuauuaaaacaacccuuucccuggauuacgcuuggaagaccacagccauggcucucagcaucgugucucuguucccucucugucuguccaccacaagccagaaaacgaccuggcuuccgguccugcuggggucuuuuggaugcaagccccucacaauguuccugauuaccgaaaauaagaucuggggccggaaauccuggccucuuaacgagggcauuauggccaucgggaucguuagcauucugcucucuucccugcucaagaaugacgugccccuggcgggaccucuuaucgccggcgggaugcugauugcuuguuaugugaucagcggauccagcgccgaucugucucucgagaaaacagcugaagucagcugggagcaagaagccgagcauuccggcaccucucacaacauucugguggaaguucaggacgaugggacgaugaagaucaaagacgaggagcgcgaugacacccuuacaauccugcucaaggccacccugcucgcugugagcggagucuaccccauguccauuccugcgacacuguuugugugguauuucuggcagaaaaagaagcagagaucuggcguucuuugggauacccccagcccgccugaaguggagcgggccguccuggacgauggcaucuaccgcauucugcaaagagggcuccugggacggucccaggugggcgucgggguguuccaggacggaguuuuucauacaauguggcacgugacgcgcggcgcuguccuuauguaucaggggaaaagacuggaacccucuugggccagcgugaagaaagaccucaucuccuacggaggcggcuggcgguuccaagggagcuggaauaccggagaggagguucaggugauugccgucgaaccuggcaagaaccccaaaaaugugcagacaaccccggggaccuuuaagacaccugagggagaagugggcgcuaucgcccuggauuucaagcccgggacgucuggauccccuauuguuaacagagagggcaaaaucgucggccucuacgggaauggaguggugaccacaagcggcaccuaugucucugcgaucgcucaagccaaggccucccaggaagggccccugcccgagauugaggacgaaguguuuaaaaagcgcaaccuuacaaucauggaucugcacccuggaagcggcaaaacccggagauaccugccggcuauuguucgcgaggccaucaagcggaagcucagaacgcugauucuugcgcccacacgcguggucgcuuccgaaauggccgaggcccugaaagggaugccuauccgguaucagaccaccgcugugaagucugaacauacaggcagagagaucguugaccucaugugccacgccaccuucacaaugcgccugcugagccccgugcgggucccuaauuacaacaugauuaucauggaugaggcucauuuuaccgaccccgccuccauugcggccagaggauauaucagcacgcgggugggcaugggggaagcugccgcuauuuucaugacagccaccccuccgggaucuguugaggccuuuccccaguccaaugcugugauccaagaugaagagcgcgacaucccugaaagaagcuggaacucuggcuacgauuggauuacagacuuccccgggaaaaccgucugguuugugccuagcaucaaguccggaaaugauauugcgaacugucuccggaaaaacggcaagcgcgugauccagcuuucuagaaagacguucgacaccgaguaucagaaaacaaagaauaacgacugggauuacgucguuaccacagacauuagcgagaugggggccaauuuccgggcugauagagugaucgacccccgccggugccugaaaccggugauucugaaggauggcccugaaagagucauccucgccggacccaugcccgugaccguugccuccgcugcccagcgccggggcagaaucgggcgcaaccaaaauaaagagggagaccaguacguguauaugggccagccucugaacaaugaugaagaccacgcgcauuggacagaggcuaagaugcuucuggauaacauuaauacccccgaggggaucauuccugcccucuuugaaccggagcgggaaaagucugccgcuaucgacggagaguacagacugcgcggcgaagccagaaaaacguucgucgagcugaugcggcgcggggaucuccccguguggcuuagcuauaagguugcguccgagggcuuucaguacagcgacagacgguggugcuucgauggagaacgcaacaaucaagugcuggaggaaaacauggacgucgagauuuggacaaaagaaggcgagagaaagaaacugcggccuagauggcucgacgcccgcaccuauucugauccccuggcucuucgggaguuuaaggaauucgccgcugggagacgcuccgugagcggagaccugauccucgagaucggcaaacugccucagcaccugacccuccgggcccagaaugcucuugauaaccuggccaugcugcacaauuccgaacaggggggaaaggcguacagacaugccauggaggaacuccccgacacaauugagacccugaugcuucuggcucucaucgccguccugacaggcggcgugacgcuguuuuuccucucugggaagggacuuggcaaaaccagcauugggcugcuguguguuacagcuuccucugcccuccuguggauggccagcguggagccgcacuggaucgcugcguccauuauccuugaauuuuuccugauggugcuccugaucccugagcccgaucggcaacgcaccccucaggacaaccagcuggccuaugucguuauuggacuccuuuuuaugauccugacaguggcugccaacgaaaugggccugcucgagaccacgaagaaagaucuggggauuggacauguggccgcugagaaucaccaacacgccaccaugcuugacgucgaucugagacccgcgagcgccuggacacucuacgcuguggccaccacaguuaucaccccuaugaugcggcauacgauugaaaacacaaccgcuaauaucucucugacagccauugcgaaccaggccgcuauccugaugggccucgacaagggcuggcccaucuccaaaauggauauuggggugccgcuucuggcccugggaugcuacagccaggucaauccucucacccugaccgcugccgugcuuaugcuggucgcucacuaugccaucauuggccccgggcuccaggcgaaggccacacgcgaggcucaaaagagaacggccgcuggaaucaugaaaaaccccaccguggacggcauuguugccaucgaucuggacccuguggucuacgacgccaaguucgaaaaacagcuggggcagaucaugcuccuuauucuguguacaucucagauccugcucaugcggaccacaugggcgcugugcgaguccauuacccuugcuacgggaccgcugacaacccucugggaaggcagccccggcaaguuuuggaauaccacaaucgccgugucuauggcuaacauuuuccgcgggagcuaucuggccggagccggccuggcuuucucccucaugaaaucucuugggggaggcagacgggggaccggagcccaaggcgagacacugggcgagaaguggaagcgccagcugaaucagcucagcaaauccgaauuuaacacguacaagagaagcgggaucauggagguugaucgguccgaagcgaaagagggacugaagagaggcgaaaccacaaaacaugccgugucucgcgggaccgcuaagcuucggugguucgucgagagaaaucuggugaagccugagggaaaagugaucgaccucggcugugggcgcggaggcuggagcuauuacugcgccggccugaagaaaguuacagaagucaagggguauaccaaaggaggccccgggcacgaggaaccuauucccauggcuacguacggauggaaccuggugaagcuccauuccggcaaagauguguuuuucaugccuccggagaagugugacacccuucugugcgauaucggggaaucuagccccaauccuacaauugaggagggacggacccugagaguccucaagaugguugaacccuggcugcgcggcaaccaguuuuguaucaaaauucuuaauccuuacaugcccuccgugguggagacacuggaacaaaugcagcggaagcacggcgggaugcucgucagaaacccgcugucucgcaauagcacccacgagauguauuggguguccugcggaacaggcaacaucguuagcgccgugaacaugaccucucggaugcugcucaauagauucacgauggcgcaucgcaaaccuacauuugagcgggacgucgaucugggggccggaaccagacacguggcuguugaacccgagguggccaaccuugacauuaucggccagcgcaucgaaaauauuaagaacgagcauaaauccaccuggcacuacgaugaagacaaucccuauaagacaugggcuuaccacgggagcuaugaggucaagccuucuggauccgccagcucuauggugaacggcguggucagacugcucacgaaacccugggauguuaucccuauggugacccaaauugcuaugacagacaccacaccguucggccagcagcggguguuuaaggagaaagucgacacccgcacacccagagccaagcgggggaccacgcagaucauggaagugaccgcgaaauggcuguggggauuccuuuccagaaauaagaagccucggauuuguacacgcgaggaauuuaccagaaaaguucggagcaacgccgcuaucggcgccguguucgucgaugagaaucaauggaacuccgcuaaggaagccguggaggacgagcgcuuuugggaucugguucauagagaacgggagcuccacaaacaggggaagugcgccacaugcguguacaauaugaugggaaaacgcgaaaagaagcugggcgaguucgggaaagcgaagggcagcagagcuaucugguauauguggcugggagcccgguuccucgaauuugaggcccugggcuucaugaacgaggaccauugguuuucucgcgaaaauagccuuuccggggucgagggagaaggccugcacaaacucggguacauucugagagauaucucuaagauucccggaggcaacauguacgcugacgauaccgccgggugggacacgcggaucacagaggaugaccuucagaaugaggcuaaaauuaccgauaucauggaaccugagcaugcccugcucgcgacaagcaucuucaagcugaccuaucagaacaaagugguucgcgugcaaagacccgccaagaacggcacggucauggacgugauuucccggcgcgaucagagaggaucuggccaggucgggaccuacggacugaauacauuuaccaacauggaagugcagcucauccggcaaauggagagcgaaggcauuuuccugccguccgagcuugagacaccuaaucuggcugaaagaguucucgacuggcuggagaagcacggggccgaacgccuuaaacggauggcuaucucuggagacgauuguguggucaagcccauugacgauagauuugccaccgcgcugacagcccucaacgacaugggcaaagugcgcaaggauaucccucagugggagcccagcaaaggguggaaugacuggcagcaggugccuuucugcucccaccauuuucaccaacugaucaugaaggauggccgggaaauuguugugcccuguagaaaccaggacgagcuggucggacgcgcucgggugagccagggcgccggguggucucucagagagaccgcuugccugggaaaguccuaugcccaaauguggcagcuuauguacuuccaucgccgggaucugagacucgcugccaaugcgaucuguagcgccguuccgguggacugggucccuacgucucgcacaaccugguccauucacgcucaccaucaguggaugaccacagaagauaugcugagcguguggaaccgggucuggaucgaggaaaaucccuggauggaggacaaaacccacguguccucuugggaagagguucccuaucuuggcaagagagaggaccaguggugcgggagccugauuggacucacagcccgggccacgugggcuaccaacauccaaguggccauuaaucaggucagacgccugaucggcaacgaaaauuaccuggauuauaugacauccaugaaacgguuuaagaacgagagcgacccugaaggggcgcucugguga

SEQ ID NO: 18648 - RNA, 9879 nt, Artificial Sequence
  derived and/or modified CDS sequence (opt5) from DENV-1__KJ189332__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaccaucuucauucugcuuaugcuggucacaccuagcauggcuaugcgcugcgugggcaucgggaacagagauuuuguugagggacucuccggcgccacguggguggacgucgugcuggagcacgggagcugugugaccacaauggcuaagaauaaacccacccuggauauugaacuccugaagacagaggucaccaacccugccauccuucggaaacugugcauugaagcgaagaucucuaauacgacaaccgacucccgcuguccgacccagggagaggccacacucguugaagagcaggaugcuaacuucgugugcagacggaccuuuguggaccgcggcuggggcaauggguguggacuguucggcaaagggagccuucugacaugcgccaaguuuaagugcgucacgaaacucgagggaaagauugugcaguacgaaaaccugaaauauucuguuaucgugaccguccacacaggcgaucaacaucagguggggaaugagaccacagaacacggaaccaucgcuacgauuaccccccaggccccuacauccgagauccagcugaccgacuacggcgcccucacacuggacuguagccccagaaccggccuugauuucaacgaaaugguucugcucacgaugaaggagaaaucuuggcuggugcauaagcaaugguuucuugaccugccucuccccuggacauccggggcuagcaccucccaggagacauggaaucggcaggaucugcuggucaccuucaaaaccgcgcacgccaagaagcaagaaguggucgugcucggaucucaggagggcgcuaugcacacagcccugacgggggccaccgaaauucagacaagcggaaccacaaccaucuuugcuggccaucuuaaaugccgccugaagauggacaaacucacgcugaaggggacauccuauguuauguguaccggcagcuucaaacuggagaaggaaguggccgagacccagcacggaacaguccuugugcaaguuaaguacgagggcaccgaugcgccgugcaaaauuccuuucucuacacaggacgaaaagggggugacgcagaacggaagacucaucaccgcuaaucccaucgucacagauaaagagaagccugugaacauugaaaccgagccccccuuuggcgaguccuauaucgugguuggggccggagaaaaagcccugaagcugagcugguucaagaaaggcucuagcauugggaagauguuugaggcuacagcccggggcgcuagacgcauggccauccucggagacaccgcgugggauuucggcuccauugggggagucuuuacgucugugggcaaacuggugcaucaggucuucgggaccgccuacggagugcuuuuuagcggcguuuccuggacaaugaagaucgggaucggcauucugcucaccuggcugggacugaauagccggucuacaucccuuagcaugaccuguaucgcugugggcauggucacacucuaccugggggugaugguucaagccgacucuggaugcgugauuaacuggaaaggcagagaacugaaguguggguccggaaucuucgucaccaacgaggugcacacguggacagaacaguauaaguuucaggcugauagcccuaaacgccucuccgccgcgauuggcaaggccugggaggaggggguuugcggcauccggucugcuaccagacuggaaaauauuauguggaaacagaucagcaacgagcuuaaucauauccugcucgaaaacgacaugaaguucaccguggucgugggagacgccaauggcauucuggcucaagggaaaaagaugauccgcccgcagcccauggagcacaaauacuccuggaagucuuggggaaaggccaaaauuaucggcgccgauauucagaacacaaccuuuaucaucgacgggccugauacgcccgaauguccugacaaucagcgggcuuggaacauuugggagguggaggauuauggauucggcaucuuuacaaccaauauuuggcugaagcuuagagacagcuacacacaaaugugcgaucaccgccucauguccgcggccaucaaagacagcaaggcuguccaugccgauaugggcuauuggauugaaucugagaaaaacgaaaccuggaagcuggcccgggcuuccuucaucgagguuaagacauguaccuggcccaaaagccacacgcuguggucuaauggggugcucgaauccgagaugaucauuccgaagaucuacggaggcccuauuagccagcauaacuauagacccggguacuucacccagacagccggaccuuggcaccugggcaaacuugagcuggacuuugaucucugcgaagggaccacaguggucguggacgagcacugcggaaaucgcggccccucucugcggaccacgacaguuaccggcaagaucauucaugaaugguguugcagaagcuguacacugccuccccuucgguuccgcggggaggauggaugcugguacggcauggagaucagaccggugaaagaaaaggaggaaaaccucguccgguccauggugagcgcggggucuggagagguugacuccuuuagccugggcauccugugugcuuccauuaugaucgaagaggugaugagaucucgcuggagccggaagaugcucaugaccgggacccuggccgucuuccuucugcucauuaugggacaacugacauggaaugaccugaucagacuuugcauuauggugggcgccaacgcuuccgaucgcaugggcauggggacgaccuaucuggcccucauggcgacauuuaaaaugagaccuauguucgcuguuggacugcucuuucggcgccugaccucuagagaggugcuucugcucacaaucggccugagccuggucgccuccguggaacuucccaacucucuggaggaacucggggacggacuggccaugggcauuaugaugcucaagcugcuuaccgaguuccagccccaccagcuguggacgacacuccugagccugaccuuuaucaaaaccacacuuucccuggauuacgcuuggaagaccacagccauggcucucagcaucgugucucuguucccucucugucuguccacgaccagccagaaaacaaccuggcuuccgguccugcuggggucuuuuggaugcaagccccucacaauguuccugauuaccgaaaauaagaucuggggccggaaauccuggccucuuaacgagggcauuauggccaucgggauuguuagcauccugcucucuucccugcucaagaaugacgugccccuggcgggaccucuuaucgccggcgggaugcugauugcuuguuaugugaucagcggauccagcgccgaucugucucucgagaaaacggcugaagucagcugggagcaagaagccgagcauuccggcaccucucacaacauucugguggaaguucaggacgaugggacaaugaagaucaaagacgaggagcgcgaugacacccuuacaauucugcucaaggccacccugcucgcugugagcggagucuaccccauguccaucccugcgacacuguuugugugguauuucuggcagaaaaagaagcagagaucuggcguucuuugggauacgcccagcccgccugaaguggagcgggccguccuggacgauggcaucuaccgcauucugcaaagagggcuccugggacggucccaggugggcgucgggguguuccaggacggaguuuuucauaccauguggcacgugacacgcggcgcuguccuuauguaucaggggaaaagacuggaacccucuugggccagcgugaagaaagaccucaucuccuacggaggcggcuggcgguuccaagggagcuggaauaccggagaggagguucaggugauugccgucgaaccuggcaagaaccccaaaaaugugcagaccacaccggggacguuuaagaccccugagggagaagugggcgcuaucgcccuggauuucaagcccgggacaucuggauccccuauuguuaacagagagggcaaaaucgucggccucuacgggaauggaguggugaccacaagcggcaccuaugucucugcgauugcucaagccaaggccucccaggaagggccccugcccgagaucgaggacgaaguguuuaaaaagcgcaaccuuacgaucauggaucugcacccuggaagcggcaaaacacggagauaccugccggcuauuguucgcgaggccaucaagcggaagcucagaacccugauucuugcgcccacccgcguggucgcuuccgaaauggccgaggcccugaaagggaugccuauccgguaucagacaaccgcugugaagucugaacauacaggcagagagauuguugaccucaugugccacgccaccuucacgaugcgccugcugagccccgugcgggucccuaauuacaacaugaucaucauggaugaggcucauuuuacagaccccgccuccauugcggccagaggauauaucagcacccgggugggcaugggggaagcugccgcuauuuucaugacagccaccccuccgggaucuguugaggccuuuccccaguccaaugcugugauccaagaugaagagcgcgacauuccugaaagaagcuggaacucuggcuacgauuggaucacggacuuccccgggaaaaccgucugguuugugccuagcaucaaguccggaaaugauauugcgaacugucuccggaaaaacggcaagcgcgugauccagcuuucuagaaagacauucgacaccgaguaucagaaaacaaagaauaacgacugggauuacgucguuaccacagacauuagcgagaugggggccaauuuccgggcugauagagugaucgacccccgccggugccugaaaccggugauucugaaggauggcccugaaagagucauccucgccggacccaugcccgugaccguugccuccgcugcccagcgccggggcagaauugggcgcaaccaaaauaaagagggagaccaguacguguauaugggccagccucugaacaaugaugaagaccacgcgcauuggacggaggcuaagaugcuucuggauaacaucaauacacccgaggggaucauuccugcccucuuugaaccggagcgggaaaagucugccgcuaucgacggagaguacagacugcgcggcgaagccagaaaaaccuucgucgagcugaugcggcgcggggaucuccccguguggcuuagcuauaagguugcguccgagggcuuucaguacagcgacagacgguggugcuucgauggagaacgcaacaaucaagugcuggaggaaaacauggacgucgagauuuggaccaaagaaggcgagagaaagaaacugcggccuagauggcucgacgcccgcacauauucugauccccuggcucuucgggaguuuaaggaauucgccgcugggagacgcuccgugagcggagaccugauccucgagauuggcaaacugccucagcaccugacccuccgggcccagaaugcucuugauaaccuggccaugcugcacaauuccgaacaggggggaaaggcguacagacaugccauggaggaacuccccgacacaaucgagacgcugaugcuucuggcucucaucgccguccugaccggcggcgugacacuguuuuuccucucugggaagggacuuggcaaaaccagcauugggcugcuguguguuacagcuuccucugcccuccuguggauggccagcguggagccgcacuggaucgcugcguccauuauccuugaauuuuuccugauggugcuccugauuccugagcccgaucggcaacgcaccccucaggacaaccagcuggccuaugucguuaucggacuccuuuuuaugauccugacgguggcugccaacgaaaugggccugcucgagaccacaaagaaagaucuggggauuggacauguggccgcugagaaucaccaacacgccaccaugcuugacgucgaucugagacccgcgagcgccuggacacucuacgcuguggccaccacgguuaucacaccuaugaugcggcauaccauugaaaacacaaccgcuaauaucucucugaccgccauugcgaaccaggccgcuauccugaugggccucgacaagggcuggcccauuuccaaaauggauaucggggugccgcuucuggcccugggaugcuacagccaggucaauccucucacacugacggcugccgugcuuaugcuggucgcucacuaugccaucauuggccccgggcuccaggcgaaggccacccgcgaggcucaaaagagaacagccgcuggaaucaugaaaaaccccaccguggacggcauuguugccaucgaucuggacccuguggucuacgacgccaaguucgaaaaacagcuggggcagauuaugcuccuuauccuguguacaucucagauccugcucaugcggaccacgugggcgcugugcgaguccauuacacuugcuaccggaccgcugaccacacucugggaaggcagccccggcaaguuuuggaauaccacaaucgccgugucuauggcuaacauuuuccgcgggagcuaucuggccggagccggccuggcuuucucccucaugaaaucucuugggggaggcagacgggggacgggagcccaaggcgagacccugggcgagaaguggaagcgccagcugaaucagcucagcaaauccgaauuuaacacauacaagagaagcgggaucauggagguugaucgguccgaagcgaaagagggacugaagagaggcgaaaccacaaaacaugccgugucucgcgggaccgcuaagcuucggugguucgucgagagaaaucuggugaagccugagggaaaagugauugaccucggcugugggcgcggaggcuggagcuauuacugcgccggccugaagaaaguuacggaagucaagggguauaccaaaggaggccccgggcacgaggaaccuauccccauggcuacauacggauggaaccuggugaagcuccauuccggcaaagauguguuuuucaugccuccggagaagugugacacccuucugugcgauaucggggaaucuagccccaauccuacaauugaggagggacggacccugagaguccucaagaugguugaacccuggcugcgcggcaaccaguuuuguaucaaaauucuuaauccuuacaugcccuccgugguggagacacuggaacaaaugcagcggaagcacggcgggaugcucgucagaaacccgcugucucgcaauagcacccacgagauguauuggguguccugcggaacgggcaacaucguuagcgccgugaacaugacaucucggaugcugcucaauagauucaccauggcgcaucgcaaaccuaccuuugagcgggacgucgaucugggggccggaacaagacacguggcuguugaacccgagguggccaaccuugacauuaucggccagcgcauugaaaauaucaagaacgagcauaaauccacguggcacuacgaugaagacaaucccuauaagaccugggcuuaccacgggagcuaugaggucaagccuucuggauccgccagcucuauggugaacggcguggucagacugcucacaaaacccugggauguuaucccuauggugacccaaauugcuaugacagacaccacaccguucggccagcagcggguguuuaaggagaaagucgacacccgcacgcccagagccaagcgggggaccacacagaucauggaagugaccgcgaaauggcuguggggauuccuuuccagaaauaagaagccucggauuuguacacgcgaggaauuuaccagaaaaguucggagcaacgccgcuaucggcgccguguucgucgaugagaaucaauggaacuccgcuaaggaagccguggaggacgagcgcuuuugggaucugguucauagagaacgggagcuccacaaacaggggaagugcgccacgugcguguacaauaugaugggaaaacgcgaaaagaagcugggcgaguucgggaaagcgaagggcagcagagcuauuugguauauguggcugggagcccgguuccucgaauuugaggcccugggcuucaugaacgaggaccauugguuuucucgcgaaaauagccuuuccggggucgagggagaaggccugcacaaacucggguacauccugagagauaucucuaagauucccggaggcaacauguacgcugacgauacagccgggugggacacccggaucacagaggaugaccuucagaaugaggcuaaaauuaccgauaucauggaaccugagcaugcccugcucgcgacgagcauuuucaagcugaccuaucagaacaaagugguucgcgugcaaagacccgccaagaacggcacagucauggacgugaucucccggcgcgaucagagaggaucuggccaggucgggaccuacggacugaauacauuuaccaacauggaagugcagcucauccggcaaauggagagcgaaggcauuuuccugccguccgagcuugagacaccuaaucuggcugaaagaguucucgacuggcuggagaagcacggggccgaacgccuuaaacggauggcuaucucuggagacgauuguguggucaagcccauugacgauagauuugccaccgcgcugacggcccucaacgacaugggcaaagugcgcaaggauaucccucagugggagcccagcaaaggguggaaugacuggcagcaggugccuuucugcucccaccauuuucaccaacugauuaugaaggauggccgggaaaucguugugcccuguagaaaccaggacgagcuggucggacgcgcucgggugagccagggcgccggguggucucucagagagacagcuugccugggaaaguccuaugcccaaauguggcagcuuauguacuuccaucgccgggaucugagacucgcugccaaugcgaucuguagcgccguuccgguggacugggucccuaccucucgcaccacaugguccauucacgcucaccaucaguggaugaccacagaagauaugcugagcguguggaaccgggucuggaucgaggaaaaucccuggauggaggacaaaacgcacguguccucuugggaagagguucccuaucuuggcaagagagaggaccaguggugcgggagccugauuggacucaccgcccgggccacaugggcuaccaacauccaaguggccauuaaucaggucagacgccugaucggcaacgaaaauuaccuggauuauaugacauccaugaaacgguuuaagaacgagagcgacccugaaggggcgcucugguga

SEQ ID NO: 18649 - RNA, 9879 nt, Artificial Sequence
  derived and/or modified CDS sequence (opt5) from DENV-1__KJ189334__SS-prME
agcgugaccaugcugcucaugcugcuucccacagcccuggcuuuccaccucacgaccagaggcggggagccucauaugaucgucuccaagcaggaacggggaaaaucucugcuuuuuaagguuagcgccggcgugaacaugugcacacugauugcgauggaccucggggagcugugugaagauaccaugacauacaaaugcccgcaaaucaccgaggcugaacccgacgauguggacuguuggugcaaugccacagauaccugggucacguauggaaccuguucccagacaggcgagcaccgcagagacaagcggucuguggcccuggcuccucauguugggcucggacuggagacccgcacagaaaccuggaugagcuccgagggcgccuggaaacagauucagagaguggaaacgugggcucuucggcaccccggcuucacagucaucgccuuuuuccuggcgcaugccauugggaccucuaucacacaaaagggaaucauuuuuauccuccugaugcuugugaccccuagcauggcuaugcgcugcguuggcauugggaacagagauuucguggagggacuguccggcgccaccugggucgacguggugcucgagcacgggagcugugucacaacgauggcuaagaauaaacccacccuggauaucgaacugcucaagacagagguuaccaacccugccauucugcggaaacuuugcaucgaagcgaagauuucuaauacaaccacggacucccgcuguccgacacagggagaggccacccugguggaagagcaggaugcuaacuuugugugcagacggaccuucgucgaccgcggcuggggcaauggguguggacucuuuggcaaagggagccugcuuacaugcgccaaguucaagugcgugaccaaacuggagggaaagaucguucaguacgaaaaccucaaauauucugugaucgucacagugcacacgggcgaucaacaucagguugggaaugagaccacagaacacggaaccauugcuacaaucaccccccaggccccuacguccgagauucagcugaccgacuacggcgcccugacacucgacuguagccccagaaccggccuggauuuuaacgaaauggugcuucugacaaugaaggagaaaucuuggcucguccauaagcaaugguuccuggaccuuccucugcccuggaccuccggggcuagcacgucccaggagacauggaaucggcaggaucuccuggugaccuuuaaaacagcgcacgccaagaagcaagaagucgugguucugggaucucaggagggcgcuaugcacaccgcccucaccggggccacagaaauccagacgagcggaaccacaaccauuuucgcuggccaucugaaaugccgccuuaagauggacaaacugacacucaaggggaccuccuaugugauguguacgggcagcuucaaacuggagaaggaagucgccgagacacagcacggaaccgugcugguucaagugaaguacgagggcaccgaugcgccgugcaaaaucccuuuuucuacacaggacgaaaagggggucacccagaacggaagacuuaucacagcuaaucccauugugacggauaaagagaagccugugaacaucgaaaccgagccccccuucggcgaguccuauauuguugucggggccggagaaaaagcccucaagcugagcugguuuaagaaaggcucuagcaucgggaagauguucgaggcuacagcccggggcgcuagacgcauggccauucugggagacaccgcgugggauuuuggcuccaucgggggaguguucacaucugugggcaaacucguccaucagguguuugggaccgccuacggaguucuguucagcggcguguccuggacgaugaagaucgggauuggcauccuucugaccuggcucggacugaauagccggucuacaucccugagcaugaccuguauugcugucggcauggugacacuuuaccucgggguuauggugcaagccgacucuggaugcgucaucaacuggaaaggcagagaacugaaguguggguccggaauuuuugugaccaacgagguucacacauggaccgaacaguauaaguuccaggcugauagcccuaaacgccuguccgccgcgaucggcaaggccugggaggagggggugugcggcauucggucugcuacgagacucgaaaauaucauguggaaacagaucagcaacgagcugaaucauauucuucuggaaaacgacaugaaguuuacagucguggugggagacgccaauggcauccucgcucaagggaaaaagaugauucgcccgcagcccauggagcacaaauacuccuggaagucuuggggaaaggccaaaaucauuggcgccgauauccagaacaccaccuucaucauugacgggccugauacacccgaauguccugacaaucagcgggcuuggaacaucugggaggucgaggauuauggauuuggcauuuucaccacgaauaucuggcugaagcugagagacagcuacacacaaaugugcgaucaccgccuuauguccgcggccauuaaagacagcaaggcuguucaugccgauaugggcuauuggaucgaaucugagaaaaacgaaaccuggaagcucgcccgggcuuccuucaucgaggugaagacauguaccuggcccaaaagccacacacuguggucuaauggggugcuggaauccgagaugauuaucccgaagauuuacggaggcccuaucagccagcauaacuauagacccggguacuuuacccagacggccggaccuuggcaccucggcaaacuggagcuugacuucgaucugugcgaagggaccacagucgugguugacgagcacugcggaaaucgcggccccucucuccggaccacaaccgugacgggcaagauuauccaugaaugguguugcagaagcuguacacugccuccccugcgguuucgcggggaggauggaugcugguacggcauggagaucagaccggucaaagaaaaggaggaaaaccuugugcgguccaugguuagcgcggggucuggagagguggacuccuucagccucggcauucugugugucuccaucaugauugaagaggugaugagaucucgcuggagccggaagaugcugaugaccgggacacucgcuguuuuucugcuucuggugaugggacaacucaccuggaaugaccugaucagacugugcauuauggucggcgccaacgccuccgaucgcaugggcauggggaccacauaucuugcucugauggccacguucaaaaugagaccuauguuugcggugggacuccuguuccggcgccucaccucuagagaggugcugcuucugacaaucggccucagccuggucgcuuccguugaacugcccaacucucuugaggaacugggggacggacucgccaugggcauuaugaugcugaagcuccugaccgaguuucagccccaccagcuuuggacaacccugcucagccugacguucaucaaaacaacccugucccuugauuacgccuggaagaccacagcuauggcccugagcaucgugucucucuuuccucugugucucuccaccacaagccagaaaacgaccuggcugccggugcuucuggggucuuucggaugcaagccccugacaauguuucucauuaccgaaaauaagaucuggggccggaaauccuggccucugaacgagggcauuauggcuaucgggauugucagcauccuucugucuucccuccugaagaaugacgugccccucgccggaccucugaucgcgggcgggaugcuuauugccuguuauguuaucagcggauccagcgcugaucugucucuggagaaagccgcugaagugagcugggagcaagaagccgagcauuccggcacaucucacaacauucucgucgaagugcaggacgaugggaccaugaagaucaaagacgaggagcgcgaugacacgcugaccauucuucugaaggccacacuccuggcuguuagcggaguguaccccauguccaucccugcgacccucuucgucugguauuucuggcagaaaaagaagcagagaucuggcgugcugugggauacacccagcccgccugaagucgagcgggccgugcuugacgauggcaucuaccgcauucugcaaagagggcugcucggacggucccagguuggcgugggggucuuucaggacggaguguuccauaccauguggcacguuacacgcggcgcugugcugauguaucaggggaaaagacuugaacccucuugggccagcgucaagaaagaccugaucuccuacggaggcggcuggcgguuucaagggagcuggaauacgggagaggaggugcaggugauugccguugaaccuggcaagaaccccaaaaauguccagaccacaccggggaccuucaagaccccugagggagaagugggcgcuaucgcccucgauuuuaagcccgggacaucuggauccccuauugugaacagagagggcaaaaucgucggccuguacgggaauggagugguuacgaccagcggcacauaugugucugcgauugcucaagccaaggccucccaggaagggccccuccccgagaucgaggacgaagucuucaaaaagcgcaaccugaccaucauggaucuucacccuggaagcggcaaaacacggagauaccugccggcuauugugcgcgaggccaucaagcggaagcugagaacccucauucuggcgcccacgcgcguuguggcuuccgaaauggccgaggcccuuaaagggaugccuauccgguaucagacaaccgcugucaagucugaacauaccggcagagagauuguggaccugaugugccacgccacauuuaccaugcgccuccugagccccguucgggugccuaauuacaacaugaucaucauggaugaggcucauuucacagaccccgccuccauugcggccagaggauauaucagcacccgggucggcaugggggaagcugccgcuauuuuuaugacggccacaccuccgggaucuguggaggccuucccccaguccaaugcugugauccaagaugaagagcgcgacauuccugaaagaagcuggaacucuggcuacgauuggaucaccgacuuucccgggaaaacagucugguucguuccuagcaucaaguccggaaaugauauugcgaacugucugcggaaaaacggcaagcgcgugauccagcucucuagaaagaccuucgacacggaguaucagaaaaccaagaauaacgacugggauuacguggucacaaccgacauuagcgagaugggggccaauuuucgggcugauagagugaucgacccccgccggugccuuaaaccgguuauucugaaggauggcccugaaagagugauccuggccggacccaugcccgucacaguggccuccgcugcccagcgccggggcagaauugggcgcaaccaaaauaaagagggagaccaguacguuuauaugggccagccucucaacaaugaugaagaccacgcgcauuggaccgaggcuaagaugcugcuugauaacaucaauacacccgaggggaucauuccugcccuguucgaaccggagcgggaaaagaacgccgcuaucgacggagaguacagacuccgcggcgaagccagaaaaaccuuuguggagcugaugcggcgcggggaucugcccgucuggcucucuuauaagguggcgagcgagggcuuccaguacuccgacagacgguggugcuuugauggagaacgcaauaaccaaguccuugaggaaaauauggacguggagauuuggacgaaagaaggcgagagaaagaaacugcggccuagauggcuggacgcccgcacauauagcgauccccucgcucugcgggaguucaaggaauuugccgcugggagacgcucuguuuccggagaccuuauccuggagauuggcaaacucccucagcaccugacccugcgggcccagaacgcucucgauaaucuugugaugcugcacaacagcgaacaggggggaaaggccuacagacaugcgauggaggaacugcccgacaccaucgagacacucaugcugcuugcccugaucgcugugcucaccggcggcgucacacuguucuuucuguccgggaagggacucggcaaaacgucuauugggcuucuguguguuaccgccagcuccgcucugcucuggauggccucuguggagccgcacuggaucgccgcuagcauuauccuggaauucuuucuuauggugcugcucauuccugagcccgaucggcaacgcacaccucaggacaaccagcuggcguaugucgugaucggacugcucuucaugauccuuaccguugccgcuaaugaaaugggccugcuggagacaaccaagaaagaucucgggauuggacauguggccgccgagaaccaccaacacgcuacgaugcuggacgucgaucuuagacccgccuccgcguggacccuguacgccguggcuacaaccgucaucacaccuaugaugcggcauaccauugaaaauacgacagccaacaucagccucaccgcuauugccaaucaggcggccauccugaugggccuggacaagggcuggcccauuucuaaaauggauaucggggugccgcuccuugcucugggaugcuacucccagguuaacccucugacacucaccgccgcugugcugaugcuugucgcccacuaugcuaucauuggccccgggcugcaggccaaggcgacccgcgaggcccaaaagagaacagcugccggaaucaugaaaaaucccacgguggacggcauuguugcuaucgaucucgacccuguggucuacgacgccaaguuugaaaaacagcuggggcagauuaugcugcucauccuuuguaccagccagauccugcugaugcggacaaccugggcccucugcgagucuauuacacuggcgaccggaccgcuuacgacacugugggaaggcucccccggcaaguucuggaacaccaccaucgcugugagcauggccaauauuuuccgcgggucuuaucucgcuggagccggccuggccuuuagccugaugaaaucccucgggggaggcagacgggggacaggagcucaaggcgagacccuuggcgagaaguggaagcgccagcugaaccagcugucuaaaagcgaauucaauacauacaagagauccgggaucauggagguggaucggagcgaagccaaagagggacucaagagaggcgaaacgaccaaacaugcgguuucccgcgggacagccaagcugcggugguuugucgagagaaaccuugugaagccugagggaaaagugauugaccugggcugugggcgcggaggcuggucuuauuacugcgcuggccucaagaaagucaccgaaguuaagggguauacaaaaggaggccccgggcacgaggaaccuauccccauggccaccuacggauggaaucuggugaagcugcauagcggcaaagauguguucuuuaucccuccggagaagugugacacgcuccuuugcgauauuggggaauccucucccaacccuaccaucgaggagggacggacacugagaguccugaagaugguggaacccuggcuccgcggcaaucaguucuguauuaaaauccugaacccuuacaugcccagcguuguggaggcucuugaacaaaugcagcggaagcacggcgggaugcuggucagaaauccgcucucccgcaacucuacccacgagauguauugggugagcugcggaacaggcaacauuguuuccgccgugaauaugaccagccggaugcugcugaacagauuuacaauggcgcaucgcaaaccuaccuacgagcgggacgucgaucucggggccggaacgagacacguggcuguggaacccgaggucgccaaucuggacaucauuggccagcgcaucgaaaacaucaagaaugagcauaaaucuacauggcacuaugaugaagacaaccccuacaagaccugggcuuaucacggguccuacgagguuaagccuagcggaucugccuccagcauggugaauggcguggucagacuucugaccaaacccugggaugugauuccuaugguuacacaaaucgcuaugacggacaccacaccguucggccagcagcggguguuuaaggagaaagucgacacccgcacacccagagccaagcgggggaccacacagauuauggaagugaccgcgaaauggcucuggggauuccugucuagaaacaagaagccucggaucuguacgcgcgaggaauuuaccagaaaaguucgguccaaugccgcuauuggcgccguguucgucgaugagaaccaauggaauagcgcuaaggaagccguggaggacgagcgcuuuugggaucuuguucauagagaacgggagcugcacaaacaggggaagugcgccacaugcguguauaacaugaugggaaaacgcgaaaagaagcucggcgaguucgggaaagcgaagggcuccagagcuaucugguacauguggcugggagcccgguuccuggaauuugaggcccucggcuucaugaaugaggaccauugguuuagccgcgaaaacucucugagcggggucgagggagaaggccuucacaaacugggguacauccucagagauauuuccaagauccccggaggcaauauguaugcugacgauaccgccgggugggacacacggauuaccgaggaugaccugcagaacgaggcuaaaaucacggaaauuauggagccugaacaugcccuucuggcgacaucuaucuucaagcucaccuaccagaacaaagugguccgcgugcaaagacccgccaagaauggcacaguuauggaugugaucagccggcgcgaccagagaggauccggccaggucgggaccuauggacugaacacguuuaccaauauggaggugcagcugauucggcaaauggaaucugagggcaucuuccucccgagcgagcuggaaacaccuaaccuugcugagagagugcuggauuggcucgaaaagcacggggccgagcgccugaaacggauggcuauuuccggagacgacuguguugugaagcccaucgaugacagauuugccaccgcgcuuacagcccugaaugauaugggcaaaguccgcaaggacauuccucagugggaacccucuaaaggguggaacgauuggcagcaggugccuuucugcagccaccauuuucaccaacucaucaugaaggacggccgggagaucguugugcccuguagaaaucaggaugagcuggucggacgcgcucgggugucccagggcgccggguggagccugagagaaaccgcuugccucggaaagucuuacgcccaaauguggcagcugauguauuuccaucgccgggaccuuagacuggcugccaacgcgauuuguuccgccgucccgguggauuggguuccuacaagccgcaccacguggucuauccacgcucaccaucaguggaugacaaccgaggacaugcucuccguguggaaucgggucuggauugaagagaaccccuggauggaagauaaaacccacgugagcuccugggaggagguucccuaccugggcaagagagaagaccaguggugcgggucucuuaucggacugacagcccgggccaccugggcuacaaauauucaaguggccaucaaccaggucagacgccucauuggcaaugagaacuaucuggacuacaugacgagcaugaaacgguuuaagaaugaauccgauccugagggggcgcugugguga

SEQ ID NO: 18650 - RNA, 9879 nt, Artificial Sequence
  derived and/or modified CDS sequence (opt5) from DENV-1__KJ189335__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgccuuuuuccuggcgcaugccauugggacaucuaucacccaaaagggaaucauuuuuauccuccugaugcuugucaccccuagcauggcuaugcgcugcgugggcauugggaacagagauuucguugagggacuguccggcgccacauggguggacgucgugcucgagcacgggagcugugugacgaccauggcuaagaauaaacccacacuggauaucgaacugcucaagaccgaggucacaaacccugccauucugcggaaacuuugcaucgaagcgaagauuucuaauaccacgacagacucccgcuguccgacccagggagaggccacccugguugaagagcaggaugcuaacuuugugugcagacggacauucguggaccgcggcuggggcaauggguguggacucuuuggcaaagggagccugcuuaccugcgccaaguucaagugcgucacaaaacuggagggaaagaucgugcaguacgaaaaccucaaauauucuguuaucgugacgguccacaccggcgaucaacaucagguggggaaugagacaaccgaacacggaacaauugcuaccaucacgccccaggccccuaccuccgagauucagcugacagacuacggcgcccugacccucgacuguagccccagaacaggccuggauuuuaacgaaaugguucuucugaccaugaaggagaaaucuuggcucgugcauaagcaaugguuccuggaccuuccucugcccuggacguccggggcuagcacaucccaggagaccuggaaucggcaggaucuccuggucacauuuaaaaccgcgcacgccaagaagcaagaaguggucgugcugggaucucaggagggcgcuaugcacaccgcccucacaggggccacggaaauccagaccagcggaacaaccacaauuuucgcuggccaucugaaaugccgccuuaagauggacaaacugacccucaaggggacguccuauguuauguguacaggcagcuucaaacuggagaaggaaguggccgagacccagcacggaaccguccuggugcaaguuaaguacgagggcacagaugcgccgugcaaaaucccuuuuucuacccaggacgaaaagggggugacacagaacggaagacuuaucacggcuaaucccauugucaccgauaaagagaagccugugaacaucgaaacagagccccccuucggcgaguccuauauugugguuggggccggagaaaaagcccucaagcugagcugguuuaagaaaggcucuagcaucgggaagauguucgaggcuaccgcccggggcgcuagacgcauggccauucugggagacacagcgugggauuuuggcuccaucgggggagucuucaccucugugggcaaacucgugcaucaggucuuugggacggccuacggagugcuguucagcggcguuuccuggaccaugaagaucgggauuggcauccuucugacauggcucggacugaauagccggucuaccucccugagcaugacauguauugcugugggcauggucacccuuuaccucggggugaugguucaagccgacucuggaugcgugaucaacuggaaaggcagagaacugaaguguggguccggaauuuuugucacaaacgaggugcacaccuggacggaacaguauaaguuccaggcugauagcccuaaacgccuguccgccgcgaucggcaaggccugggaggaggggguuugcggcauucggucugcuacaagacucgaaaauaucauguggaaacagaucagcaacgagcugaaucauauucuucuggaaaacgacaugaaguuuaccguggucgugggagacgccaauggcauccucgcucaagggaaaaagaugauucgcccgcagcccauggagcacaaauacuccuggaagucuuggggaaaggccaaaaucauuggcgccgauauccagaacaccacauucaucauugacgggccugauacccccgaauguccugacaaucagcgggcuuggaacaucugggagguggaggauuauggauuuggcauuuucacgacaaauaucuggcugaagcugagagacagcuacacccaaaugugcgaucaccgccuuauguccgcggccauuaaagacagcaaggcuguccaugccgauaugggcuauuggaucgaaucugagaaaaacgaaacauggaagcucgcccgggcuuccuucaucgagguuaagaccuguacauggcccaaaagccacacccuguggucuaauggggugcuggaauccgagaugauuaucccgaagauuuacggaggcccuaucagccagcauaacuauagacccggguacuuuacgcagaccgccggaccuuggcaccucggcaaacuggagcuugacuucgaucugugcgaagggacaaccguggucguggacgagcacugcggaaaucgcggccccucucuccggacaaccacgguuacaggcaagauuauccaugaaugguguugcagaagcuguacccugccuccccugcgguuucgcggggaggauggaugcugguacggcauggagaucagaccggugaaagaaaaggaggaaaaccuuguccgguccauggugagcgcggggucuggagagguugacuccuucagccucggcauucuguguguguccaucaugauugaagaggucaugagaucucgcuggagccggaagaugcugaugacagggacccucgcuguguuucugcuucugguuaugggacaacucaccuggaaugaccugaucagacugugcauuauggugggcgccaacgccuccgaucgcaugggcauggggacaacguaucuugcucugauggccaccuucaaaaugagaccuauguuugcggucggacuccuguuccggcgccucacaucuagagaggugcugcuucugaccaucggccucagccugguggcuuccgucgaacugcccaacucucuugaggaacugggggacggacucgccaugggcauuaugaugcugaagcuccugacagaguuucagccccaccagcuuuggaccacgcugcucagccugacauucaucaaaaccacccugucccuugauuacgccuggaagacaaccgcuauggcccugagcaucguuucucucuuuccucugugucucuccacaacgagccagaaaaccacauggcugccggugcuucuggggucuuucggaugcaagccccugaccauguuucucauuacagaaaauaagaucuggggccggaaauccuggccucugaacgagggcauuauggcuaucgggauugugagcauccuucugucuucccuccugaagaaugacgucccccucgccggaccucugaucgcgggcgggaugcuuauugccuguuaugugaucagcggauccagcgcugaucugucucuggagaaagccgcugaaguuagcugggagcaagaagccgagcauuccggcaccucucacaacauucucguggaaguccaggacgaugggacgaugaagaucaaagacgaggagcgcgaugacacccugacaauucuucugaaggccacccuccuggcugugagcggaguuuaccccauguccaucccugcgacacucuucgugugguauuucuggcagaaaaagaagcagagaucuggcguccugugggauacccccagcccgccugaaguggagcgggccguccuugacgauggcaucuaccgcauucugcaaagagggcugcucggacggucccaggugggcguugggguguuucaggacggagucuuccauacaauguggcacgugacgcgcggcgcuguucugauguaucaggggaaaagacuugaacccucuugggccagcgugaagaaagaccugaucuccuacggaggcggcuggcgguuucaagggagcuggaauaccggagaggagguccaggugauugccguggaaccuggcaagaaccccaaaaauguucagacaaccccggggaccuucaagacaccugagggagaagucggcgcuaucgcccucgauuuuaagcccgggacgucuggauccccuauugugaacagagagggcaaaaucgugggccuguacgggaauggagucgugaccacaagcggcaccuauguuucugcgauugcucaagccaaggccucccaggaagggccccuccccgagaucgaggacgaaguguucaaaaagcgcaaccugacaaucauggaucuucacccuggaagcggcaaaacccggagauaccugccggcuauuguccgcgaggccaucaagcggaagcugagaacgcucauucuggcgcccacacgcgugguugcuuccgaaauggccgaggcccuuaaagggaugccuauccgguaucagaccaccgcugugaagucugaacauacaggcagagagauugucgaccugaugugccacgccaccuuuacaaugcgccuccugagccccgugcggguuccuaauuacaacaugaucaucauggaugaggcucauuucaccgaccccgccuccauugcggccagaggauauaucagcacgcgggugggcaugggggaagcugccgcuauuuuuaugacagccaccccuccgggaucugucgaggccuucccccaguccaaugcugugauccaagaugaagagcgcgacauuccugaaagaagcuggaacucuggcuacgauuggaucacagacuuucccgggaaaaccgugugguucgucccuagcaucaaguccggaaaugauauugcgaacugucugcggaaaaacggcaagcgcguuauccagcucucuagaaagacguucgacaccgaguaucagaaaacaaagaauaacgacugggauuacguggugaccacagacauuagcgagaugggggccaauuuucgggcugauagagucaucgacccccgccggugccuuaaaccggugauucugaaggauggcccugaaagaguuauccuggccggacccaugcccgugaccgucgccuccgcugcccagcgccggggcagaauugggcgcaaccaaaauaaagagggagaccaguacguguauaugggccagccucucaacaaugaugaagaccacgcgcauuggacagaggcuaagaugcugcuugauaacaucaauacccccgaggggaucauuccugcccuguucgaaccggagcgggaaaagaacgccgcuaucgacggagaguacagacuccgcggcgaagccagaaaaacguuuguugagcugaugcggcgcggggaucugcccguguggcucucuuauaaggucgcgagcgagggcuuccaguacuccgacagacgguggugcuuugauggagaacgcaauaaccaagugcuugaggaaaauauggacgucgagauuuggacaaaagaaggcgagagaaagaaacugcggccuagauggcuggacgcccgcaccuauagcgauccccucgcucugcgggaguucaaggaauuugccgcugggagacgcucuguguccggagaccuuauccuggagauuggcaaacucccucagcaccugacccugcgggcccagaacgcucucgauaaucuuguuaugcugcacaacagcgaacaggggggaaaggccuacagacaugcgauggaggaacugcccgacacaaucgagacccucaugcugcuugcccugaucgcugugcucacaggcggcgugacgcuguucuuucuguccgggaagggacucggcaaaaccucuauugggcuucugugugucacagccagcuccgcucugcucuggauggccucuguugagccgcacuggaucgccgcuagcauuauccuggaauucuuucuuauggugcugcucauuccugagcccgaucggcaacgcaccccucaggacaaccagcuggcguauguggucaucggacugcucuucaugauccuuacaguggccgcuaaugaaaugggccugcuggagaccacgaagaaagaucucgggauuggacauguugccgccgagaaccaccaacacgcuaccaugcuggacguggaucuuagacccgccuccgcguggacacuguacgccgucgcuaccacagugaucaccccuaugaugcggcauacgauugaaaauacaaccgccaacaucagccucacagcuauugccaaucaggcggccauccugaugggccuggacaagggcuggcccauuucuaaaauggauaucggggucccgcuccuugcucugggaugcuacucccaggugaacccucugacccucaccgccgcuguucugaugcuuguggcccacuaugcuaucauuggccccgggcugcaggccaaggcgacacgcgaggcccaaaagagaacggcugccggaaucaugaaaaaucccaccgucgacggcauuguggcuaucgaucucgacccuguuguguacgacgccaaguuugaaaaacagcuggggcagauuaugcugcucauccuuuguacaagccagauccugcugaugcggaccacaugggcccucugcgagucuauuacccuggcgacgggaccgcuuacaacccugugggaaggcucccccggcaaguucuggaacaccacaaucgcugucagcauggccaauauuuuccgcgggucuuaucucgcuggagccggccuggccuuuagccugaugaaaucccucgggggaggcagacgggggaccggagcucaaggcgagacacuuggcgagaaguggaagcgccagcugaaccagcugucuaaaagcgaauucaauacguacaagagauccgggaucauggagguggaucggagcgaagccaaagagggacucaagagaggcgaaaccacaaaacaugcggugucccgcgggaccgccaagcugcggugguuuguugagagaaaccuugucaagccugagggaaaagugauugaccugggcugugggcgcggaggcuggucuuauuacugcgcuggccucaagaaagugacagaagucaagggguauaccaaaggaggccccgggcacgaggaaccuauccccauggccacguacggauggaaucugguuaagcugcauagcggcaaagauguguucuuuaucccuccggagaagugugacacccuccuuugcgauauuggggaauccucucccaacccuacaaucgaggagggacggacccugagagugcugaagauggucgaacccuggcuccgcggcaaucaguucuguauuaaaauccugaacccuuacaugcccagcgugguugaggcucuugaacaaaugcagcggaagcacggcgggaugcuggugagaaauccgcucucccgcaacucuacacacgagauguauugggucagcugcggaaccggcaacauuguguccgccguuaauaugacaagccggaugcugcugaacagauuuaccauggcgcaucgcaaaccuacguacgagcgggacguggaucucggggccggaacaagacacgucgcuguggaacccgagguggccaaucuggacaucauuggccagcgcaucgaaaacaucaagaaugagcauaaaucuaccuggcacuaugaugaagacaaccccuacaagaccugggcuuaucacggguccuacgaggucaagccuagcggaucugccuccagcaugguuaauggcguggugagacuucugacaaaacccugggaugucauuccuauggugacgcaaaucgcuaugaccgacacaaccccguucggccagcagcggguuuuuaaggagaaaguggacacacgcacccccagagccaagcgggggacaacccagauuauggaagucacggcgaaauggcucuggggauuccugucuagaaacaagaagccucggaucuguacccgcgaggaauuuacaagaaaagugcgguccaaugccgcuauuggcgccguuuucguggaugagaaccaauggaauagcgcuaaggaagccgucgaggacgagcgcuuuugggaucuugugcauagagaacgggagcugcacaaacaggggaagugcgccaccugcguuuauaacaugaugggaaaacgcgaaaagaagcucggcgaguucgggaaagcgaagggcuccagagcuaucugguacauguggcugggagcccgguuccuggaauuugaggcccucggcuucaugaaugaggaccauugguuuagccgcgaaaacucucugagcgggguggagggagaaggccuucacaaacugggguacauccucagagauauuuccaagauccccggaggcaauauguaugcugacgauacagccgggugggacacccggauuacggaggaugaccugcagaacgaggcuaaaaucacagaaauuauggagccugaacaugcccuucuggcgaccucuaucuucaagcucacauaccagaacaaagucgugcgcguccaaagacccgccaagaauggcaccgugauggauguuaucagccggcgcgaccagagaggauccggccagguggggacguauggacugaacaccuuuacaaauauggagguccagcugauucggcaaauggaaucugagggcaucuuccucccgagcgagcuggaaaccccuaaccuugcugagagagugcuggauuggcucgaaaagcacggggccgagcgccugaaacggauggcuauuuccggagacgacugugugguuaagcccaucgaugacagauuugccacagcgcuuaccgcccugaaugauaugggcaaagugcgcaaggacauuccucagugggaacccucuaaaggguggaacgauuggcagcaggucccuuucugcagccaccauuuucaccaacucaucaugaaggacggccgggagaucgugguucccuguagaaaucaggaugagcuggugggacgcgcucgggucucccagggcgccggguggagccugagagaaacagcuugccucggaaagucuuacgcccaaauguggcagcugauguauuuccaucgccgggaccuuagacuggcugccaacgcgauuuguuccgccgugccggucgauugggugccuaccagccgcacgacauggucuauccacgcucaccaucaguggaugaccaccgaggacaugcucuccguuuggaaucggguguggauugaagagaaccccuggauggaagauaaaacacacgucagcuccugggaggaggugcccuaccugggcaagagagaagaccaguggugcgggucucuuaucggacugaccgcccgggccacaugggcuacgaauauucaaguugccaucaaccaggugagacgccucauuggcaaugagaacuaucuggacuacaugaccagcaugaaacgguuuaagaaugaauccgauccugagggggcgcugugguga

SEQ ID NO: 18651 - RNA, 9879 nt, Artificial Sequence
  derived and/or modified CDS sequence (opt5) from DENV-1__KJ189336__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcaucgucacccucuaccugggggugaugguucaagccgacucuggaugcgugauuaacuggaaaggcagagaacugaaguguggguccggaaucuucgucacaaacgaggugcacaccuggacggaacaguauaaguuucaggcugauagcccuaaacgccucuccgccgcgauuggcaaggccugggaggaggggguuugcggcauccggucugcuacaagacuggaaaauaucauguggaaacagauuagcaacgagcuuaaucauauccugcucgaaaacgacaugaaguucaccguggucgugggagacgccaauggcauucuggcucaagggaaaaagaugauccgcccgcagcccauggagcacaaauacuccuggaagucuuggggaaaggccaaaauuaucggcgccgauauccagaacaccacauuuauuaucgacgggccugauacccccgaauguccugacaaucagcgggcuuggaacauuugggagguggaggauuauggauucggcaucuuuacgacaaauauuuggcugaagcuuagagacagcuacacccaaaugugcgaucaccgccucauguccgcggccaucaaagacagcaaggcuguccaugccgauaugggcuauuggaucgaaucugagaaaaacgaaacauggaagcuggcccgggcuuccuucauugagguuaagaccuguacauggcccaaaagccacacccuguggucuaauggggugcucgaauccgagaugaucauuccgaagaucuacggaggcccuauuagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagaucauccaugaaugguguugcagaagcuguacccugccuccccuucgguuccgcggggaggauggaugcugguacggcauggagauuagaccggugaaagaaaaggaggaaaaccucguccgguccauggugagcgcggggucuggagagguugacuccuuuagccugggcauccuguguguguccauuaugaucgaagaggucaugagaucucgcuggagccggaagaugcucaugacagggacccuggcuguguuccuucugcucguuaugggacaacugaccuggaaugaccugauuagacuuugcaucauggugggcgccaacgccuccgaucgcaugggcauggggacaacguaucuggcucucauggccaccuuuaaaaugagaccuauguucgcggucggacugcucuuucggcgccugacaucuagagaggugcuucugcucaccauuggccugagccugguggcuuccgucgaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgccuggaagacaaccgcuauggcccucagcauuguuucucuguucccucucugucuguccacaacgagccagaaaaccacauggcuuccggugcugcuggggucuuuuggaugcaagccccucaccauguuccugaucacagaaaauaagauuuggggccggaaauccuggccucuuaacgagggcaucauggcuauugggaucgugagcauccugcucucuucccugcucaagaaugacgucccccuggccggaccucuuauugcgggcgggaugcugaucgccuguuaugugauuagcggauccagcgcugaucugucucucgagaaagccgcugaaguuagcugggagcaagaagccgagcauuccggcaccucucacaacauccugguggaaguccaggacgaugggacgaugaagauuaaagacgaggagcgcgaugacacccuuacaauccugcucaaggccacccugcucgcugugagcggaguuuaccccauguccaucccugcgacacuguuugugugguauuucuggcagaaaaagaagcagagaucuggcguccuuugggauacccccagcccgccugaaguggagcgggccguccuggacgauggcauuuaccgcauccugcaaagagggcuccugggacggucccaggugggcguugggguguuccaggacggagucuuucauacaauguggcacgugacgcgcggcgcuguucuuauguaucaggggaaaagacuggaacccucuugggccagcgugaagaaagaccucauuuccuacggaggcggcuggcgguuccaagggagcuggaauaccggagaggagguccaggugaucgccguggaaccuggcaagaaccccaaaaauguucagacaaccccggggaccuuuaagacaccugagggagaagucggcgcuauugcccuggauuucaagcccgggacgucuggauccccuaucgugaacagagagggcaaaauugugggccucuacgggaauggagucgugaccacaagcggcaccuauguuucugcgaucgcucaagccaaggccucccaggaagggccccugcccgagaucgaggacgaaguguuuaaaaagcgcaaccuuacaauuauggaucugcacccuggaagcggcaaaacccggagauaccugccggcuaucguccgcgaggccauuaagcggaagcucagaacgcugauccuugcgcccacacgcgugguugcuuccgaaauggccgaggcccugaaagggaugccuauucgguaucagaccaccgcugugaagucugaacauacaggcagagagaucgucgaccucaugugccacgccaccuucacaaugcgccugcugagccccgugcggguuccuaauuacaacaugaucauuauggaugaggcucauuuuaccgaccccgccuccaucgcggccagaggauauauuagcacgcgggugggcaugggggaagcugccgcuaucuucaugacagccaccccuccgggaucugucgaggccuuuccccaguccaaugcugugauucaagaugaagagcgcgacaucccugaaagaagcuggaacucuggcuacgauuggaucacagacuuccccgggaaaaccgugugguuugucccuagcauuaaguccggaaaugauaucgcgaacugucuccggaaaaacggcaagcgcguuauucagcuuucuagaaagacguucgacaccgaguaucagaaaacaaagaauaacgacugggauuacguggugaccacagacaucagcgagaugggggccaauuuccgggcugauagagucauugacccccgccggugccugaaaccggugauccugaaggauggcccugaaagaguuauucucgccggacccaugcccgugaccgucgccuccgcugcccagcgccggggcagaaucgggcgcaaccaaaauaaagagggagaccaguacguguauaugggccagccucugaacaaugaugaagaccacgcgcauuggacagaggcuaagaugcuucuggauaacaucaauacccccgaggggauuaucccugcccucuuugaaccggagcgggaaaagucugccgcuauugacggagaguacagacugcgcggcgaagccagaaaaacguucguugagcugaugcggcgcggggaucuccccguguggcuuagcuauaaggucgcguccgagggcuuucaguacagcgacagacgguggugcuucgauggagaacgcaacaaucaagugcuggaggaaaacauggacgucgagaucuggacaaaagaaggcgagagaaagaaacugcggccuagauggcucgacgcccgcaccuauucugauccccuggcucuucgggaguuuaaggaauucgccgcugggagacgcuccgugagcggagaccugauucucgagaucggcaaacugccucagcaccugacccuccgggcccagaaugcucuugauaaccugguuaugcugcacaauuccgaacaggggggaaaggccuacagacaugcgauggaggaacuccccgacacaaucgagacccugaugcuucuggcccucauugcugugcugacaggcggcgugacgcuguuuuuccucucugggaagggacuuggcaaaaccagcaucgggcugcugugugucacagccuccucugcucuccuguggauggccagcguugagccgcacuggauugccgcuuccaucauucuugaauuuuuccugauggugcuccugaucccugagcccgaucggcaacgcaccccucaggacaaccagcuggcguauguggucaucggacuccuuuuuaugauucugacaguggccgcuaacgaaaugggccugcucgagaccacgaagaaagaucuggggaucggacauguugccgccgagaaucaccaacacgcuaccaugcuugacguggaucugagacccgccagcgcguggacacucuacgccgucgcuaccacagugauuaccccuaugaugcggcauacgaucgaaaacacaaccgccaauauuucucugacagcuaucgccaaccaggcggccauucugaugggccucgacaagggcuggcccaucuccaaaauggauaucggggucccgcuucuggcucugggaugcuacagccaggugaauccucucacccugaccgccgcuguucuuaugcugguggcccacuaugcuauuaucggccccgggcuccaggccaaggcgacacgcgaggcccaaaagagaacggcugccggaauuaugaaaaaccccaccgucgacggcaucguggcuauugaucuggacccuguuguguacgacgccaaguucgaaaaacagcuggggcagaucaugcuccuuauccuguguacaucucagauucugcucaugcggaccacaugggcccugugcgaguccaucacccuugcgacgggaccgcugacaacccucugggaaggcagccccggcaaguuuuggaauaccacaauugcugucucuauggccaacaucuuccgcgggagcuaucuggcuggagccggccuggccuucucccucaugaaaucucuugggggaggcagacgggggaccggagcucaaggcgagacacugggcgagaaguggaagcgccagcugaaucagcucagcaaauccgaauuuaacacguacaagagaagcgggauuauggagguggaucgguccgaagccaaagagggacugaagagaggcgaaaccacaaaacaugcggugucucgcgggaccgccaagcuucggugguucguugagagaaaucuggucaagccugagggaaaagugaucgaccucggcugugggcgcggaggcuggagcuauuacugcgcuggccugaagaaagugacagaagucaagggguauaccaaaggaggccccgggcacgaggaaccuauccccauggccacguacggauggaaccugguuaagcuccauuccggcaaagauguguuuuucaugccuccggagaagugugacacccuucugugcgauauuggggaaucuagccccaauccuacaaucgaggagggacggacccugagagugcucaagauggucgaacccuggcugcgcggcaaccaguuuuguauuaaaauccuuaauccuuacaugcccuccgugguugaggcucuggaacaaaugcagcggaagcacggcgggaugcucgugagaaacccgcugucucgcaauagcacacacgagauguauugggucuccugcggaaccggcaacauugugagcgccguuaacaugacaucucggaugcugcucaauagauucaccauggcgcaucgcaaaccuacguacgagcgggacguggaucugggggccggaacaagacacgucgcuguggaacccgagguggccaaccuugacaucauuggccagcgcaucgaaaauaucaagaacgagcauaaauccaccuggcacuaugaugaagacaaucccuacaagaccugggcuuaucacgggagcuacgaggucaagccuucuggauccgccagcucuaugguuaacggcguggugagacugcucacaaaacccugggaugucauuccuauggugacgcaaaucgcuaugaccgacacaaccccguuuggccagcagcggguuuucaaggagaaaguggacacacgcacccccagagccaagcgggggacaacccagauuauggaagucacggcgaaauggcuguggggauuucuuuccagaaauaagaagccucggaucuguacccgcgaggaauucacaagaaaagugcggagcaacgccgcuauuggcgccguuuuuguggaugagaaucaauggaacuccgcuaaggaagccgucgaggacgagcgcuucugggaucuggugcauagagaacgggagcuccacaaacaggggaagugcgccaccugcguuuauaauaugaugggaaaacgcgaaaagaagcugggcgaguuugggaaagcgaagggcagcagagcuaucugguacauguggcugggagcccgguuccucgaauucgaggcccugggcuuuaugaacgaggaccauugguucucucgcgaaaauagccuuuccgggguggagggagaaggccugcacaaacucggguacauccugagagauauuucuaagauccccggaggcaacauguaugcugacgauacagccgggugggacacccggauuacggaggaugaccuucagaaugaggcuaaaaucacagaaauuauggagccugaacaugcccugcucgcgaccagcaucuuuaagcugacauaccagaacaaagucgugcgcguccaaagacccgccaagaacggcaccgugauggauguuaucucccggcgcgaccagagaggaucuggccagguggggacguauggacugaauaccuucacaaacauggagguccagcucauucggcaaauggaaagcgagggcaucuuucugccguccgagcuugaaaccccuaaucuggcugagagagugcucgauuggcuggaaaagcacggggccgagcgccuuaaacggauggcuauuucuggagacgacugugugguuaagcccaucgaugacagauucgccacagcgcugaccgcccucaacgauaugggcaaagugcgcaaggacauuccucagugggaacccagcaaaggguggaaugauuggcagcaggucccuuuuugcucccaccauuuccaccaacugaucaugaaggacggccgggagaucgugguucccuguagaaaccaggaugagcuggugggacgcgcucgggucagccagggcgccggguggucucucagagaaacagcuugccugggaaaguccuacgcccaaauguggcagcuuauguauuuucaucgccgggaccugagacucgcugccaaugcgauuuguagcgccgugccggucgauugggugccuaccucucgcacgacaugguccauccacgcucaccaucaguggaugaccaccgaggacaugcugagcguuuggaaccggguguggauugaagagaaucccuggauggaagauaaaacacacgucuccucuugggaggaggugcccuaccuuggcaagagagaagaccaguggugcgggagccugaucggacucaccgcccgggccacaugggcuacgaacauucaaguugccaucaaucaggugagacgccugauuggcaacgagaauuaucuggacuacaugaccuccaugaaacgguucaagaacgaaagcgauccugagggggcgcucugguga

SEQ ID NO: 18652 - RNA, 9879 nt, Artificial Sequence
  derived and/or modified CDS sequence (opt5) from DENV-1__KJ189337__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaucuggaaucggcaggaucugcuggucaccuucaaaacagcgcacgccaagaagcaagaaguggucgugcucggaucucaggagggcgcuaugcacaccgcccugaccggggccacagaaauucagacgagcggaaccacaaccaucuuugcuggccaucuuaaaugccgccugaagauggacaaacucacacugaaggggaccuccuauguuauguguacgggcagcuucaaacuggagaaggaaguggccgagacacagcacggaaccguccuugugcaaguuaaguacgagggcaccgaugcgccgugcaaaaucccuuucucuacacaggacgaaaagggggugacccagaacggaagacucauuacagcuaaucccaucgucacggauaaagagaagccugugaacauugaaaccgagccccccuuuggcgaguccuauaucgugguuggggccggagaaaaagcccugaagcugagcugguucaagaaaggcucuagcauugggaagauguuugaggcuacagcccggggcgcuagacgcauggccauccucggagacaccgcgugggauuucggcuccaucgggggagucuuuacaucugugggcaaacuggugcaucaggucuucgggaccgccuacggagugcuuuuuagcggcguuuccuggacgaugaagauugggaucggcauucugcucaccuggcugggacugaauagccggucuacaucccuuagcaugaccuguaucgcugugggcauggucacacucuaccugggggugaugguucaagccgacucuggaugcgugauuaacuggaaaggcagagaacugaaguguggguccggaaucuucgucaccaacgaggugcacacauggaccgaacaguauaaguuucaggcugauagcccuaaacgccucuccgccgcgauuggcaaggccugggaggaggggguuugcggcauccggucugcuacgagacuggaaaauaucauguggaaacagauuagcaacgagcuuaaucauauccugcucgaaaacgacaugaaguucacaguggucgugggagacgccaauggcauucuggcucaagggaaaaagaugauccgcccgcagcccauggagcacaaauacuccuggaagucuuggggaaaggccaaaauuaucggcgccgauauccagaacaccaccuuuauuaucgacgggccugauacacccgaauguccugacaaucagcgggcuuggaacauuugggagguggaggauuauggauucggcaucuuuaccacgaauauuuggcugaagcuuagagacagcuacacacaaaugugcgaucaccgccucauguccgcggccaucaaagacagcaaggcuguccaugccgauaugggcuauuggaucgaaucugagaaaaacgaaaccuggaagcuggcccgggcuuccuucauugagguuaagacauguaccuggcccaaaagccacacacuguggucuaauggggugcucgaauccgagaugaucauuccgaagaucuacggaggcccuauuagccagcauaacuauagacccggguacuucacccagacggccggaccuuggcaccugggcaaacuugagcuggacuuugaucucugcgaagggaccacaguggucguggacgagcacugcggaaaucgcggccccucucugcggaccacaaccguuacgggcaagaucauccaugaaugguguugcagaagcuguacacugccuccccuucgguuccgcggggaggauggaugcugguacggcauggagauuagaccggugaaagaaaaggaggaaaaccucguccgguccauggugagcgcggggucuggagagguugacuccuuuagccugggcauccugugugcuuccauuaugaucgaagaggugaugagaucucgcuggagccggaagaugcucaugaccgggacacuggccgucuuccuucugcucauuaugggacaacugaccuggaaugaccugaucagacuuugcauuauggugggcgccaacgcuuccgaucgcaugggcauggggaccacauaucuggcccucauggcgacguuuaaaaugagaccuauguucgcuguuggacugcucuuucggcgccugaccucuagagaggugcuucugcucacaaucggccugagccuggucgccuccguggaacuucccaacucucuggaggaacucggggacggacuggccaugggcaucaugaugcucaagcugcuuaccgaguuccagccccaccagcuguggacaacccuccugagccugacguuuauuaaaacaacccuuucccuggauuacgcuuggaagaccacagccauggcucucagcaucgugucucuguucccucucugucuguccaccacaagccagaaaacgaccuggcuuccgguccugcuggggucuuuuggaugcaagccccucacaauguuccugauuaccgaaaauaagaucuggggccggaaauccuggccucuuaacgagggcauuauggccaucgggaucguuagcauucugcucucuucccugcucaagaaugacgugccccuggcgggaccucuuaucgccggcgggaugcugauugcuuguuaugugaucagcggauccagcgccgaucugucucucgagaaagcugccgaagucagcugggagcaagaagccgagcauuccggcacaucucacaacauucugguggaaguucaggacgaugggaccaugaagaucaaagacgaggagcgcgaugacacgcuuaccauccugcucaaggcuacacugcucgcggugagcggagucuaccccauguccauuccugccacccuguuugugugguauuucuggcagaaaagaaagcagcggucuggcguucuuugggauacacccagcccgccugaaguggagcgcgcuguccuggacgauggcaucuacagaauucugcaacgggggcuccugggacgcucccaggugggcgucgggguguuccaggacggaguuuuucauaccauguggcacgugacaagaggcgccguccuuauguaucaggggaagcggcuggaacccucuugggccagcgugaaaaaggaccucaucuccuacggaggcggcuggagauuccaagggagcuggaauacgggagaggagguucaggugauugcugucgaaccuggcaaaaaccccaagaaugugcagaccacaccggggaccuuuaaaaccccugagggagaagugggcgccaucgcgcuggauuucaagcccgggacaucuggauccccuauuguuaaccgcgagggcaagaucgucggccucuacgggaauggaguggugacgaccagcggcacauaugucucugcuaucgcccaagccaaagcuucccaggaagggccccugcccgagauugaggacgaaguguuuaagaaacggaaccuuaccaucauggaucugcacccuggaagcggcaagacaagacgcuaccugccggccauuguucgggaggcgaucaaaagaaagcuccgcacccugauucuugcucccacgcggguggucgccuccgaaauggccgaggcucugaaggggaugccuaucagauaucagacaaccgccgugaaaucugaacauaccggccgcgagaucguugaccucaugugccacgcuacauucaccaugcggcugcugagccccgugagagucccuaauuacaacaugauuaucauggaugaggcccauuuuacagaccccgcguccauugccgcucggggauauaucagcacccgcgugggcaugggggaagccgcugccauuuucaugacggccacaccuccgggaucuguugaggcuuuuccccaguccaaugcggugauccaagaugaagagagagacaucccugaacggagcuggaacucuggcuacgauuggauuaccgacuuccccgggaagacagucugguuugugccuagcaucaaauccggaaaugauauugccaacugucuccgcaagaacggcaaaagagugauccagcuuucucggaagaccuucgacacggaguaucagaagaccaaaaauaacgacugggauuacgucguuacaaccgacauuagcgagaugggggcuaauuucagagccgaucgcgugaucgacccccggagaugccugaagccggugauucugaaagauggcccugaacgcgucauccucgccggacccaugcccgugacaguugcuuccgccgcgcagcggagaggccgcaucgggcggaaccaaaauaaggagggagaccaguacguguauaugggccagccucugaacaaugaugaagaccacgcucauuggaccgaggccaaaaugcuucuggauaacauuaauacacccgaggggaucauuccugcccucuuugaaccggagagagaaaagucugcugccaucgacggagaguaccgccugagaggcgaagcgcggaagaccuucgucgagcugaugcgcagaggggaucuccccguguggcuuagcuauaaaguugccuccgagggcuuucaguacagcgaccggcgcuggugcuucgauggagaaagaaacaaucaagugcuggaggaaaacauggacgucgagauuuggacgaaggaaggcgagcggaaaaagcugagaccucgcuggcucgacgcucggacauauucugauccccuggcccuuagagaguuuaaagaauucgcugccgggcgccgguccgugagcggagaccugauccucgagaucggcaagcugccucagcaccugacccucagagcucagaaugcccuugauaaccuggucaugcugcacaauuccgaacaggggggaaaagcguaccggcaugccauggaggaacuccccgacaccauugagacacugaugcuucuggcucucaucgccgugcugaccggcggcguuacacuguuuuuccucucugggaagggacuuggcaagacgagcauugggcugcugugugugaccgcuuccucugcccuccuguggauggccagcguggagccgcacuggaucgcugcguccauuauccuugaauuuuuccugaugguccuccugaucccugagcccgaucgccaaagaacaccucaggacaaccagcuggccuauguugugauuggacuccuuuuuaugauccugaccguggcugccaacgaaaugggccugcucgagacaaccaaaaaggaucuggggauuggacaugucgccgcugagaaucaccaacacgccacgaugcuugacguggaucugcggcccgcgagcgccuggacccucuacgcuguugccacaaccgugaucacaccuaugaugcgccauaccauugaaaacacgacagcuaauaucucucugaccgccauugcgaaccaggccgcuauccugaugggccucgacaaaggcuggcccaucuccaagauggauauuggggucccgcuucuggcccugggaugcuacagccaggugaauccucucacacugaccgcugccguccuuaugcugguggcucacuaugccaucauuggccccgggcuccaggcgaaagccaccagagaggcucaaaagcggacagccgcuggaaucaugaagaaccccacgguugacggcauuguggccaucgaucuggacccugucguguacgacgccaaauucgaaaagcagcuggggcagaucaugcuccuuauucuguguaccucucagauccugcucaugcgcacaaccugggcgcugugcgaguccauuacacuugcuaccggaccgcugacgacacucugggaaggcagccccggcaaauuuuggaauaccaccaucgccguuucuauggcuaacauuuucagagggagcuaucuggccggagccggccuggcuuucucccucaugaagucucuugggggaggccggcgcgggacaggagcccaaggcgagacccugggcgagaaauggaagagacagcugaaucagcucagcaaguccgaauuuaacacauacaaacggagcgggaucauggagguggauagauccgaagcgaaggagggacugaaacgcggcgaaacgaccaagcaugccgucucucgggggacagcuaaacuuagaugguucguggagcgcaaucuggugaagccugagggaaagguuaucgaccucggcugugggcggggaggcuggagcuauuacugcgccggccugaaaaaggucaccgaagugaaaggguauacaaagggaggccccgggcacgaggaaccuauucccauggcuaccuacggauggaaccuggugaaacuccauuccggcaaggaugucuuuuucaugccuccggagaaaugugacacgcuucugugcgauaucggggaaucuagccccaauccuaccauugaggagggaagaacacugcgcguucucaagaugguggaacccuggcugcggggcaaccaguuuuguaucaagauucuuaauccuuacaugcccuccguggucgagacccuggaacaaaugcagagaaaacacggcgggaugcucgugcgcaacccgcugucucggaauagcacacacgagauguauuggguuuccugcggaaccggcaacaucgugagcgccgucaacaugacaucuagaaugcugcucaaucgcuucaccauggcgcaucggaagccuacguuugagagagacguggaucugggggccggaacacgccacguugcuguggaacccgaggucgccaaccuugacauuaucggccagagaaucgaaaaugugaaaaacgagcauaaguccaccuggcacuacgaugaagacaaucccuauaaaaccugggcuuaccacgggagcuaugaggugaagccuucuggauccgccagcucuauggucaacggcguugugcggcugcucacaaagcccugggaugugauuccuauggucacgcaaaucgcuaugaccgacacaaccccguucggccagcagcgcguguuuaaagagaagguugacacaagaaccccccgggccaaaagagggacaacccagauuauggaagugacggcgaaguggcuguggggauuccuuucccggaauaaaaagccucgcaucuguaccagagaggaauuuacacggaagguccgcagcaacgccgcuauuggcgccguguucguugaugagaaucaauggaacuccgcuaaagaagccguggaggacgagagauuuugggaucugguccaucgggaacgcgagcuccacaagcaggggaaaugcgccaccugcguguacaauaugaugggaaagagagaaaaaaagcugggcgaguucgggaaggcgaaaggcagccgggcuaucugguauauguggcugggagcccgcuuccucgaauuugaggcccugggcuucaugaacgaggaccauugguuuucuagagaaaauagccuuuccgggguugagggagaaggccugcacaagcucggguacauccugcgggauauuucuaaaauccccggaggcaacauguacgcugacgauacagccgggugggacacccgcauuacggaggaugaccuucagaaugaggcuaagaucacagauauuauggaaccugagcaugcccugcucgcgaccagcaucuucaaacugacauaucagaacaagguggucagagugcaacggcccgccaaaaacggcaccgucauggacgugaucucccgcagagaucagcggggaucuggccagguugggacguacggacugaauaccuuuacaaacauggaagugcagcucauuagacaaauggagagcgaaggcaucuuccugccguccgagcuugagaccccuaaucuggcugaacgcguccucgacuggcuggagaagcacggggccgaacggcuuaagagaauggcuauuucuggagacgauuguguggugaaacccaucgacgaucgcuuugccacagcgcugaccgcccucaacgacaugggcaagguucggaaagauauuccucagugggagcccagcaagggguggaaugacuggcagcaggugccuuucugcucccaccauuuucaccaacugaucaugaaagauggcagagaaaucgucgugcccugucgcaaccaggacgagcugguuggacgggcuagagugagccagggcgccggguggucucuccgcgagacagcuugccugggaaaguccuaugcccaaauguggcagcuuauguacuuccaucggagagaucugcgccucgcugccaaugcgauuuguagcgccgucccgguggacugggucccuaccucucggacgacaugguccauccacgcucaccaucaguggaugaccaccgaagauaugcugagcguguggaacagaguuuggauugaggaaaaucccuggauggaggacaagacacacguguccucuugggaagagguccccuaucuuggcaaacgggaggaccaguggugcgggagccugaucggacucaccgccagagccacaugggcuacgaacauucaaguggccaucaaucagguucgccggcugauuggcaacgaaaauuaccuggauuauaugaccuccaugaagagauuuaaaaacgagagcgacccugaaggggcgcucugguga

SEQ ID NO: 18653 - RNA, 9879 nt, Artificial Sequence
  derived and/or modified CDS sequence (opt5) from DENV-1__KJ189340__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucuguguguguccaucaugauugaagaggucaugagaucucgcuggagccggaagaugcucaugacagggacccuggcuguguuccuucugcucguuaugggacaacugaccuggaaugaccugaucagacuuugcauuauggugggcgccaacgccuccgaucgcaugggcauggggacaacguaucuggcucucauggccaccuuuaaaaugagaccuauguucgcggucggacugcucuuucggcgccugacaucuagagaggugcuucugcucaccaucggccugagccugguggcuuccgucgaacuucccaacucucuggaggaacucggggacggacuggccaugggcauuaugaugcucaagcugcuuacagaguuccagccccaccagcuguggaccacgcuccugagccugacauuuaucaaaaccacccuuucccuggauuacgccuggaagacaaccgcuauggcccucagcaucguuucucuguucccucucugucuguccacaacgagccagaaaaccacauggcuuccggugcugcuggggucuuuuggaugcaagccccucaccauguuccugauuacagaaaauaagaucuggggccggaaauccuggccucuuaacgagggcauuauggcuaucgggauugugagcauccugcucucuucccugcucaagaaugacgucccccuggccggaccucuuaucgcgggcgggaugcugauugccuguuaugugaucagcggauccagcgcugaucugucucucgagaaagccgcugaaguuagcugggagcaagaagccgagcauuccggcaccucucacaacauucugguggaaguccaggacgaugggacgaugaagaucaaagacgaggagcgcgaugacacccuuacaauucugcucaaggccacccugcucgcugugagcggaguuuaccccauguccaucccugcgacacuguuugugugguauuucuggcagaaaaagaagcagagaucuggcguccuuugggauacccccagcccgccugaaguggagcgggccguccuggacgauggcaucuaccgcauucugcaaagagggcuccugggacggucccaggugggcguugggguguuccaggacggagucuuucauacaauguggcacgugacgcgcggcgcuguucuuauguaucaggggaaaagacuggaacccucuugggccagcgugaagaaagaccucaucuccuacggaggcggcuggcgguuccaagggagcuggaauaccggagaggagguccaggugauugccguggaaccuggcaagaaccccaaaaauguucagacaaccccggggaccuuuaagacaccugagggagaagucggcgcuaucgcccuggauuucaagcccgggacgucuggauccccuauugugaacagagagggcaaaaucgugggccucuacgggaauggagucgugaccacaggcgggaccuauguuagcgcgauugcucaagccaaggccucucaggaaggaccccugcccgagaucgaggacgaaguguuuaaaaagcgcaaccuuacaaucauggaucugcacccuggcuccgggaaaacccggagauaccugccggcuauuguccgcgaggccaucaagcggaagcucagaacgcugauucuugcgcccacacgcgugguugcuagcgaaauggccgaggcccugaaaggcaugccuauccgguaucagaccaccgcugugaaguccgaacauacaggaagagagauugucgaccucaugugccacgccaccuucacaaugcgccugcugucucccgugcggguuccuaauuacaacaugaucaucauggaugaggcucauuuuaccgaccccgccagcauugcggccagaggcuauaucuccacgcggguggggaugggagaagcugccgcuauuuucaugacagccaccccuccgggcagcgucgaggccuuuccccagucuaaugcugugauccaagaugaagagcgcgacauuccugaaagauccuggaacagcggguacgauuggaucacagacuuccccggaaaaaccgugugguuugucccuucuaucaagagcggcaaugauauugcgaacugucuccggaaaaacgggaagcgcguuauccagcuuuccagaaagacguucgacaccgaguaucagaaaacaaagaauaacgacugggauuacguggugaccacagacauuucugagaugggcgccaauuuccgggcugauagagucaucgacccccgccggugccugaaaccggugauucugaaggauggaccugaaagaguuauccucgccggccccaugcccgugaccgucgccagcgcugcccagcgccgggggagaauuggacgcaaccaaaauaaagagggcgaccaguacguguauauggggcagccucugaacaaugaugaagaccacgcgcauuggacagaggcuaagaugcuucuggauaacaucaauacccccgagggaaucauuccugcccucuuugaaccggagcgggaaaaguccgccgcuaucgacggcgaguacagacugcgcggggaagccagaaaaacguucguugagcugaugcggcgcggcgaucuccccguguggcuuucuuauaaggucgcgagcgagggauuucaguacuccgacagacgguggugcuucgauggcgaacgcaacaaucaagugcuggaggaaaacauggacgucgagauuuggacaaaagaaggggagagaaagaaacugcggccuagauggcucgacgcccgcaccuauagcgauccccuggcucuucgggaguuuaaggaauucgccgcuggaagacgcucuguguccggcgaccugauccucgagauugggaaacugccucagcaccugacccuccgggcccagaaugcucuugauaaccugguuaugcugcacaauagcgaacagggaggcaaggccuacagacaugcgauggaggaacuccccgacacaaucgagacccugaugcuucuggcccucaucgcugugcugacaggcggggugacgcuguuuuuccucuccggaaagggccuugggaaaaccucuauuggacugcugugugucacagccagcuccgcucuccuguggauggccucuguugagccgcacuggaucgccgcuagcauuauccuugaauuuuuccugauggugcuccugauuccugagcccgaucggcaacgcaccccucaggacaaccagcuggcguauguggucaucggccuccuuuuuaugauccugacaguggccgcuaacgaaauggggcugcucgagaccacgaagaaagaucugggaauuggccauguugccgccgagaaucaccaacacgcuaccaugcuugacguggaucugagacccgccuccgcguggacacucuacgccgucgcuaccacagugaucaccccuaugaugcggcauacgauugaaaacacaaccgccaauaucagccugacagcuauugccaaccaggcggccauccugaugggccucgacaagggguggcccauuucuaaaauggauaucggagucccgcuucuggcucugggcugcuacucccaggugaauccucucacccugaccgccgcuguucuuaugcugguggcccacuaugcuaucauugggcccggacuccaggccaaggcgacacgcgaggcccaaaagagaacggcugccggcaucaugaaaaaccccaccgucgacgggauuguggcuaucgaucuggacccuguuguguacgacgccaaguucgaaaaacagcugggacagauuaugcuccuuauccuguguacaagccagauccugcucaugcggaccacaugggcccugugcgagucuauuacccuugcgacgggcccgcugacaacccucugggaaggcucccccgggaaguuuuggaauaccacaaucgcugucagcauggccaacauuuuccgcggaucuuaucuggcuggcgccgggcuggccuucagccucaugaaaucccuuggaggcgggagacggggaaccggcgcucaaggcgagacacugggggagaaguggaagcgccagcugaaucagcucucuaaaagcgaauuuaacacguacaagagauccggaaucauggagguggaucggagcgaagccaaagagggccugaagagaggggaaaccacaaaacaugcggugucccgcggaaccgccaagcuucggugguucguugagagaaaucuggucaagccugagggcaaagugauugaccucggguguggacgcggcggcuggucuuauuacugcgcugggcugaagaaagugacagaagucaagggauauaccaaaggcgggcccggacacgaggaaccuauccccauggccacguacggcuggaaccugguuaagcuccauagcgggaaagauguguuuuucaugccuccggagaagugugacacccuucugugcgauaucggagaauccucucccaauccuacaauugaggagggccggacccugagagugcucaagauggucgaacccuggcugcgcggcaaccaguuuuguaucaaaauucuuaauccuuacaugcccagcgugguugaggcucuggaacaaaugcagcggaagcacgggggaaugcucgugagaaacccgcugucccgcaauucuacacacgagauguauugggucagcugcggcaccgggaacaucguguccgccguuaacaugacaagccggaugcugcucaauagauucaccauggcgcaucgcaaaccuacguacgagcgggacguggaucugggagccggcacaagacacgucgcuguggaacccgagguggccaaccuugacauuaucgggcagcgcauugaaaauaucaagaacgagcauaaaucuaccuggcacuaugaugaagacaaucccuacaagaccugggcuuaucacggauccuacgaggucaagccuagcggcucugccuccagcaugguuaacggcguggugagacugcucacaaaacccugggaugucaucccuauggugacgcaaauugcuaugaccgacacaaccccguuugggcagcagcggguuuucaaggagaaaguggacacacgcacccccaaggccaaaagaggaacaacccagaucauggaagucacggcgaaguggcuguggggcuuucuuucucggaauaagaaaccuagaauuuguacccgggaggaauucacacgcaaggugagauccaacgccgcuaucggggccguuuuuguggaugagaaucaauggaacagcgcuaaagaagccgucgaggacgagcgguucugggaucuggugcaucgcgaaagagagcuccacaagcagggaaaaugcgccaccugcguuuauaauaugaugggcaagcgggaaaagaaacugggggaguuuggcaaggcgaaaggaucccgcgcuauuugguacauguggcugggcgccagauuccucgaauucgaggcccugggguuuaugaacgaggaccauugguucagccgggaaaauucucuuagcggaguggagggcgaagggcugcacaagcucggauacauccugcgcgauaucuccaaaauucccggcgggaacauguaugcugacgauacagccggcugggacaccagaaucacggaggaugaccuucagaaugaggcuaagauuacagaaaucauggagccugaacaugcccugcucgcgaccucuauuuuuaaacugacauaccagaacaaggucgugcggguccaacgccccgccaagaacggaaccgugauggauguuaucagcagacgggaccagcgcggcuccgggcaggugggaacguauggccugaauaccuucacaaacauggagguccagcucaucagacaaauggaaucugaggggauuuuucugccgagcgagcuugaaaccccuaaucuggcugagcgggugcucgauuggcuggaaaaacacggagccgagagacuuaagcgcauggcuaucuccggcgacgacugugugguuaaacccauugaugaccgguucgccacagcgcugaccgcccucaacgauauggggaaggugagaaaagacaucccucagugggaacccucuaagggcuggaaugauuggcagcaggucccuuuuugcagccaccauuuccaccaacugauuaugaaggacggacgcgagaucgugguucccugucggaaccaggaugagcuggugggcagagcucgcgucucccagggggccggauggagccuccgggaaacagcuugccugggcaaaucuuacgcccaaauguggcagcuuauguauuuucauagacgcgaccugcggcucgcugccaaugcgaucuguuccgccgugccggucgauugggugccuaccagcagaacgacauggucuauucacgcucaccaucaguggaugaccaccgaggacaugcuguccguuuggaaccgcguguggaucgaagagaaucccuggauggaagauaagacacacgucagcuccugggaggaggugcccuaccuugggaaacgggaagaccaguggugcggaucucugauuggccucaccgccagagccacaugggcuacgaacauccaaguugccauuaaucaggugcggagacugaucgggaacgagaauuaucuggacuacaugaccagcaugaagcgcuucaaaaacgaauccgauccugagggcgcgcucugguga

SEQ ID NO: 18654 - RNA, 9879 nt, Artificial Sequence
  derived and/or modified CDS sequence (opt5) from DENV-1__KJ189341__SS-prME
agcgugaccaugcugcuuaugcugcuucccacagcgcuggcuuuccaccugacgaccagaggaggggaaccucauaugaucgucuccaagcaggaacggggaaaaucucugcuuuuuaagacaagcgcuggaguuaauaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggagggcaccgcagagagaagcggucugucgcccuggcuccucaugugggacucggacuggagacacgcaccgaaacguggaugagcuccgagggagccuggaaacagauucagagaguugaaacaugggcccuucggcaccccggguucaccgugaucgcccuguuucucgcgcaugccauuggaacaucuaucacccaaaagggcaucauuuucauccugcuuaugcuggucaccccuagcauggcuaugcgcugcguggggauuggaaauagagacuuuguugagggccucuccggggccacauggguggaugucgugcuggagcacggaagcugugugacgaccauggcuaagaauaaacccacacuggacaucgaacuccugaagaccgaggucacaaacccugccguucuucggaaacugugcauugaagcgaagaucucuaauaccacgacagauucccgcuguccgacccagggcgaggccacccucguggaagaacaagacgcuaacuucgugugcagacggacauuugucgaucgcggcugggggaauggauguggccuguucgggaaaggaagccuucugaccugcgccaaguuuaagugcgugacaaaacucgagggcaagauuguucaguacgaaaaccugaaauauucugugaucgucacggugcacaccggggaccaacaucagguuggaaaugagacaaccgaacacggcacaaucgcuaccauuacgccccaggccccuaccuccgagauccagcugacagauuacggcgcccucacccuggacuguagccccagaacagggcuugacuucaacgaaauggugcugcucaccaugaaggagaaaucuuggcugguccauaagcaaugguuucuugaucugccucuccccuggacguccggagcuagcacaucccaggagaccuggaaucggcaggaccugcuggugacauucaaaaccgcgcacgccaagaagcaagaagucgugguucucggcucucaggagggggcuaugcacaccgcccugacaggagccacggaaauucagaccagcggcacaaccacaaucuuugcugggcaucuuaaaugccgccugaagauggauaaacucacccugaagggcacguccuaugugauguguacaggaccguucaaacuggagaaggaagucgccgagacccagcacggcaccgugcuuguucaagugaaguacgaggggacagacgcgccuugcaaaauucccuucagcacccaggaugaaaagggagucacacagaacggcagacucaucacggcuaauccuaucgugaccgacaaagagaagcccgugaacauugaaacagagcccccuuuuggggagucuuauaucguugucggagccggcgaaaaagcccugaagcuguccugguucaagaaagggagcucuauuggcaagauguuugaggcuaccgcccggggagcuagacgcauggccauccucggcgauacagcgugggacuucgggagcauuggaggcguguuuaccuccguggggaaacugguccaucagguguucggaacggccuacggcguucucuuuucuggggugagcuggaccaugaagaucggcaucggcauucugcucacauggcugggccucaauucccggagcaccucucuuuccaugacauguaucgucguggggauuguuacccucuaccugggagugaugguccaagcugauagcggcugcgugaucaacuggaaagggagagaacugaaguguggaucuggcauuuucguuacaaacgaggugcacaccuggacggaacaguauaaguuucaggccgacuccccgaaacgccucagcgcugccaucgggaaggcgugggaggagggcgucugcggcauucgguccgccacaagacuggaaaauaucauguggaaacagaucucuaacgagcuuaaucauauucugcucgaaaacgauaugaaguucaccgugguggucggcgacgcuaaugggauccuggcccaaggcaagaagaugauucgcccccagccuauggagcacaaauacagcuggaaguccuggggcaaggcuaaaaucauuggggccgacacccagaacacaaccuuuaucaucgauggacccgacacgccugaaugucccgauaaucagcgggccuggaacauuugggagguugaggacuauggcuucggcaucuuuacaaccaauauuuggcugaaacuuagagauucuuacacacaaaugugcgaccaccgccucaugagcgcugcgaucaaagauuccaaggccgugcaugcugacaugggguauuggauugaaagcgagaaaaacgaaaccuggaagcuggcccgggccucuuucaucgaggugaagacauguaccuggccgaaaucccacacgcuguggagcaauggaguccucgaaucugagaugaucauuccuaagaucuacggcgggcccauuucccagcauaacuauagaccuggauacuucacccagacagcuggccccuggcaccuggggaaacuugagcuggauuuugaccucugcgaaggaaccacagugguuguggaugagcacugcggcaaucgcggcccuagccugcggaccacgacagucaccgggaagaucauucaugaaugguguugcagaucuuguacacugcccccgcuucgguuccgcggagaggacggcugcugguacgggauggagaucagaccugugaaagaaaaggaggaaaaccucguucggagcaugguguccgccggaagcggcgaggucgauucuuuuucccuggggauccugugugcgagcauuaugaucgaagaggugaugagaucccgcuggucucggaagaugcucaugaccggaacccuggcuguuuuccuucugcucauuaugggccaacugacauggaaagaccugaucagacuuugcauuauggugggcgccaaugccagcgaccgcauggggaugggaacgaccuaucuggcucucauggccacauuuaagaugagacccauguucgcggucggccugcucuuucggcgccugaccuccagagaggugcuucugcucacaaucgggcugucucugguggcuagcgucgaacuucccaacucccuggaggaacucggagauggccuggccauggggauuaugaugcucaaacugcuuaccgaguuccagccucaccagcuguggacgacacuccugucucugaccuuuaucaagaccacacuuagccuggacuacgccuggaaaaccacagcuauggcccucuccaucguuagccuguucccgcucugucugucuacgaccucccagaagacaaccuggcuucccgugcugcugggcagcuuuggcugcaagccuucuacaauguuccucauuaccgaaaacaaaaucuggggccggaaguccuggccccugaaugaggggauuauggcuaucggaauugugagcauccuucugucuucccuccugaaaaacgaugucccucucgccggcccccugaucgccggcgggaugcuuauugccuguuaugugaucagcggguccagcgcugaccugucucuggagaaggccgcugaaguuagcugggagcaagaagccgagcauuccgggacgucucacaauauucucguggaaguccaggaugacggaaccaugaaaaucaaggaugaggagcgcgacgauacacugaccauucuucugaaagccacacuccuggcugugagcggcguuuacccuauguccauccccgcgacccucuuugugugguauuucuggcagaagaagaaacagagaucuggcguccugugggacacaccgagcccucccgaaguggagcgggccguccuugaugacgggaucuaccgcauucugcaaagaggacugcucggccggucccagguggggguuggaguguuccaggauggcgucuuucauacgauguggcacgugacccgcggggcuguucugauguaucagggaaagagacuugaaccuucuugggccagcgugaaaaaggaccugaucuccuacggcggcggguggcgguuccaaggaagcuggaacacaggcgaggagguccaggugauugccguggaacccgggaaaaauccgaagaacguucagaccaccccuggaacauuuaagacgcccgagggcgaagucggggcuaucgcccucgacuucaaaccuggaaccucuggcucccccauugugaauagagagggcaagaucguggggcuguacggaaacggcgucgugacaaccagcgggacauauguuucugcgauugcucaagccaaagccucccaggaaggaccccucccugagaucgaggaugaaguguuuaagaaacgcaaucugaccaucauggaccuucacccgggcagcgggaagacgcggagauaccugcccgcuauuguccgcgaggccaucaagcggaaacugagaacacucauucuggcgccuacccgcgugguugcuuccgaaauggccgaggcccuuaagggcaugcccauccgguaucagaccacagcugugaaaucugaacauaccggaagagagauugucgaucugaugugccacgccacauucaccaugcgccuccugagcccugugcggguucccaacuacaauaugaucaucauggacgaggcucauuuuacggauccugccuccauugcggccagaggcuauaucagcacacggguggggaugggagaagcugccgcuauuuucaugaccgccacaccgcccggcucugucgaggccuuuccucaguccaacgcugugauccaagacgaagaaagagauauucccgaaagaagcuggaacucuggguacgacuggaucaccgauuucccuggaaagacggugugguuuguccccagcaucaaauccggcaacgacauugcgaauugucugcggaagaacgggaagcgcguuauccagcucucuagaaaaaccuucgauacagaguaucagaagaccaaaaacaaugacugggacuacguggugacaaccgauauuagcgagaugggcgccaacuuccgggcugacagagucaucgauccgcgccggugccuuaagccugugauucugaaagacggacccgaaagaguuauccuggccggccccaugccugugacagucgccuccgcugcccagcgccgggggagaauuggacgcaaucaaaacaaggagggcgaucaguacguguauauggggcagccccucaauaacgacgaagaucacgcgcauuggaccgaggcuaagaugcugcuugacaauaucaacacgccugagggaaucauuccggcccuguuugaacccgagcgggaaaaaucugccgcuaucgauggcgaguacagacuccgcggggaagccagaaagacauucguugagcugaugcggcgcggcgaccugccuguguggcucagcuauaaagucgcguccgagggcauucaguacagcgauagacgguggugcuuugacggcgaacgcaauaaccaagugcuugaggaaaauauggaugucgagaucuggaccaaggaaggggagcgcaagaagcugcggcccagauggcuggacgcccgcaccuauucugacccucucgcucugcgggaguucaaagaauuugccgcuggaagacgcuccgugagcggcgaucuuauucuggagaucgggaagcucccccagcaccugacacugcgggcccagaacgcucucgacaaucuuguuaugcugcacaacuccgaacagggaggcaaggccuacagacaugcgauggaggaacugccggauaccaucgagacacucaugcugcuugcccugauugcugugcucacgggcggggugacccuguucuuucugucuggaaaaggccucgggaagacaagcaucggacuucugugugucaccgccuccucugcucugcucuggauggccagcguugagcugcacuggauugccgcuuccaucauucuugaguucuuucugauggugcuccugaucccugagcccgaccggcaacgcacaccucaggauaaucagcuggcguauguggucaucggccuccuuuucaugauucugaccguggccgcuaacgaaauggggcugcucgagacgaccaaaaaggaccugggaaucggccauguugccgccgagaaccaccaacacgcuacaaugcuugauguggaccugagacccgccagcgcguggacccucuacgccgucgcuacaaccgugauuacgccuaugaugcggcauacaaucgaaaauaccacagccaacauuucucugaccgcuaucgccaaucaggcggccauucugaugggccucgauaaaggguggcccaucuccaagauggacaucggagucccgcuucuggcucugggcugcuacagccaggugaacccucucacccugacagccgcuguucuuaugcugguggcccacuaugcuauuaucgggcccggacuccaggccaaggcgacgcgcgaggcccagaaaagaaccgcugccggcauuaugaagaaucccacagucgaugggaucguggcuauugaccuggauccuguuguguacgacgccaaauuugaaaagcagcugggacagaucaugcuccuuauccuguguaccucucagauucugcucaugcggacaaccugggcccugugcgaguccaucacgcuugcgacaggcccgcugaccacccucugggaaggcagccccgggaaauucuggaacacaaccauugcugucucuauggccaauaucuuucgcggaagcuaucuggcuggcgccgggcuggccuucucccucaugaagucucuuggaggcgggagacggggaacaggcgcucaaggcgagacgcugggggagaaguggaaacgccagcugaaccagcucagcaaguccgaguucaauauuuacaaaagaagcggaaucauggagguggaccgguccgaagccaaggagggccugaaaagaggggaaaccacaaagcaugcggugucucgcggaaccgccaaacuucggugguuuguugagagaaaccuggucaaaccugagggcaaggugaucgaucucggguguggacgcggcggcuggagcuauuacugcgcugggcugaaaaaggugacagaagucaaaggauauaccaagggcgggcccggacacgaggaaccuauucccauggccacguacggcuggaaucugguuaaacuccauuccgggaaggacguguucuuuaugccuccggagaagugugauacccuucugugcgacaucggagaaucuagccccaacccuacaauugaggagggccggacccugagagugcucaaaauggucgaacccuggcugcgcggcaaucaguucuguaucaagauucuuaacccuuacaugcccuccgugguugagacacuggaacaaaugcagcggaaacacgggggaaugcucgugagaaauccgcugucucgcaacagcacccacgagauguauugggucuccugcggcacagggaauaucgugagcgcuguuaacaugaccucucggaugcugcucaacagauuuacgauggcccaucgcaagccuacauacgagcgggauguggaccugggagcgggcaccagacacgucgccguggaacccgagguggcuaaucuugauauuaucgggcagcgcaucgaaaacauuaaaaaugagcauaaguccaccuggcacuaugacgaagauaaccccuacaagacaugggccuaucacggaagcuacgaggucaaaccuucuggcuccgcuagcucuaugguuaauggcguggugagacugcucacgaagcccugggacgucaucccuauggugacccaaauugccaugacagauaccacaccguucgggcagcagcggguuuuuaaagagaagguggacacccgcacacccagagcuaaacggggaaccacgcagaucauggaagucaccgccaaguggcuguggggcuuccuuuccagaaacaagaaaccucggauuuguacacgcgaggaauuuaccagaaaggugcggagcaaugcggccaucggggcuguuuucguggacgagaaccaauggaacuccgccaaagaagcugucgaggaugagcgcuuuugggaccuggugcauagagaacgggagcuccacaagcagggaaaaugcgccacaugcguuuauaacaugaugggcaagcgcgaaaagaaacugggggaguucggcaaggccaaaggaagcagagcgaucugguacauguggcugggcgcucgguuucucgaguucgaggcccugggguucaugaaugaggaucauugguuuucucgcgaaaacagccuuuccggaguggagggcgaagggcugcacaagcucggauacauucugagagacaucucuaaaauucccggcgggaauauguaugccgaugacaccgcuggcugggauacgcggaucacagaggacgaucuucagaacgaggccaagauuaccgacaucauggaaccugagcaugcucugcucgccacaagcaucuucaaacugaccuaccagaauaaggucgugcgcguccaaagacccgcgaagaacggaacggugauggauguuauuucccggcgcgaccagagaggcucuggacaggugggaaccuauggccugaacacauuuaccaauauggaaguccagcucauccggcaaauggagagcgaagggauuuuccugccguccgagcuugagacaccuaaccuggccgaaagagugcucgauuggcuggagaaacacggagcugaacgccuuaagcggauggccaucucuggcgacgacugugugguuaaacccauugaugacagauuugcuaccgcccugacagcgcucaaugauauggggaaggugcgcaaagacaucccucagugggagcccagcaagggcuggaacgauuggcagcaggucccuuucugcucccaccauuuucaccaacugaucaugaaggacggacgggaaauugugguucccuguagaaaucaggaugagcuggugggccgcgcccgggucagccagggggcuggauggucucucagagagaccgccugccugggcaaauccuacgcucaaauguggcagcuuauguauuuccaucgccgggaccugagacucgccgcuaacgccaucuguagcgcggugccggucgauugggugccuacgucucgcacaaccugguccauucacgcccaccaucaguggaugaccacagaagacaugcugagcguuuggaaucggguguggaucgaggaaaaccccuggauggaggauaagacccacgucuccucuugggaagaggugcccuaccuugggaaaagagaggaccaguggugcggaagccugauuggccucacagcucgggccacgugggccaccaauauccaaguugcuauuaaccaggugagacgccugaucgggaaugaaaacuaucuggacuacaugacauccaugaagcgguuuaaaaaugagagcgauccugaaggcgcccucugguga

SEQ ID NO: 18655 - RNA, 9879 nt, Artificial Sequence
  derived and/or modified CDS sequence (opt5) from DENV-1__KJ189343__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugacagcccuguuucucgcgcaugccaucgggaccucuauuacccaaaagggaaucaucuucauucugcuuaugcuggucacaccuagcauggcuaugcgcugcgugggcaucgggaacagagauuuuguugagggacucuccggcgccacguggguggacgucgugcuggagcacgggagcugugugaccacaauggcuaagaauaaacccacccuggauauugaacuccugaagacagaggucaccaacccugccauccuucggaaacugugcauugaagcgaagaucucuaauacgacaaccgacucccgcuguccgacccagggagaggccacacucguugaagagcaggaugcuaacuucgugugcagacggaccuuuguggaccgcggcuggggcaauggguguggacuguucggcaaagggagccuucugacaugcgccaaguuuaagugcgucacgaaacucgagggaaagauugugcaguacgaaaaccugaaauauucuguuaucgugaccguccacacaggcgaucaacaucagguggggaaugagaccacagaacacggaaccaucgcuacgauuaccccccaggccccuacauccgagauccagcugaccgacuacggcgcccucacacuggacuguagccccagaaccggccuugauuucaacgaaaugguucugcucacgaugaaggagaaaucuuggcuggugcauaagcaaugguuucuugaccugccucuccccuggacauccggggcuagcaccucccaggagacauggaaucggcaggaucugcuggucaccuucaaaaccgcgcacgccaagaagcaagaaguggucgugcucggaucucaggagggcgcuaugcacacagcccugacgggggccaccgaaauucagacaagcggaaccacaaccaucuuugcuggccaucuuaaaugccgccugaagauggacaaacucacgcugaaggggacauccuauguuauguguaccggcagcuucaaacuggagaaggaaguggccgagacccagcacggaacaguccuugugcaaguuaaguacgagggcaccgaugcgccgugcaaaauuccuuucucuacacaggacgaaaagggggugacgcagaacggaagacucaucaccgcuaaucccaucgucacagauaaagagaagccugugaacauugaaaccgagccccccuuuggcgaguccuauaucgugguuggggccggagaaaaagcccugaagcugagcugguucaagaaaggcucuagcauugggaagauguuugaggcuacagcccggggcgcuagacgcauggccauccucggagacaccgcgugggauuucggcuccauugggggagucuuuacgucugugggcaaacuggugcaucaggucuucgggaccgccuacggagugcuuuuuagcggcguuuccuggacaaugaagaucgggaucggcauucugcucaccuggcugggacugaauagccggucuacaucccuuagcaugaccuguaucgcugugggcauggucacacucuaccugggggugaugguucaagccgacucuggaugcguggucaacuggaaaggcagagaacugaaguguggguccggaauuuucgugaccaacgagguucacacguggacagaacaguauaaguuucaggcugauagcccuaaacgccucuccgccgcgaucggcaaggccugggaggagggggugugcggcauucggucugcuaccagacuggaaaauaucauguggaaacagauuagcaacgagcuuaaucauauccugcucgaaaacgacaugaaguucaccgucguggugggagacgccaauggcauccuggcucaagggaaaaagaugauucgcccgcagcccauggagcacaaauacuccuggaagucuuggggaaaggccaaaaucauuggcgccgauauccagaacacaaccuuuauuaucgacgggccugauacgcccgaauguccugacaaucagcgggcuuggaacaucugggaggucgaggauuauggauucggcauuuuuacaaccaauaucuggcugaagcuuagagacagcuacacacaaaugugcgaucaccgccucauguccgcggccauuaaagacagcaaggcuguucaugccgauaugggcuauuggaucgaaucugagaaaaacgaaaccuggaagcuggcccgggcuuccuucauugaggugaagacauguaccuggcccaaaagccacacgcuguggucuaauggggugcucgaauccgagaugaucaucccgaagauuuacggaggcccuaucagccagcauaacuauagacccggguacuucacccagacagccggaccuuggcaccugggcaaacuugagcuggacuuugaucucugcgaagggaccacagucgugguugacgagcacugcggaaaucgcggccccucucugcggaccacgacagugaccggcaagauuauccaugaaugguguugcagaagcuguacacugccuccccuucgguuccgcggggaggauggaugcugguacggcauggagauuagaccggucaaagaaaaggaggaaaaccucgugcgguccaugguuagcgcggggucuggagagguggacuccuuuagccugggcauccugugugcuuccaucaugauugaagaggucaugagaucucgcuggagccggaagaugcucaugaucgggacccuggccguguuccuucugcucauuaugggacaacugaccuggaaugaccugaucagacuuugcauuaugguuggcgccaacgcuuccgaucgcaugggcauggggacaacguaucuggcccucauggcgaccuuuaaaaugagaccuauguucgcugugggacugcucuuucggcgccugacaucuagagagguccuucugcucaccaucggccugagccugguggccuccguggaacuucccaacucucuggaggaacucggggacggacuggccaugggcauuaugaugcucaagcugcuuacagaguuccagccccaccagcuguggaccacgcuccugagccugacauuuaucaaaaccacccuuucccuggauuacgcuuggaagacaaccgccauggcucucagcaucgucucucuguucccucucugucuguccacaacgagccagaaaaccacauggcuuccgguucugcuggggucuuuuggaugcaagccccucaccauguuccugauuacagaaaauaagaucuggggccggaaauccuggccucuuaacgagggcauuauggccaucgggauugugagcauccugcucucuucccugcucaagaaugacgugccccuggcgggaccucuuaucgccggcgggaugcugauugcuuguuaugucaucagcggauccagcgccgaucugucucucgagaaaaccgcugaagugagcugggagcaagaagccgagcauuccggcacgucucacaacauucugguugaagugcaggacgaugggaccaugaagaucaaagacgaggagcgcgaugacacacuuaccauucugcucaaggccacacugcucgcugucagcggaguguaccccauguccaucccugcgacccuguuuguuugguauuucuggcagaaaaagaagcagagaucuggcgugcuuugggauacacccagcccgccugaagucgagcgggccgugcuggacgauggcaucuaccgcauucugcaaagagggcuccugggacggucccaggucggcguggggguuuuccaggacggaguguuucauacgauguggcacgucacccgcggcgcugugcuuauguaucaggggaaaagacuggaacccucuugggccagcguuaagaaagaccucaucuccuacggaggcggcuggcgguuccaagggagcuggaauacaggagaggaggugcaggucauugccguggaaccuggcaagaaccccaaaaaugugcagaccaccccggggacauuuaagacgccugagggagaaguuggcgcuaucgcccuggauuucaagcccgggaccucuggauccccuauugucaacagagagggcaaaaucgugggccucuacgggaauggaguggucacaaccagcggcacauaugugucugcgauugcucaagccaaggccucccaggaagggccccugcccgagaucgaggacgaaguuuuuaaaaagcgcaaccuuaccaucauggaucugcacccuggaagcggcaaaacgcggagauaccugccggcuauugugcgcgaggccaucaagcggaagcucagaacacugauucuugcgcccacccgcgucguggcuuccgaaauggccgaggcccugaaagggaugccuauccgguaucagaccacagcuguuaagucugaacauaccggcagagagauuguggaccucaugugccacgccacauucaccaugcgccugcugagccccguccgggugccuaauuacaacaugaucaucauggaugaggcucauuuuacggaccccgccuccauugcggccagaggauauaucagcacacggguuggcaugggggaagcugccgcuauuuucaugaccgccacaccuccgggaucuguggaggccuuuccccaguccaaugcugucauccaagaugaagagcgcgacauuccugaaagaagcuggaacucuggcuacgauuggaucaccgacuuccccgggaaaacggugugguuugugccuagcaucaaguccggaaaugauauugcgaacugucuccggaaaaacggcaagcgcgucauccagcuuucuagaaagaccuucgacacagaguaucagaaaaccaagaauaacgacugggauuacguugugacaaccgacauuagcgagaugggggccaauuuccgggcugauagagugaucgacccccgccggugccugaaaccggucauucugaaggauggcccugaaagagugauccucgccggacccaugcccguuacaguggccuccgcugcccagcgccggggcagaauugggcgcaaccaaaauaaagagggagaccaguacgucuauaugggccagccucugaacaaugaugaagaccacgcgcauuggaccgaggcuaagaugcuucuggauaacaucaauacgcccgaggggaucauuccugcccucuuugaaccggagcgggaaaagucugccgcuaucgacggagaguacagacugcgcggcgaagccagaaaaacauucguggagcugaugcggcgcggggaucuccccguuuggcuuagcuauaagguggcguccgagggcuuucaguacagcgacagacgguggugcuucgauggagaacgcaacaaucaaguccuggaggaaaacauggacguggagauuuggaccaaagaaggcgagagaaagaaacugcggccuagauggcucgacgcccgcaccuauucugauccccuggcucuucgggaguuuaaggaauucgccgcugggagacgcuccgucagcggagaccugauccucgagauuggcaaacugccucagcaccugacacuccgggcccagaaugcucuugauaaccuggccaugcugcacaauuccgaacaggggggaaaggcguacagacaugccauggaggaacuccccgacaccaucgagacacugaugcuucuggcucucaucgccgugcugacgggcggcguuacccuguuuuuccucucugggaagggacuuggcaaaacaagcauugggcugcugugugugaccgcuuccucugcccuccuguggauggccagcguggagccgcacuggaucgcugcguccauuauccuugaauuuuuccugaugguccuccugauuccugagcccgaucggcaacgcacaccucaggacaaccagcuggccuauguugugaucggacuccuuuuuaugauccugaccguggcugccaacgaaaugggccugcucgagacgaccaagaaagaucuggggauuggacaugucgccgcugagaaucaccaacacgccacaaugcuugacguggaucugagacccgcgagcgccuggacccucuacgcuguugccacaaccgugaucacgccuaugaugcggcauacaauugaaaacaccacagcuaauaucucucugaccgccauugcgaaccaggccgcuauccugaugggccucgacaagggcuggcccauuuccaaaauggauaucggggucccgcuucuggcccugggaugcuacagccaggugaauccucucacccugacagcugccguccuuaugcugguggcucacuaugccaucauuggccccgggcuccaggcgaaggccacgcgcgaggcucaaaagagaaccgccgcuggaaucaugaaaaaccccacaguugacggcauuguggccaucgaucuggacccugucguguacgacgccaaguucgaaaaacagcuggggcagauuaugcuccuuauccuguguaccucucagauccugcucaugcggacaaccugggcgcugugcgaguccauuacgcuugcuacaggaccgcugaccacccucugggaaggcagccccggcaaguuuuggaauacaaccaucgccguuucuauggcuaacauuuuccgcgggagcuaucuggccggagccggccuggcuuucucccucaugaaaucucuugggggaggcagacgggggacaggagcccaaggcgagacgcugggcgagaaguggaagcgccagcugaaucagcucagcaaauccgaauuuaacaccuacaagagaagcgggaucauggagguggaucgguccgaagcgaaagagggacugaagagaggcgaaacaaccaaacaugccgucucucgcgggacagcuaagcuucggugguucguggagagaaaucuggugaagccugagggaaaaguuauugaccucggcugugggcgcggaggcuggagcuauuacugcgccggccugaagaaagucaccgaagugaagggguauacgaaaggaggccccgggcacgaggaaccuauccccauggcuaccuacggauggaaccuggugaagcuccauuccggcaaagaugucuuuuucaugccuccggagaagugugacacacuucugugcgauaucggggaaucuagccccaauccuaccauugaggagggacggacacugagaguucucaagaugguggaacccuggcugcgcggcaaccaguuuuguaucaaaauucuuaauccuuacaugcccuccguggucgagacccuggaacaaaugcagcggaagcacggcgggaugcucgugagaaacccgcugucucgcaauagcacacacgagauguauuggguuuccugcggaaccggcaacaucgugagcgccgucaacaugacgucucggaugcugcucaauagauucacaauggcgcaucgcaaaccuaccuuugagcgggacguggaucugggggccggaaccagacacguugcuguggaacccgaggucgccaaccuugacauuaucggccagcgcauugaaaauaucaagaacgagcauaaauccacauggcacuacgaugaagacaaucccuauaagacgugggcuuaccacgggagcuaugaggugaagccuucuggauccgccagcucuauggugaacggcgucguuagacugcucaccaaacccugggaugugaucccuauggugacacaaauugcuaugaccgacacaaccccguucggccagcagcgggucuuuaaggagaaaguggacacacgcacccccagagccaagcgggggacgacccagaucauggaaguuacagcgaaauggcuguggggauuccuuuccagaaauaagaagccucggauuuguacccgcgaggaauuuacaagaaaagugcggagcaacgccgcuaucggcgccgucuucguggaugagaaucaauggaacuccgcuaaggaagccguugaggacgagcgcuuuugggaucuggugcauagagaacgggagcuccacaaacaggggaagugcgccaccugcgucuacaauaugaugggaaaacgcgaaaagaagcugggcgaguucgggaaagcgaagggcagcagagcuauuugguauauguggcugggagcccgguuccucgaauuugaggcccugggcuucaugaacgaggaccauugguuuucucgcgaaaauagccuuuccgggguggagggagaaggccugcacaaacucggguacauccugagagauaucucuaagauucccggaggcaacauguacgcugacgauacggccgggugggacacacggaucaccgaggaugaccuucagaaugaggcuaaaauuacagauaucauggaaccugagcaugcccugcucgcgaccagcauuuucaagcugacguaucagaacaaaguugugcgcguccaaagacccgccaagaacggcaccgugauggacgucaucucccggcgcgaucagagaggaucuggccagguggggacauacggacugaauaccuuuacaaacauggaaguucagcucauccggcaaauggagagcgaaggcauuuuccugccguccgagcuugagaccccuaaucuggcugaaagagugcucgacuggcuggagaagcacggggccgaacgccuuaaacggauggcuaucucuggagacgauugugucgugaagcccauugacgauagauuugccacagcgcugaccgcccucaacgacaugggcaaagugcgcaaggauaucccucagugggagcccagcaaaggguggaaugacuggcagcagguuccuuucugcucccaccauuuucaccaacugauuaugaaggauggccgggaaaucgugguccccuguagaaaccaggacgagcuggugggacgcgcucggguuagccagggcgccggguggucucucagagagacggcuugccugggaaaguccuaugcccaaauguggcagcuuauguacuuccaucgccgggaucugagacucgcugccaaugcgaucuguagcgccgugccggucgacugggugccuacaucucgcaccaccugguccauucacgcucaccaucaguggaugacaaccgaagauaugcugagcgucuggaaccggguguggaucgaggaaaaucccuggauggaggacaaaacacacguuuccucuugggaagaggugcccuaucuuggcaagagagaggaccaguggugcgggagccugauuggacucacggcccgggccaccugggcuacaaacauccaagucgccauuaaucaggugagacgccugaucggcaacgaaaauuaccuggauuauaugaccuccaugaaacgguuuaagaacgagagcgacccugaaggggcgcucugguga

SEQ ID NO: 18656 - RNA, 9879 nt, Artificial Sequence
  derived and/or modified CDS sequence (opt5) from DENV-1__KJ189344__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugacagcccuguuucucgcgcaugccaucgggaccucuauuacccaaaagggaaucaucuucauucugcuuaugcuggucacaccuagcauggcuaugcgcugcgugggcaucgggaacagagauuuuguugagggacucuccggcgccacguggguggacgucgugcuggagcacgggagcugugugaccacaauggcuaagaauaaacccacccuggauauugaacuccugaagacagaggucaccaacccugccauccuucggaaacugugcauugaagcgaagaucucuaauacgacaaccgacucccgcuguccgacccagggagaggccacacucguugaagagcaggaugcuaacuucgugugcagacggaccuuuguggaccgcggcuggggcaauggguguggacuguucggcaaagggagccuucugacaugcgccaaguuuaagugcgucacgaaacucgagggaaagauugugcaguacgaaaaccugaaauauucuguuaucgugaccguccacacaggcgaucaacaucagguggggaaugagaccacagaacacggaaccaucgcuacgauuaccccccaggccccuacauccgagauccagcugaccgacuacggcgcccucacacuggacuguagccccagaaccggccuugauuucaacgaaaugguucugcucacgaugaaggagaaaucuuggcuggugcauaagcaaugguuucuugaccugccucuccccuggacauccggggcuagcaccucccaggagacauggaaucggcaggaucugcuggucaccuucaaaaccgcgcacgccaagaagcaagaaguggucgugcucggaucucaggagggcgcuaugcacacagcccugacgggggccaccgaaauucagacaagcggaaccacaaccaucuuugcuggccaucuuaaaugccgccugaagauggacaaacucacgcugaaggggacauccuauguuauguguaccggcagcuucaaacuggagaaggaaguggccgagacccagcacggaacaguccuugugcaaguuaaguacgagggcaccgaugcgccgugcaaaauuccuuucucuacacaggacgaaaagggggugacgcagaacggaagacucaucaccgcuaaucccaucgucacagauaaagagaagccugugaacauugaaaccgagccccccuuuggcgaguccuauaucgugguuggggccggagaaaaagcccugaagcugagcugguucaagaaaggcucuagcauugggaagauguuugaggcuacagcccggggcgcuagacgcauggccauccucggagacaccgcgugggauuucggcuccauugggggagucuuuacgucugugggcaaacuggugcaucaggucuucgggaccgccuacggagugcuuuuuagcggcguuuccuggacaaugaagaucgggaucggcauucugcucaccuggcugggacugaauagccggucuacaucccuuagcaugaccuguaucgcugugggcauggucacacucuaccugggggugaugguucaagccgacucuggaugcguggucaacuggaaaggcagagaacugaaguguggguccggaauuuucgugaccaacgagguucacacguggacagaacaguauaaguuucaggcugauagcccuaaacgccucuccgccgcgaucggcaaggccugggaggagggggugugcggcauucggucugcuaccagacuggaaaauaucauguggaaacagauuagcaacgagcuuaaucauauccugcucgaaaacgacaugaaguucaccgucguggugggagacgccaauggcauccuggcucaagggaaaaagaugauucgcccgcagcccauggagcacaaauacuccuggaagucuuggggaaaggccaaaaucauuggcgccgauauccagaacacaaccuuuauuaucgacgggccugauacgcccgaauguccugacaaucagcgggcuuggaacaucugggaggucgaggauuauggauucggcauuuuuacaaccaauaucuggcugaagcuuagagacagcuacacacaaaugugcgaucaccgccucauguccgcggccauuaaagacagcaaggcuguucaugccgauaugggcuauuggaucgaaucugagaaaaacgaaaccuggaagcuggcccgggcuuccuucauugaggugaagacauguaccuggcccaaaagccacacgcuguggucuaauggggugcucgaauccgagaugaucaucccgaagauuuacggaggcccuaucagccagcauaacuauagacccggguacuucacccagacagccggaccuuggcaccugggcaaacuugagcuggacuuugaucucugcgaagggaccacagucgugguugacgagcacugcggaaaucgcggccccucucugcggaccacgacagugaccggcaagauuauccaugaaugguguugcagaagcuguacacugccuccccuucgguuccgcggggaggauggaugcugguacggcauggagauuagaccggucaaagaaaaggaggaaaaccucgugcgguccaugguuagcgcggggucuggagagguggacuccuuuagccugggcauccugugugucuccaucaugauugaagaggugaugagaucucgcuggagccggaagaugcucaugaccgggacccuggcuguuuuccuucugcucgugaugggacaacugacauggaaugaccugaucagacuuugcauuauggucggcgccaacgccuccgaucgcaugggcauggggacgaccuaucuggcucucauggccacauuuaaaaugagaccuauguucgcggugggacugcucuuucggcgccugaccucuagagaggugcuucugcucacaaucggccugagccuggucgcuuccguugaacuucccaacucucuggaggaacucggggacggacuggccaugggcauuaugaugcucaagcugcuuaccgaguuccagccccaccagcuguggacgacacuccugagccugaccuuuaucaaaaccacacuuucccuggauuacgccuggaagaccacagcuauggcccucagcauugugucucuguucccucucugucuguccacgaccagccagaaaacaaccuggcuuccggugcugcuggggucuuuuggaugcaagccccucacaauguuccugaucaccgaaaauaagaucuggggccggaaauccuggccucuuaacgagggcauuauggcuaucgggauugucagcauccugcucucuucccugcucaagaaugacgugccccuggccggaccucuuauugcgggcgggaugcugaucgccuguuauguuaucagcggauccagcgcugaucugucucucgagaaagccgcugaagugagcugggagcaagaagccgagcauuccggcacgucucacaacauucuggucgaagugcaggacgaugggaccaugaagaucaaagacgaggagcgcgaugacacacuuaccauucugcucaaggccacacugcucgcuguuagcggaguguaccccauguccaucccugcgacccuguuugucugguauuucuggcagaaaaagaagcagagaucuggcgugcuuugggauacacccagcccgccugaagucgagcgggccgugcuggacgauggcauuuaccgcauccugcaaagagggcuccugggacggucccagguuggcgugggggucuuccaggacggaguguuucauacgauguggcacguuacccgcggcgcugugcuuauguaucaggggaaaagacuggaacccucuugggccagcgucaagaaagaccucaucuccuacggaggcggcuggcgguuccaagggagcuggaauacaggagaggaggugcaggugauugccguugaaccuggcaagaaccccaaaaauguccagaccaccccggggacauuuaagacgccugagggagaagugggcgcuaucgcccuggauuucaagcccgggaccucuggauccccuauugugaacagagagggcaaaaucgucggccucuacgggaauggagugguuacaaccagcggcacauaugugucugcgauugcucaagccaaggccucccaggaagggccccugcccgagaucgaggacgaagucuuuaaaaagcgcaaccuuaccauuauggaucugcacccuggaagcggcaaaacgcggagauaccugccggcuaucgugcgcgaggccaucaagcggaagcucagaacacugauucuugcgcccacccgcguuguggcuuccgaaauggccgaggcccugaaagggaugccuauccgguaucagaccacagcugucaagucugaacauaccggcagagagauuguggaccucaugugccacgccacauucaccaugcgccugcugagccccguucgggugccuaauuacaacaugaucauuauggaugaggcucauuuuacggaccccgccuccaucgcggccagaggauauaucagcacacgggucggcaugggggaagcugccgcuauuuucaugaccgccacaccuccgggaucuguggaggccuuuccccaguccaaugcugugauccaagaugaagagcgcgacauuccugaaagaagcuggaacucuggcuacgauuggaucaccgacuuccccgggaaaacggucugguuuguuccuagcauuaaguccggaaaugauaucgcgaacugucuccggaaaaacggcaagcgcgugauccagcuuucuagaaagaccuucgacacagaguaucagaaaaccaagaauaacgacugggauuacguggucacaaccgacauuagcgagaugggggccaauuuccgggcugauagagugaucgacccccgccggugccugaaaccgguuauucugaaggauggcccugaaagagugauccucgccggacccaugcccgucacaguggccuccgcugcccagcgccggggcagaauugggcgcaaccaaaauaaagagggagaccaguacguuuauaugggccagccucugaacaaugaugaagaccacgcgcauuggaccgaggcuaagaugcuucuggauaacaucaauacgcccgaggggauuaucccugcccucuuugaaccggagcgggaaaagucugccgcuaucgacggagaguacagacugcgcggcgaagccagaaaaacauucguggagcugaugcggcgcggggaucuccccgucuggcuuagcuauaagguggcguccgagggcuuucaguacagcgacagacgguggugcuucgauggagaacgcaacaaucaaguccuggaggaaaacauggacguggagauuuggaccaaagaaggcgagagaaagaaacugcggccuagauggcucgacgcccgcaccuauucugauccccuggcucuucgggaguuuaaggaauucgccgcugggagacgcuccguuagcggagaccugauccucgagauuggcaaacugccucagcaccugacacuccgggcccagaaugcucuugauaaccuggugaugcugcacaauuccgaacaggggggaaaggccuacagacaugcgauggaggaacuccccgacaccaucgagacacugaugcuucuggcccucauugcugugcugacgggcggcgucacccuguuuuuccucucugggaagggacuuggcaaaacaagcaucgggcugcuguguguuaccgccuccucugcucuccuguggauggccagcguggagccgcacuggaucgccgcuuccauuauccuugaauuuuuccugauggugcuccugauuccugagcccgaucggcaacgcacaccucaggacaaccagcuggcguaugucgugaucggacuccuuuuuaugauucugaccguugccgcuaacgaaaugggccugcucgagacgaccaagaaagaucuggggaucggacauguggccgccgagaaucaccaacacgcuacaaugcuugacgucgaucugagacccgccagcgcguggacccucuacgccguggcuacaaccgucaucacgccuaugaugcggcauacaauugaaaacaccacagccaauaucucucugaccgcuauugccaaccaggcggccauccugaugggccucgacaagggcuggcccauuuccaaaauggauaucggggugccgcuucuggcucugggaugcuacagccagguuaauccucucacccugacagccgcugugcuuaugcuggucgcccacuaugcuauuaucggccccgggcuccaggccaaggcgacgcgcgaggcccaaaagagaaccgcugccggaaucaugaaaaaccccacaguggacggcauuguugcuaucgaucuggacccuguggucuacgacgccaaguucgaaaaacagcuggggcagauuaugcuccuuauccuguguaccucucagauucugcucaugcggacaaccugggcccugugcgaguccaucacgcuugcgacaggaccgcugaccacccucugggaaggcagccccggcaaguuuuggaauacaaccaucgcugugucuauggccaacauuuuccgcgggagcuaucuggcuggagccggccuggccuucucccucaugaaaucucuugggggaggcagacgggggacaggagcucaaggcgagacgcugggcgagaaguggaagcgccagcugaaucagcucagcaaauccgaauuuaacaccuacaagagaagcgggaucauggagguggaucgguccgaagccaaagagggacugaagagaggcgaaacaaccaaacaugcgguuucucgcgggacagccaagcuucggugguucgucgagagaaaucuggugaagccugagggaaaagugauugaccucggcugugggcgcggaggcuggagcuauuacugcgcuggccugaagaaagucaccgaaguuaagggguauacgaaaggaggccccgggcacgaggaaccuauccccauggccaccuacggauggaaccuggugaagcuccauuccggcaaagauguguuuuucaugccuccggagaagugugacacacuucugugcgauauuggggaaucuagccccaauccuaccaucgaggagggacggacacugagaguccucaagaugguggaacccuggcugcgcggcaaccaguuuuguaucaaaauucuuaauccuuacaugcccuccguuguggaggcucuggaacaaaugcagcggaagcacggcgggaugcucgucagaaacccgcugucucgcaauagcacccacgagauguauuggguguccugcggaacaggcaacaucguuagcgccgugaacaugaccucucggaugcugcucaauagauucacgauggcgcaucgcaaaccuacauacgagcgggacgucgaucugggggccggaaccagacacguggcuguggaacccgaggucgccaaccuugacauuaucggccagcgcauugaaaauaucaagaacgagcauaaauccaccuggcacuaugaugaagacaaucccuacaagacaugggcuuaucacgggagcuacgagguuaagccuucuggauccgccagcucuauggugaacggcguggucagacugcucacgaaacccugggaugugauuccuaugguuacccaaaucgcuaugacagacaccacaccguuuggccagcagcggguguucaaggagaaagucgacacccgcacacccagagccaagcgggggaccacgcagaucauggaagugaccgcgaaauggcuguggggauuucuuuccagaaauaagaagccucggauuuguacacgcgaggaauucaccagaaaaguucggagcaacgccgcuaucggcgccguguuugucgaugagaaucaauggaacuccgcuaaggaagccguggaggacgagcgcuucugggaucugguucauagagaacgggagcuccacaaacaggggaagugcgccacaugcguguauaauaugaugggaaaacgcgaaaagaagcugggcgaguuugggaaagcgaagggcagcagagcuauuugguacauguggcugggagcccgguuccucgaauucgaggcccugggcuuuaugaacgaggaccauugguucucucgcgaaaauagccuuuccggggucgagggagaaggccugcacaaacucggguacauccugagagauauuucuaagauccccggaggcaacauguaugcugacgauaccgccgggugggacacgcggaucacagaggaugaccuucagaaugaggcuaaaauuaccgaaaucauggagccugaacaugcccugcucgcgacaagcauuuuuaagcugaccuaccagaacaaagugguccgcgugcaaagacccgccaagaacggcacgguuauggaugugaucucccggcgcgaccagagaggaucuggccaggucgggaccuauggacugaauacauucaccaacauggaggugcagcucauucggcaaauggaaagcgagggcaucuuucugccguccgagcuugaaacaccuaaucuggcugagagagugcucgauuggcuggaaaagcacggggccgagcgccuuaaacggauggcuaucucuggagacgacuguguugugaagcccauugaugacagauucgccaccgcgcugacagcccucaacgauaugggcaaaguccgcaaggacaucccucagugggaacccagcaaaggguggaaugauuggcagcaggugccuuuuugcucccaccauuuccaccaacugauuaugaaggacggccgggagaucguugugcccuguagaaaccaggaugagcuggucggacgcgcucgggugagccagggcgccggguggucucucagagaaaccgcuugccugggaaaguccuacgcccaaauguggcagcuuauguauuuucaucgccgggaccugagacucgcugccaaugcgauuuguagcgccgucccgguggauuggguuccuacgucucgcacaaccugguccauccacgcucaccaucaguggaugaccacagaggacaugcugagcguguggaaccgggucuggaucgaagagaaucccuggauggaagauaaaacccacguguccucuugggaggagguucccuaccuuggcaagagagaagaccaguggugcgggagccugauuggacucacagcccgggccacgugggcuaccaacauccaaguggccauuaaucaggucagacgccugaucggcaacgagaauuaucuggacuacaugacauccaugaaacgguucaagaacgaaagcgauccugagggggcgcucugguga

SEQ ID NO: 18657 - RNA, 9879 nt, Artificial Sequence
  derived and/or modified CDS sequence (opt5) from DENV-1__KJ189346__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaugagcggaaccacaaccauuuuugcuggccaucuuaaaugccgccugaagauggacaaacucacacugaaggggaccuccuauguuauguguacgggcagcuucaaacuggagaaggaaguggccgagacacagcacggaaccguccuugugcaaguuaaguacgagggcaccgaugcgccgugcaaaaucccuuucucuacacaggacgaaaagggggugacccagaacggaagacucaucacagcuaaucccauugucacggauaaagagaagccugugaacaucgaaaccgagccccccuuuggcgaguccuauauugugguuggggccggagaaaaagcccugaagcugagcugguucaagaaaggcucuagcaucgggaagauguuugaggcuacagcccggggcgcuagacgcauggccauucucggagacaccgcgugggauuucggcuccaucgggggagucuuuacaucugugggcaaacuggugcaucaggucuucgggaccgccuacggagugcuuuuuagcggcguuuccuggacgaugaagaucgggauuggcauccugcucaccuggcugggacugaauagccggucuacaucccuuagcaugaccuguauugcugugggcauggucacacucuaccugggggugaugguucaagccgacucuggaugcgugaucaacuggaaaggcagagaacugaaguguggguccggaauuuucgucaccaacgaggugcacacauggaccgaacaguauaaguuucaggcugauagcccuaaacgccucuccgccgcgaucggcaaggccugggaggaggggguuugcggcauucggucugcuacgagacuggaaaauaucauguggaaacagaucagcaacgagcuuaaucauauucugcucgaaaacgacaugaaguucacaguggucgugggagacgccaauggcauccuggcucaagggaaaaagaugauucgcccgcagcccauggagcacaaauacuccuggaagucuuggggaaaggccaaaaucauuggcgccgauauccagaacaccaccuuuaucauugacgggccugauacacccgaauguccugacaaucagcgggcuuggaacaucugggagguggaggauuauggauucggcauuuuuaccacgaauaucuggcugaagcuuagagacagcuacacacaaaugugcgaucaccgccucauguccgcggccauuaaagacagcaaggcuguccaugccgauaugggcuauuggaucgaaucugagaaaaacgaaaccuggaagcuggcccgggcuuccuucaucgagguuaagacauguaccuggcccaaaagccacacacuguggucuaauggggugauggaauccgagaugauuaucccgaagauuuacggaggcccuaucagccagcauaacuauagacccggguacuucacccagacggccggaccuuggcaccucggcaaacuggagcuugacuuugaucugugcgaagggaccacaguggucguggacgagcacugcggaaaucgcggccccucucuccggaccacaaccguuacgggcaagauuauccaugaaugguguugcagaagcuguacacugccuccccugcgguuccgcggggaggauggaugcugguacggcauggagaucagaccggugaaagaaaaggaggaaaaccuuguccgguccauggugagcgcggggucuggagagguugacuccuuuagccucggcauucugugugcuuccaucaugauugaagaggugaugagaucucgcuggagccggaagaugcugaugaccgggacacucgccgucuuccugcuucuggugaugggacaacucaccuggaaugaccugaucagacugugcauuaugguuggcgccaacgcuuccgaucgcaugggcauggggaccacauaucuugcccugauggcgacguuuaaaaugagaccuauguucgcugugggacuccuguuucggcgccucaccucuagagagguccugcuucugacaaucggccucagccugguggccuccguggaacugcccaacucucuugaggaacugggggacggacucgccaugggcauuaugaugcugaagcuccugaccgaguuccagccccaccagcuuuggacaacccugcucagccugacguuuaucaaaacaacccugucccuugauuacgcuuggaagaccacagccauggcucugagcaucgucucucucuucccucugugucucuccaccacaagccagaaaacgaccuggcugccgguucuucuggggucuuuuggaugcaagccccugacaauguuccucauuaccgaaaauaagaucuggggccggaaauccuggccucugaacgagggcauuauggccaucgggauugugagcauccuucugucuucccuccugaagaaugacgugccccucgcgggaccucugaucgccggcgggaugcuuauugcuuguuaugucaucagcggauccagcgccgaucugucucuggagaaagcugccgaagugagcugggagcaagaagccgagcauuccggcacaucucacaacauucucguugaagugcaggacgaugggaccaugaagaucaaagacgaggagcgcgaugacacgcugaccauucuucugaaggcuacacuccuggcggucagcggaguguaccccauguccaucccugccacccucuuucugugguauuucuggcagaaaaagaagcagagaucuggcguucuuugggauacacccagcccgccugaaguggagcgggcuguccuggacgauggcaucuaccgcauucugcaaagagggcuccugggacggucccaggugggcgucgggguguuccaggacggaguuuuucauaccauguggcacgugacacgcggcgccguccuuauguaucaggggaaaagacuggaacccucuugggccagcgugaagaaagaccucaucuccuacggaggcggcuggcgguuccaagggagcuggaauacgggagaggagguucaggugauugcugucgaaccuggcaagaaccccaaaaaugugcagaccacaccggggaccuuuaagaccccugagggagaagugggcgccaucgcgcuggauuucaagcccgggacaucuggauccccuauuguuaacagagagggcaaaaucgucggccucuacgggaauggaguggugacgaccagcggcacauaugucucugcuauugcccaagccaaggcuucccaggaagggccccugcccgagaucgaggacgaaguguuuaaaaagcgcaaccuuaccaucauggaucugcacccuggaagcggcaaaacacggagauaccugccggccauuguucgcgaggcgaucaagcggaagcucagaacccugauucuugcucccacgcgcguggucgccuccgaaauggccgaggcucugaaagggaugccuauccgguaucagacaaccgccgugaagucugaacauaccggcagagagauuguugaccucaugugccacgcuacauucaccaugcgccugcugagccccgugcgggucccuaauuacaacaugaucaucauggaugaggcccauuuuacagaccccgcguccauugccgcuagaggauauaucagcacccgggugggcaugggggaagccgcugccauuuucaugacggccacaccuccgggaucuguugaggcuuuuccccaguccaaugcggugauccaagaugaagagcgcgacauuccugaaagaagcuggaacucuggcuacgauuggaucaccgacuuccccgggaaaacagucugguuugugccuagcaucaaguccggaaaugauauugccaacugucuccggaaaaacggcaagcgcgugauccagcuuucuagaaagaccuucgacacggaguaucagaaaaccaagaauaacgacugggauuacgucguuacaaccgacauuagcgagaugggggcuaauuuccgggccgauagagugaucgacccccgccggugccugaaaccggugauucugaaggauggcccugaaagagucauccucgccggacccaugcccgugacaguugcuuccgccgcgcagcgccggggcagaauugggcgcaaccaaaauaaagagggagaccaguacguguauaugggccagccucugaacaaugaugaagaccacgcucauuggaccgaggccaagaugcuucuggauaacaucaauacacccgaggggaucauuccugcccucuuugaaccggagcgggaaaagucugcugccaucgacggagaguacagacugcgcggcgaagcgagaaaaaccuucgucgagcugaugcggcgcggggaucuccccguguggcuuagcuauaagguugccuccgagggcuuucaguacagcgacagacgguggugcuucgauggagaacgcaacaaucaagugcuggaggaaaacauggacgucgagauuuggacgaaagaaggcgagagaaagaaacugcggccuagauggcucgacgcucgcacauauucugauccccuggcccuucgggaguuuaaggaauucgcugccgggagacgcuccgugagcggagaccugauccucgagauuggcaaacugccucagcaccugaccucccgggcucagaaugcccucgauaaccuugucaugcugcacaauucugaacaggggggaaaggcguacagacaugccauggaggaacugcccgacaccaucgagacacucaugcugcuugcucugaucgccgugcucaccggcggcguuacacuguuuuuccugagcgggaagggacucggcaaaacguccauugggcuucugugugugaccgcuucuagcgcccugcucuggauggccuccguggagccgcacuggaucgcugcgagcauuauccuggaauuuuuccuuaugguccugcucauuccugagcccgaucggcaacgcacaccucaggacaaccagcuggccuauguugugaucggacugcucuuuaugauccuuaccguggcugccaacgaaaugggccugcuggagacaaccaagaaagaucucgggauuggacaugucgccgcugagaaucaccaacacgccacgaugcuggacguggaucuuagacccgcgucugccuggacccuguacgcuguugccacaaccgugaucacaccuaugaugcggcauaccauugaaaacacgacagcuaauaucucccucaccgccauugcgaaccaggccgcuauccugaugggccuggacaagggcuggcccauuagcaaaauggauaucggggucccgcuccuugcccugggaugcuacucucaggugaauccucugacacucaccgcugccguccugaugcuuguggcucacuaugccaucauuggccccgggcugcaggcgaaggccacccgcgaggcucaaaagagaacagccgcuggaaucaugaaaaaccccacgguugacggcauuguggccaucgaucucgacccugucguguacgacgccaaguucgaaaaacagcuggggcagauuaugcugcucauccuuuguaccucccagauccugcugaugcggacaaccugggcgcucugcgagagcauuacacuggcuaccggaccgcuuacgacacugugggaaggcucucccggcaaguuuuggaauaccaccaucgccguuagcauggcuaacauuuuccgcggguccuaucucgccggagccggccuggcuuucucucugaugaaaagccucgggggaggcagacgggggacaggagcccaaggcgagacccuuggcgagaaguggaagcgccagcugaaucagcuguccaaaagcgaauuuaacacauacaagagauccgggaucauggagguggaucggucugaagcgaaagagggacucaagagaggcgaaacgaccaaacaugccgucagccgcgggacagcuaagcugcggugguucguggagagaaaucuugugaagccugagggaaaaguuauugaccugggcugugggcgcggaggcugguccuauuacugcgccggccucaagaaagucaccgaagugaagggguauacaaaaggaggccccgggcacgaggaaccuauccccauggcuaccuacggauggaaccuggccaagcugcauucuggcaaagauguguuuuucaugccuccggagaagugugacacgcuccuuugcgauaucggggaaagcucccccaauccuaccauugaggagggacggacacugagaguccugaagaugguugaacccuggcuccgcggcaaccaguuuuguaucaaaauucugaauccuuacaugcccucugugguggagacccuugaacaaaugcagcggaagcacggcgggaugcuggucagaaacccgcucagccgcaauuccacacacgagauguauugggugagcugcggaaccggcaacaucguuucugcggugaacaugacaucccggaugcugcugaauagauucaccacggcccaucgcaaaccuacauacgagcgggacgucgaucucggggcuggaaccagacacguggccguugaacccgagguggcuaaccuggacauuaucggccagcgcauugaaaauaucaagaacgagcauaaaagcaccuggcacuaugaugaagacaaucccuacaagacaugggccuaucacgggucuuacgaggucaagccuuccggaagcgcuucuuccauggugaacggcguggucagacuucugacgaaacccugggauguuaucccuauggugacccaaauugccaugacagacaccacaccguuuggccagcagcggguguucaaggagaaagucgacacccgcacacccagagcgaagcgggggaccacgcagaucauggaagugaccgccaaauggcucuggggauuucugagcagaaauaagaagccucggauuuguacacgcgaggaauucaccagaaaaguucgguccaacgcugccaucggcgcuguguuugucgaugagaaucaauggaacagcgccaaggaagccguggaggacgagcgcuucugggaucuuguucauagagaacgggagcugcacaaacaggggaagugcgcgacaugcguguauaauaugaugggaaaacgcgaaaagaagcucggcgaguuugggaaagcuaagggcucuagagccauuugguacauguggcugggagcccgguuccuggaauucgaggcucucggcuuuaugaacgaggaccauugguucagccgcgaaaauucccugucuggggucgagggagaaggccuucacaaacugggguacauccucagagauaucagcaagauucccggaggcaacauguaugccgacgauaccgcugggugggacacgcggaucacagaggaugaccugcagaaugaggccaaaauuaccgaaaucauggagccugaacaugcgcuucuggccacauccauuuuuaagcucaccuaccagaacaaagugguucgcgugcaaagacccgcuaagaacggcacggucauggaugugaucucucggcgcgaccagagaggaagcggccaggucgggaccuauggacugaauacauucaccaacauggaggugcagcugauccggcaaauggaauccgagggcauuuuucucccgucugagcuggaaacaccuaaucuugccgagagaguucuggauuggcucgaaaagcacggggcugagcgccugaaacggauggccaucagcggagacgacuguguggucaagcccauugaugacagauucgcgaccgcccuuacagcucugaacgauaugggcaaagugcgcaaggacauccuccagugggaaccuuccaaaggguggaaugauuggcagcaggugcccuuuugcagccaccauuuccaccaacugauuaugaaggacggccgggagaucguugugccuuguagaaaccaggaugagcuggucggacgcgcccgggugucucagggcgcuggguggucccucagagaaaccgccugccugggaaagagcuacgcucaaauguggcagcuuauguauuuucaucgccgggaccugagacucgccgcgaaugccaucuguucugcuguucccguggauugggucccgacgucccgcacaaccuggagcauucacgcccaccaucaguggaugaccacagaggacaugcuguccguguggaaccgggucuggaucgaagagaauccuuggauggaagauaaaacccacgugucuagcugggaggagguucccuaccuuggcaagagagaagaccaguggugcgggucccugauuggacucacagcccgggcuacgugggccaccaacauccaaguggcgauuaaucaggucagacgccugaucggcaacgagaauuaucuggacuacaugacaagcaugaaacgguucaagaacgaaucugaucccgagggggcucucugguga

SEQ ID NO: 18658 - RNA, 9879 nt, Artificial Sequence
  derived and/or modified CDS sequence (opt5) from DENV-1__KJ189347__SS-prME
agcgugaccaugcugcugaugcugcuucccaccgcccuggcuuuccaccucacgaccagaggcggggaaccucauaugaucgucuccaagcaggaacggggaaagucucugcuuuuuaagacaagcgccggcguuaacaugugcacccugauugcgauggaccucggggagcugugugaagauacaaugaccuacaagugcccgcagaucacagaggcugaacccgacgauguggacuguuggugcaaugccaccgauacgugggugaccuauggaacauguucccagaccggcgagcaccgcagagacaagcggucuguugcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagaacaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcccguucaaacuggagaaggaaguggccgagacccagcacggaaccguccuugugcaaguuaaguacgagggcacagaugcgccuugcaaaauccccuuccucacccaggacgaaaagggggugacacagaacggaagacugaucacggcuaauccuauugucaccgauaaagagaagcccgugaacaucgaaacagagcccccuuuuggcgagagcuauauugugguuggggccggagaaaaagcccugaagcucucuugguucaagaaaggcuccagcaucgggaagauguuugaggcuaccgcccggggcgcuagacgcauggccauucugggagacacagcgugggauuucggcucuaucgggggagucuuuaccagcgugggcaaacuugugcaucaggucuucgggacggccuacggagugcuguuuuccggcguuucuuggaccaugaagaucgggauuggcauccuccugacauggcugggacuuaauagccgguccaccagccucucuaugacauguauugcugugggcauggucacccuguaccugggggugaugguucaagccgacuccggaugcgugaucaacuggaaaggcagagaacucaagugugggagcggaauuuucgucacaaacgaggugcacaccuggacggaacaguauaaguuucaggcugauucuccgaaacgccuguccgccgcgaucggcaaggccugggaggaggggguuugcggcauucggagcgcuacaagacuugaaaauaucauguggaaacagaucuccaacgagcugaaucauauucuccuggaaaacgacaugaaguucaccguggucgugggagacgccaauggcauccuggcucaagggaaaaagaugauucgcccccagccuauggagcacaaauacucuuggaaaagcuggggaaaggccaagaucauuggcgccgauauccagaacaccacauuuaucauugacgggcccgauaccccugaaugucccgacaaucagcgggcuuggaacaucugggagguggaggauuauggauucggcauuuuuacgacaaauaucuggcuuaagcucagagacuccuacacccaaaugugcgaucaccgccugaugucugcggccauuaaagacagcaaggcuguccaugccgauaugggcuauuggaucgaauccgagaaaaacgaaacauggaagcuggcccgggcuagcuucaucgagguuaagaccuguacauggccgaaaucucacacccucugguccaauggggugcuggaaagcgagaugauuaucccuaagauuuacggaggccccaucucucagcauaacuauagaccuggguacuucacgcagaccgccggacccuggcaccuuggcaaacuggagcucgacuuugaucugugcgaagggacaaccguggucguggacgagcacugcggaaaucgcggcccuucccugcggacaaccacgguuacaggcaagauuauccaugaaugguguugcagaagcuguacccuucccccgcuccgguuccgcggggaggauggaugcugguacggcauggagaucagaccugugaaagaaaaggaggaaaaccugguccggucuauggugagcgcgggguccggagagguugacagcuuuucucugggcauucucuguguguccaucaugauugaagaggucaugagaagccgcuggucccggaagaugcugaugacagggacccuugcuguguuccugcuccugguuaugggacaacugaccuggaaugaccuuaucagacugugcauuauggugggcgccaacgccucugaucgcaugggcauggggacaacguaucucgcucugauggccaccuuuaaaaugagacccauguucgcggucggacuccuguuucggcgccuuacaagcagagaggugcugcuccugaccaucggccugucccuuauggcuucuguggaacugcccaacagccucgaggaacugggggacggacucgccaugggcauuaugaugcugaaacuucugacagaguuccagccucaccagcucuggaccacgcugcugucccuuacauuuaucaaaaccacccugucucucgauuacgccuggaagacaaccgcuauggcccugagcaucgucucccucuucccgcugugucuuagcacaacgucucagaaaaccacauggcugcccguucugcucggguccuuuggaugcaagccucugaccauguuccuuauuacagaaaauaagaucuggggccggaaaagcuggccccugaacgagggcauuauggcuaucgggauugugucuauccuccuguccagccuccugaagaaugacgugccucuugccggaccccugaucgcgggcgggaugcugauugccuguuaugucaucucuggauccagcgcugaucucucccuggagaaagccgcugaagugagcugggagcaagaagccgagcauucuggcaccagccacaacauucuuguugaagugcaggacgaugggacgaugaagaucaaagacgaggagcgcgaugacacccugacaauucuccugaaggccacccuccuggcugucuccggaguguacccuaugucuauccccgcgacacuuuuuguuugguauuucuggcagaaaaagaagcagagaagcggcgugcugugggauaccccguccccucccgaagucgagcgggccgugcuggacgauggcaucuaccgcauucuccaaagagggcugcuuggacggucucaggucggcguggggguuuuccaggacggaguguuucauacaauguggcacgucacgcgcggcgcugugcugauguaucaggggaaaagacucgaaccuagcugggccuccguuaagaaagaccugaucucuuacggaggcggcuggcgguuccaagggagcuggaauaccggagaggaggugcaggucauugccguggaacccggcaagaacccgaaaaaugugcagacaaccccugggaccuuuaagacacccgagggagaaguuggcgcuaucgcccucgauuucaagccugggacguccggaagccccauugucaacagagagggcaaaaucgugggccuguacgggaauggaguggucaccacaucuggcaccuauguguccgcgauugcucaagccaaggccagccaggaagggccccuuccugagaucgaggacgaaguuuuuaaaaagcgcaaccugacaaucauggaucugcacccgggaucuggcaaaacccggagauaccuccccgcuauugugcgcgaggccaucaagcggaagcugagaacgcuuauucuggcgccuacacgcgucguggcuuccgaaauggccgaggcccucaaagggaugcccauccgguaucagaccaccgcuguuaagagcgaacauacaggcagagagauuguggaccugaugugccacgccaccuucacaaugcgccugcucuccccuguccgggugcccaauuacaacaugaucaucauggaugaggcucauuuuaccgacccugccucuauugcggccagaggauauaucagcacgcggguuggcaugggggaagcugccgcuauuuucaugacagccaccccgcccggauccguggaggccuuuccucagagcaaugcugucauccaagaugaagaacgcgacauucccgaaagaucuuggaacuccggcuacgauuggaucacagacuucccugggaaaaccgugugguuugugcccagcaucaagucuggaaaugauauugcgaacugucuucggaaaaacggcaagcgcgucauccagcugagcagaaagacguucgacaccgaguaucagaaaacaaagaauaacgacugggauuacguugugaccacagacauuuccgagaugggggccaauuuccgggcugauagagugaucgacccgcgccggugccugaaaccugucauucucaaggauggccccgaaagagugauccuggccggacccaugccuguuaccguggccucugcugcccagcgccggggcagaauugggcgcaaccaaaauaaagagggagaccaguacgucuauaugggccagccccuuaacaaugaugaagaccacgcgcauuggacagaggcuaagaugcugcucgauaacaucaauaccccugaggggaucauuccggcccuguuugaacccgagcgggaaaagagcgccgcuaucgacggagaguacagacugcgcggcgaagccagaaaaacguucguggagcucaugcggcgcggggaucuuccuguuuggcuguccuauaagguggcgucugagggcuuucaguacagcgacagacgguggugcuucgauggagaacgcaacaaucaaguccuggaggaaaacauggacguggagauuuggacaaaagaaggcgagagaaagaaacuccggcccagauggcuggacgcccgcaccuauuccgauccucuugcucugcgggaguuuaaggaguucgccgcugggagacgcagcgucucuggagaccucauccuggagauuggcaaacugccccagcaccucacccuucgggcccagaaugcucuggauaaccuggugaugcuccacaauuccgaacaagggggaaaggccuacagacaugcgauggaggaacugccggacacaaucgagacccuuaugcugcucgcccugaucgcuguucugacaggcggcgugacgcucuuuuuccuuagcgggaagggacugggcaaaaccuccauugggcugcucugugugacagccucuagcgcucugcuuuggauggccuccgucgagccucacuggaucgccgcuucuauuauccuggaauuuuuccucaugguucugcugauucccgagccugaucggcaacgcacaccccaggacaaccagcucgcguauguggugaucggacuucuguuuaugauccugacagucgccgcuaacgaaaugggccuccuggagaccacgaagaaagaucuugggauuggacauguggccgccgagaaucaccaacacgcuaccaugcuggacguugaucucagaccugccagcgcguggacacuguacgccguggcuaccacagucaucacccccaugaugcggcauacgauugaaaacacaaccgccaauaucucccugacagcuauugccaaccaggcggccauccucaugggccuugacaagggcuggccgauuagcaaaauggauaucggggugccucugcuggcucucggaugcuacucucaggucaauccccugacccuuaccgccgcugugcugaugcucguugcccacuaugcuaucauuggccccgggcugcaggccaaggcgacacgcgaggcccaaaagagaacggcugccggaaucaugaaaaacccuaccguggacggcauugucgcuaucgaucuggacccggugguuuacgacgccaaguucgaaaaacagcucgggcagauuaugcuucugauccuguguacaucccagauccuccugaugcggaccacaugggcccuuugcgagagcauuacccuggcgacgggaccccucacaacccugugggaaggcucuccuggcaaguuuuggaauaccacaaucgcuguguccauggccaacauuuuccgcgggagcuaucuggcuggagccggccucgccuucucucuuaugaaaagccucgggggaggcagacgggggaccggagcucaaggcgagacacugggcgagaaguggaagcgccagcucaaucagcuguccaaaucugaauuuaacacguacaagagaagcgggaucauggaggucgaucgguccgaagccaaagagggacuuaagagaggcgaaaccacaaaacaugcggugagccgcgggaccgccaagcugcggugguucguggagagaaaucucguuaagcccgagggaaaagucauugaccugggcugugggcgcggaggcugguccuauuacugcgcuggccugaagaaagugacagaagugaagggguauaccaaaggaggcccugggcacgaggaacccaucccuauggccacguacggauggaaccucgucaaacuucauucuggcaaagaugucuuuuucaugccgcccgagaagugugacacccugcugugcgauaucggggaaagcuccccuaaucccacaauugaggagggacggacccucagagugcugaagaugguggaaccuuggcuucgcggcaaccaguuuuguaucaaaauucugaaucccuacaugccgucugucguggagacacucgaacaaaugcagcggaagcacggcgggaugcugguuagaaacccucugagccgcaauuccacccacgagauguauugggugucuugcggaacaggcaacaucgucagcgcugugaacaugaccucccggaugcuccugaauagauucacgauggcccaucgcaaacccacauacgagcgggacguugaucuuggggcgggaaccagacacguggccgucgaacccgagguggcuaaccuggacauuaucggccagcgcauugaaaauaucaagaacgagcauaaaagcaccuggcacuaugaugaagacaauccuuacaagacaugggccuaucacgggucuuacgaggugagacccuccggaagcgcuucuuccauggucaacggcguugugcggcuccugacgaagccuugggaugugaucccgauggucacccaaauugccaugacagacaccacacccuuuggccagcagcgcguguucaaagagaagguugacaccagaacaccucgggcuaaaagagggaccacgcagaucauggaagugaccgccaaguggcuuuggggauuucugagccggaauaaaaagccccgcauuuguacaagagaggaguucacccggaagguccgcucuaacgcggccaucggcgcuguguuuguugaugagaaucaauggaacuccgccaaagaagcuguggaggacgagagauucugggaucucguccaucgggaacgcgagcugcacaagcaggggagaugcgccacaugcguguauaauaugaugggaaaacgggaaaagaaacugggcgaguuugggaaggccaagggcagccgcgcgauuugguacauguggcucggagcuagauuccuggaguucgaggcccuuggcuuuaugaacgaggaccauugguucucccgggaaaauagccugucugggguugagggagaaggccuccacaaacugggguacauccuucgcgauaucagcaagauuccuggaggcaacauguaugccgacgauaccgcugggugggacacgagaaucacagaggaugaccugcagaaugaggccaaaauuaccgaaaucauggagcccgaacaugcucuccuggccacauccauuuuuaagcugaccuaccagaacaaagugguccgggugcaacgcccggcgaagaacggcacggucauggaugugaucucuagacgggaccagagaggaagcggccagguugggaccuauggacucaauacauucaccaacauggaggugcagcugauccgccaaauggaauccgagggcauuuuucuuccuucugagcuggaaacacccaaucucgccgagcggguccuggauuggcuugaaaaacacggggcugagagacugaagcgcauggccaucagcggagacgacuguguggugaagccuauugaugaccgguucgcuaccgcccucacagcgcugaacgauaugggcaaaguuagaaaggacaucccccagugggaaccuuccaaaggguggaaugauuggcaacaggugcccuuuugcucucaccauuuccaccaacugauuaugaaggacggccgcgagaucgucgugccgugucggaaccaggaugagcucguuggcagagcucgcgugagccagggagcuggguggucccugcgggaaaccgccugccuuggaaaaagcuacgcucaaauguggcagcugauguauuuucauagacgcgaccuccggcuggccgcuaaugccaucuguucugcggucccuguggauuggguccccacguccagaacaaccuggagcauucacgcccaccaucaguggaugaccacagaggacaugcuuucuguguggaaccggguuuggaucgaagagaaucccuggauggaagauaagacccacguguccagcugggaggaggucccuuaccugggcaagagagaagaccaguggugcgggucccucauuggacugacagcucgcgccacgugggccaccaacauccaaguggcuauuaaucagguucggagacugaucggcaacgagaauuaucucgacuacaugacaucuaugaaacgcuucaagaacgaaagcgauccggagggggcccugugguga

SEQ ID NO: 18659 - RNA, 9879 nt, Artificial Sequence
  derived and/or modified CDS sequence (opt5) from DENV-1__KJ189348__SS-prME
agcgugaccaugcugcugaugcugcuucccacagcccuggcuuuccaccucacgaccagaggcggggaaccucauaugaucgucuccaagcacgaacggggaaaaucucugcuuuuuaagacaagcgccggcguuaauaugugcacccugauugcgauggaccucggggaacugugugaagauacaaugaccuacaaaugcccccgcaucacagaggcugaacccgacgauguggacuguuggugcaaugccaccgauacgugggugaccuauggaacauguucccaaaccggcgagcauagacgggacaagcgcucugucgcccuggcuccucacguggggcucggacuggagacaagaaccgaaacguggaugagcuccgagggcgccuggaaacaaauucagcggguugaaacaugggcucuuagacaucccggcuucaccgugaucgcccuguuucucgcgcacgccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccagggagaggccacccucguggaagaacaagaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcauaccggcgaucagcaccagguugggaaugagacaaccgaacauggaacaaucgcuaccauuacgccccaagccccuaccuccgagauccagcugacagacuacggcgcccucacccuggacuguagcccccggacaggccuugauuucaacgaaauggugcugcucaccaugaaggagaaaucuuggcugguccacaagcagugguuucuugaccugccucuccccuggacguccggggcuagcacaucccaggagaccuggaaucgccaagaucugcuggugacauucaaaaccgcgcacgccaagaagcaggaagucgugguucucggaucucaggagggcgcuaugcauaccgcccugacaggggccacggaaauucaaaccagcggaacaaccacaaucuuugcuggccaccuuaaaugcagacugaagauggacaaacucacccugaaggggacguccuaugugauguguacaggcagcuucaaacuggagaaggaagucgccgagacccagcauggaaccgugcuuguucaggugaaguacgagggcacagaugcgccgugcaaaauuccuuucucuacccaggacgaaaagggggucacacaaaacggacggcucaucacggcuaaucccaucgugaccgauaaagagaagccugugaacauugaaacagagccgcccuuuggcgaguccuauaucguugucggggccggagaaaaagcccugaagcugagcugguucaagaaaggcucuagcauugggaagauguuugaggcuaccgccagaggcgcucgccggauggccauccucggagacacagcgugggauuucggcuccauugggggaguguuuaccucugugggcaaacugguccaccagguguucgggacggccuacggaguucuuuuuagcggcguguccuggaccaugaagaucgggaucggcauucugcucacauggcugggacugaauagcagaucuaccuccuucagcaugacauguaucgcugucggcauggugacccuuuaccucgggguuauggugcaggccgacucuggaugcgucauuaacuggaaaggccgcgaacugaaguguggguccggaaucuuugugacaaacgagguucauaccuggacggaacaguauaaguuccaagcugauagcccuaaacggcuguccgccgcgauuggcaaggccugggaggagggggugugcggcaucagaucugcuacacgccucgaaaauauuauguggaaacagaucagcaacgagcugaaucacauccuucuggaaaacgacaugaaguuuaccgucguggugggagacgccaauggcauucucgcucaggggaaaaagaugauccggccgcagcccauggagcacaaauacuccuggaagucuuggggaaaggccaaaauuaucggcgccgauauucaaaacaccacauucaucaucgacgggccugauacccccgaauguccugacgaucagagagcuuggaauauuugggaggucgaggacuauggauuuggcaucuucacgacaaacauuuggcugaagcugcgcgauagcuacacccagaugugcgaccaucggcuuauguccgcggccaucaaagauagcaaggcuguucacgccgacaugggcuauuggauugaaucugagaaaaaugaaacauggaagcucgccagagcuuccuucaucgaggugaagaccuguacauggcccaaaagccauacccuguggucuaacggggugcuggaauccgagaugaucauuccgaagaucuacggaggcccuauuagccagcacaauuaucgccccggguacuuuacgcaaaccgccggaccuuggcaccucggcaaacuggagcuugauuucgaccugugcgaagggacaaccgucgugguugaugagcauugcggaaaccggggccccucucucagaacaaccacggugacaggcaagaucauucacgaaugguguugccggagcuguacccugccuccccugcgcuuuagaggggaggacggaugcugguacggcauggagauccggccggucaaagaaaaggaggaaaaucuugugagauccaugguuagcgcggggucuggagagguggacuccuucagccucggcauccugugugucuccauuaugaucgaagaggugaugcgcucucgguggagcagaaagaugcugaugacagggacccucgcuguuuuucugcuucugauuaugggacagcucaccuggaacgaucugauccgccugugcauuauggugggcgccaaugccuccgacagaaugggcauggggacaacguaucuugcucugauggccaccuucaaaaugcggccuauguuugcggucggaauccucuuccgcagacugacaucucgggaggugcuccugcuuaccauuggccugagccucguggcuuccgucgaacugcccaacucucuggaggaacuuggggauggacuggccaugggcaucaugaugcucaagcugcucacagaguuucagccccaucaacuguggaccacgcuucugagccucacauucaucaaaaccacccugucccuggacuacgccuggaagacaaccgcuauggcccuuagcauuguuucucuguuuccucucugucuguccacaacgagccagaaaaccacauggcucccggugcugcuugggucuuucggaugcaagccccugaccauguuucugaucacagaaaacaagauuuggggccgcaaauccuggccuaucaaugagggcauuauggcuaucgggaucgugagcauucuccugucuucccuucugaagaacgaugucccccucgccggaccucugaucgcgggcgggaugcucauugccuguuaugugaucagcggauccagcgcugaccugucucuugagaaagccgcugaaguuagcugggagcaggaagccgagcacuccggcaccucucauaauauucugguggaaguccaggaugacgggacgaugagaaucaaggaugaggagaaagacgauacccugacaauccuccugaaggccacccuucuggcugugagcggaguuuaccccauguccauuccugcgacacucuucgugugguauuucuggcagaagaagaagcagcggucuggcguccugugggacacccccagcccgccugaaguggagcgcgccguccucgaugacggcaucuaccgcauucugcagcgggggcuucugggacgcucccaggugggcguugggguguuucaagacggagucuuccacacaauguggcacgugacgagaggcgcuguucugauguaucaggggaaacggcucgaacccucuugggccagcgugaagaaagaucugaucuccuacggaggcggcuggagauuucaggggagcuggaacaccggagaggagguccaggugauugccguggaaccuggcaagaaucccaaaaacguucaaacaaccccggggaccuucaagacaccugagggagaagucggcgcuaucgcccuugacuuuaagcccgggacgucuggauccccuauugugaaucgcgagggcaaaaucgugggccuguacgggaacggagucgugaccacaagcggcaccuauguuucugcgaucgcucaggccaaggccucccaggaagggccccuccccgagauugaggaugaaguguucaaaaagcggaaucugacaaucauggaccuccauccuggaagcggcaaaaccagacgcuaccugccggcuauuguccgggaggccaucaagagaaaacuucgcacgcugauucuggcgcccacacgggugguugcuuccgaaauggccgaggcccucaaagggaugccuaucagauaucaaaccaccgcugugaagucugaacacacaggccgcgagaucgucgaucugaugugccaugccaccuuuacaaugcggcuucugagccccgugagaguuccuaacuacaauaugauuaucauggacgaggcucacuucaccgaucccgccuccauugcggcccggggauauaucagcacgcgcgugggcaugggggaagcugccgcuauuuuuaugacagccaccccuccgggaucugucgaggccuucccccaguccaacgcugugauccaggacgaagagagagauaucccugaacggagcuggaacucuggcuacgacuggauuacagauuuucccgggaaaaccgugugguucgucccuagcaucaaguccggaaacgacauugcgaauugucuccgcaaaaacggcaagagaguuauccagcugucucggaagacguucgacaccgaguaucagaagacaaagaacaaugauugggacuacguggugaccacagauauuagcgagaugggggccaacuuuagagcugaccgcgucaucgauccccggagaugccugaaaccggugauucucaaggacggcccugaacgcguuauccuugccggacccaugcccgugaccgucgccuccgcugcccagcggagaggccgcaucgggcggaaucagaacaaagagggagaucaguacguguauaugggccaaccucugaauaacgacgaagaucaugcgcacuggacagaggcuaagaugcugcucgacaauauuaacacccccgaggggaucauuccugcccuguucgaaccggagagagaaaagucugccgcuaucgauggagaguaccgccuuagaggcgaagcccggaaaacguuuguugagcugaugcgcagaggggaccuccccguguggcugagcuauaaggucgcguccgagggcuuccaguacagcgaucggcgcuggugcuuugacggagaaagaaauaaccaggugcuggaggaaaauauggacgucgagauuuggacaaaagaaggcgagcggaagaaacucagaccucgcuggcuugaugcccggaccuauucugacccccuggcucugagagaguucaaggaauuugccgcugggcgccgguccgugagcggagaucucauccuggagaucggcaaacuuccucagcaccugacccucagagcccaaaacgcucuggacaaucugguuaugcuccauaacuccgaacaagggggaaaggccuaccggcacgcgauggaggaacuucccgauacaauugagacccugaugcugcucgcccugaucgcugugcuuacaggcggcgugacgcuguucuuucucucugggaagggacugggcaaaaccagcauugggcugcucugugucacagccuccucugcccuucuguggauggccagcguugagccgcauuggaucgccgcuuccauuauccuggaguucuuucucauggugcugcuuaucccugagcccgaccgccagagaaccccucaggauaaucaacuggcguauguggucauuggacuccuguucaugauccugacaguggccgcuaacgaaaugggccuccuugagaccacgaagcgggaccuggggauuggacacguugccgccgagaaccaccagcaugcuaccaugcuggauguggaccuccgccccgccagcgcguggacacuguacgccgucgcuaccacagugaucaccccuaugaugagacacacgauugaaaauacaaccgccaacaucucucuuacagcuauugccaaucaggcggccauccugaugggccucgauaaaggcuggcccaucuccaagauggacauuggggucccgcugcuggcucucggaugcuacagccaagugaacccucuuacccugaccgccgcuguucugaugcucguggcccauuaugcuaucauuggccccgggcugcaggccaaagcgacacgggaggcccagaagcgcacggcugccggaaucaugaagaaucccaccgucgauggcauuguggcuaucgaccuugacccuguuguguacgaugccaaauuugaaaagcagcuggggcaaaucaugcuccugauucuguguacaucucagauccuccuuaugagaaccacaugggcccugugcgaguccauuacccuggcgacgggaccgcucacaacccugugggaaggcagccccggcaaauucuggaacaccacaaucgcugucucuauggccaauauuuuccgggggagcuaucuugcuggagccggccuggccuuuucccucaugaagucucucgggggaggccgcagagggaccggagcucagggcgagacacugggcgagaaauggaagcggcagcucaaccaacuuagcaagccugaguucaauacguacaaaagauccgggaucauggagguggaccgcagcgaagccaaggagggacugaaacggggcgaaaccacaaagcacgcgguguccagagggaccgccaaacugcgcugguuuguugagcggaaccucgucaagcccgagggaaaggugaucgaucugggcugugggagaggaggcuggucuuauuacugcgcuggccuuaaaaaggugacagaagucaaaggguauaccaagggaggcccugggcaugaggaacccauuccuauggccacguacggauggaaucugguuaaacuccacagcggcaaggacguguucuuuaugccgcccgagaaaugugauacccugcugugcgacaucggggaauccucuccuaaccccacaauugaggagggacgcacccuccgggugcuuaagauggucgaaccuuggcugagaggcaaucaguucuguaucaagauucugaaccccuacaugccgagcgugguugagacacucgaacagaugcagcgcaaacacggcgggaugcuggugcggaauccucuuuccagaaacucuacccaugagauguauugggucagcugcggaacaggcaauaucguguccgcuguuaacaugaccagccgcaugcugcucaaccgguuuacgauggcccacagaaagcccacauacgagcgcgauguggaccugggggcgggaaccagacaugucgccguggaacccgagguggcuaaucuggauauuaucggccaacggaucgaaaacauuaaaaaugagcacaagucuaccuggcacuaugacgaagauaacccuuacaaaacaugggccuaucauggguccuacgaggucaagcccagcggaucugcuuccagcaugguuaauggcguggugcgccuccugacgaagccuugggacgucaucccgauggugacccagauugccaugacagacaccacacccuucggccagcaaagaguuuuuaaagagaagguggauacccggacaccuagagcuaaacgggggaccacgcagaucauggaagucaccgccaaguggcuuuggggauuccugucucgcaacaaaaagcccagaauuuguacacgggaggaauuuacccgcaaggugagauccaaugcggccaucggcgcuguuuucguggacgagaaccaguggaauagcgccaaagaagcugucgaggaugagcgguuuugggaccucgugcaccgcgaaagagagcugcauaagcaggggaaaugcgccacaugcguuuauaacaugaugggaaagcgggagaagaaacuuggcgaguucgggaaagccaaaggcucccgcgcgaucugguacauguggcugggagcuagauuccucgaauuugaggcccugggcuucaugaaugaggaucacugguuuagccgggaaaacucucugagcgggguggagggagaaggccuccauaagcugggguacauucuucgcgacaucuccaaaauuccuggaggcaauauguaugccgaugacaccgcugggugggauacgagaaucacagaggacgaucugcaaaacgaggccaagauuaccgacaucauggaacccgagcacgcucuccuggccacaucuaucuucaaacuuaccuaccagaauaaggucgugcggguccagcgcccggcgaaaaacggcacggugauggauguuauuagcagacgggaccagagaggauccggccaaguggggaccuauggacugaacacauuuaccaauauggaaguccagcucauccgccagauggagucugaaggcauuuuccugccuagcgagcuggagacacccaaccucgccgaacgggugcugaauuggcuugagaagcacggggcugaaagacugaagcgcauggccaucuccggagacgauugugugguuaaaccuauugacgaucgguuugcuaccgcccucacagcgcugaacgacaugggcaaggugagaaaagauaucccccagugggagccuucuaagggguggaaugacuggcaacagguccccuucugcagccaucacuuucaucagcuuaucaugaaagauggccgcgaaauugugguuccgugucggaaccaggacgagcuggugggcagagcucgcgucucccaaggagcuggguggagccuccgggagaccgccugccugggaaagucuuacgcucagauguggcagcugauguauuuccacagacgcgaucuccggcuggccgcuaaugccaucuguuccgcggugccugucgacugggugcccacgagcagaacaaccuggucuauucacgcccaucaccaauggaugaccacagaagauaugcuuuccguuuggaaccggguguggaucgaggaaaaucccuggauggaggacaagacccaugucagcuccugggaagaggugccuuaccugggcaaaagagaggaccaguggugcgggucucucauuggacugacagcucgcgccacgugggccaccaacauccagguugcuauuaaucaggugcggagacuuaucggcaacgaaaauuaucuggauuacaugacaagcaugaagcgcuuuaaaaacgaguccgacccggaaggggcccucugguga

SEQ ID NO: 18660 - RNA, 9879 nt, Artificial Sequence
  derived and/or modified CDS sequence (opt5) from DENV-1__KJ189368__SS-prME
agcgugaccaugcugcuuaugcugcuucccaccgcucuggcuuuccaccucacgaccagaggcggggaaccucauaugaucgucuccaagcaggaacggggaaagucucugcuuuuuaagacaagcgccggcguuaacaugugcacccugauugcgauggaccucggggagcugugugaagauacaaugaccuacaagugcccgcagaucacagaggcugaacccgacgauguggacuguuggugcaaugccaccgauacgugggugaccuauggaacauguucccagaacggcgagcaccgcagagacaagcggucugucgcccuggcuccucauguggggcucggacuggagacccgcacagaaaccuggaugagcuccgagggcgccuggaaacagauucagagaguugaaacgugggcccuucggcaccccggcuucacagugaucgcccuguuucucgcgcaugccauugggaccucuaucacacagaagggaaucauuuucauccugcuuaugcuggucaccccuagcauggcuaugcgcugcgugggcauugggaauagagauuuuguugagggacucuccggcgccaccuggguggacgucgugcuggagcacgggagcugugugacaacgauggcuaagaacaaacccacccuggauaucgaacuccugaagacagaggucaccaauccugccauucuucggaaacugugcaucgaagcgaagauuucuaacacaaccacggacucccgcuguccgacacagggagaggccacccucguugaagaacaggaugcuaauuucgugugcagacggaccuuuguggaccgcggcuggggcaacggguguggacuguucggcaaagggagccuucugacaugcgccaaguuuaagugcgucaccaaacucgagggaaagaucgugcaguacgaaaaucugaaauauucuguuaucgugacaguccacacgggcgaucaacaucagguggggaacgagaccacagaacacggaaccauugcuacaaucacaccccaggccccuacguccgagauucagcugaccgacuacggcgcccucacacuggacuguagccccagaaccggccuugauuucaaugaaaugguucugcucacaaugaaggagaaaucuuggcuggugcauaagcaaugguuucuugaccugccucuccccuggaccuccggggcuagcacgucccaggagacauggaaccggcaggaucugcuggucaccuucaaaacagcgcacgccaagaagcaagaaguggucgugcucggaucucaggagggcgcuaugcacaccgcccugaccggggccacagaaauccagacgagcggaaccacaaccauuuuugcuggccaucuuaaaugccgccugaagauggacaaacucacacugaaggggaccuccuauguuauguguacgggcccguucaaacuggagaaggaaguggccgagacacagcacggaaccguccuugugcaaguuaaguacgagggcaccgaugcgccuugcaaaauccccuucagcacacaggacgaaaagggggugacccagaauggaagacucaucacagcuaacccuauugucacggauaaagagaagcccgugaauaucgaaaccgagcccccuuuuggcgagucuuauauugugguuggggccggagaaaaagcccugaagcuguccugguucaagaaaggcagcucuaucgggaagauguuugaggcuacagcccggggcgcuagacgcauggccauucucggagacaccgcgugggauuucggcagcaucgggggagucuuuacauccgugggcaaacuggugcaucaggucuucgggaccgccuacggagugcucuuuucuggcguuagcuggacgaugaagaucgggauuggcauccugcucaccuggcugggacugaacucccggagcacaucucuuuccaugaccuguauugcugugggcauggucacacucuaccugggggugaugguucaagccgacagcggaugcgugaucaacuggaaaggcagagaacugaagugugggucuggaauuuucgucaccaaugaggugcacacauggaccgaacaguauaaguuucaggcugauuccccgaaacgccucagcgccgcgaucggcaaggccugggaggaggggguuugcggcauucgguccgcuacgagacuggaaaacaucauguggaaacagaucucuaaugagcuuaaccauauucugcucgaaaaugacaugaaguucacaguggucgugggagacgccaacggcauccuggcucaagggaaaaagaugauucgcccccagccuauggagcacaaauacagcuggaaguccuggggaaaggccaaaaucauuggcgccgauauccagaauaccaccuuuaucauugacgggcccgauacaccugaaugucccgacaaccagcgggcuuggaauaucugggagguggaggauuauggauucggcauuuuuaccacgaacaucuggcugaaacuuagagacucuuacacacaaaugugcgaucaccgccucaugagcgcggccauuaaagacuccaaggcuguccaugccgauaugggcuauuggaucgaaagcgagaaaaaugaaaccuggaagcuggcccgggcuucuuucaucgagguuaagacauguaccuggccgaaaucccacacacuguggagcaacggggugcucgaaucugagaugauuaucccuaagauuuacggaggccccaucucccagcauaauuauagaccuggguacuucacccagacggccggacccuggcaccugggcaaacuugagcuggacuuugaucucugcgaagggaccacaguggucguggacgagcacugcggaaaccgcggcccuagccugcggaccacaaccguuacgggcaagauuauccaugaaugguguugcagaucuuguacacugcccccgcuucgguuccgcggggaggauggaugcugguacggcauggagaucagaccugugaaagaaaaggaggaaaaucucguccggagcaugguguccgcggggagcggagagguugacucuuuuucccugggcauucugugugugagcaucaugauugaagaggucaugagaucccgcuggucucggaagaugcucaugaccgggacacuggcuguguuccuucugcucguuaugggacaacugaccuggaacgaccugaucagacuuugcauuauggugggcgccaacgccagcgaucgcaugggcauggggaccacauaucuggcucucauggccacguuuaaaaugagacccauguucgcggucggacugcucuuucggcgccugaccuccagagaggugcuucugcucacaaucggccugucucugguggcuagcgucgaacuucccaauucccuggaggaacucggggacggacuggccaugggcauuaugaugcucaagcugcuuaccgaguuccagccucaccagcuguggacaacccuccugucucugacguuuaucaaaacaacccuuagccuggauuacgccuggaagaccacagcuauggcccucuccaucguuagccuguucccgcucugucugucuaccacaucccagaaaacgaccuggcuucccgugcugcuggggagcuuuggaugcaagccucucacaauguuccugauuaccgaaaacaagaucuggggccggaaaucuuggccccuuaaugagggcauuauggcuaucgggauuguguccauccugcucagcucucugcucaagaacgacgucccucuggccggaccccuuaucgcgggcgggaugcugauugccuguuaugugaucuccggaagcuccgcugaucugagccucgagaaagccgcugaaguuucuugggagcaagaagccgagcauagcggcacaucccacaauauucugguggaaguccaggacgaugggaccaugaagaucaaagacgaggagcgcgaugacacgcuuaccauucugcucaaggccacacugcucgcugugucuggaguuuacccuaugagcauccccgcgacccuguuugugugguauuucuggcagaaaaagaagcagagauccggcguccuuugggauacaccgucuccucccgaaguggagcgggccguccuggacgauggcaucuaccgcauucugcaaagagggcuccugggacggagccaggugggcguugggguguuccaggacggagucuuucauaccauguggcacgugacacgcggcgcuguucuuauguaucaggggaaaagacuggaaccuuccugggccucugugaagaaagaccucaucagcuacggaggcggcuggcgguuccaaggguccuggaacacgggagaggagguccaggugauugccguggaacccggcaagaauccgaaaaacguucagaccacaccugggaccuuuaagacccccgagggagaagucggcgcuaucgcccuggauuucaagccugggacaagcggaucucccauugugaauagagagggcaaaaucgugggccucuacgggaacggagucgugacgaccuccggcacauauguuagcgcgauugcucaagccaaggccucucaggaagggccccugccugagaucgaggacgaaguguuuaaaaagcgcaaucuuaccaucauggaucugcacccgggauccggcaaaacacggagauaccugcccgcuauuguccgcgaggccaucaagcggaagcucagaacccugauucuugcgccuacgcgcgugguugcuagcgaaauggccgaggcccugaaagggaugcccauccgguaucagacaaccgcugugaaguccgaacauaccggcagagagauugucgaccucaugugccacgccacauucaccaugcgccugcugucuccugugcggguucccaacuacaauaugaucaucauggaugaggcucauuuuacagacccugccagcauugcggccagaggauauaucuccacccgggugggcaugggggaagcugccgcuauuuucaugacggccacaccgcccggaagcgucgaggccuuuccucagucuaacgcugugauccaagaugaagaacgcgacauucccgaaagauccuggaauagcggcuacgauuggaucaccgacuucccugggaaaacagugugguuuguccccucuaucaagagcggaaacgauauugcgaacugucuccggaaaaauggcaagcgcguuauccagcuuuccagaaagaccuucgacacggaguaucagaaaaccaagaacaaugacugggauuacguggugacaaccgacauuucugagaugggggccaacuuccgggcugauagagucaucgacccgcgccggugccugaaaccugugauucugaaggauggccccgaaagaguuauccucgccggacccaugccugugacagucgccagcgcugcccagcgccggggcagaauugggcgcaaucaaaacaaagagggagaccaguacguguauaugggccagccccugaauaacgaugaagaccacgcgcauuggaccgaggcuaagaugcuucuggauaauaucaacacaccugaggggaucauuccggcccucuuugaacccgagcgggaaaaguccgccgcuaucgacggagaguacagacugcgcggcgaagccagaaaaaccuucguugagcugaugcggcgcggggaucucccuguguggcuuucuuauaaggucgcgagcgagggcuuucaguacuccgacagacgguggugcuucgauggagaacgcaauaaccaagugcuggaggaaaauauggacgucgagauuuggacgaaagaaggcgagagaaagaaacugcggcccagauggcucgacgcccgcacauauagcgauccucuggcccuucgggaguuuaaggaguucgccgcugggagacgcucuaucuccggagaccugauucucgagaucggcaaacugccccagcaccugacccuccgggcccagaacgcucuugauaaucuggugaugcugcacaacagcgaacaagggggaaaggccuacagacaugcgauggaggaacucccggacaccaucgagacacugaugcuucuggcccucauugcuguucugaccggcggcgugacacuguuuuuccucuccgggaagggacuuggcaaaacgucuaucgggcugcugugugugaccgccagcuccgcucuccuguggauggccucugucgagccucacuggauugccgcuagcaucauucuugaauuuuuccugaugguucuccugauccccgagccugaucggcaacgcacaccccaggacaaccagcuggcguauguggugaucggacuccuuuuuaugauucugaccgucgccgcuaaugaaaugggccugcucgagacaaccaagaaagaucuggggaucggacauguggccgccgagaaccaccaacacgcuacgaugcuugacguugaucugagaccugccuccgcguggacccucuacgccguggcuacaaccgucauuacacccaugaugcggcauaccaucgaaaauacgacagccaacauuagccugaccgcuaucgccaaucaggcggccauucugaugggccucgacaagggcuggccgaucucuaaaauggauaucggggugccucuucuggcucugggaugcuacucccaggucaacccccucacacugaccgccgcugugcuuaugcugguugcccacuaugcuauuaucggccccgggcuccaggccaaggcgacccgcgaggcccaaaagagaacagcugccggaauuaugaaaaauccuacgguggacggcaucgucgcuauugaucuggacccggugguuuacgacgccaaguucgaaaaacagcuggggcagaucaugcuccuuauccuguguaccagccagauucugcucaugcggacaaccugggcccugugcgagucuaucacacuugcgaccggaccccugacgacacucugggaaggcuccccuggcaaguuuuggaacaccaccauugcugugagcauggccaauaucuuccgcgggucuuaucuggcuggagccggccuggccuucagccucaugaaaucccuugggggaggcagacgggggacaggagcucaaggcgagacccugggcgagaaguggaagcgccagcugaaccagcucucuaaaagcgaauuuaauacauacaagagauccgggauuauggaggucgaucggagcgaagccaaagagggacugaagagaggcgaaacgaccaaacaugcggugucccgcgggacagccaaacuucggugguucguggagagaaaccugguuaagcccgagggaaaagucaucgaccucggcugugggcgcggaggcuggucuuauuacugcgcuggccugaagaaagugaccgaagugaagggguauacaaaaggaggcccugggcacgaggaacccaucccuauggccaccuacggauggaaucuggucaagcuccauagcggcaaagauguguuuuucaugccgcccgagaagugugacacgcuucugugcgauauuggggaauccucuccuaaccccaccaucgaggagggacggacacugagaguucucaagaugguggaaccuuggcugcgcggcaaucaguuuuguauuaaaauccuuaaccccuacaugccgagcgucguggagacccuggaacaaaugcagcggaagcacggcgggaugcucguuagaaauccucugucccgcaacucuacacacgagauguauugggugagcugcggaaccggcaacauugucuccgcugugaauaugacaagccggaugcugcucaacagauucaccauggcccaucgcaaacccacguacgagcgggacguugaucugggggcgggaacaagacacguggccgucgaacccgagguggcuaaucuugacaucauuggccagcgcaucgaaaacaucaagaaugagcauaaaucuaccuggcacuaugaugaagacaacccuuacaagaccugggccuaucacggguccuacgaggugaagcccagcggaucugcuuccagcauggucaauggcguugugagacugcucacaaaaccuugggaugugauuccgauggucacgcaaaucgccaugaccgacacaacccccuuuggccagcagcggguguucaaggagaaaguugacacacgcaccccuagagcuaagcgggggacaacccagauuauggaagugacggccaaauggcuguggggauuucuuucuagaaacaagaagccccggaucuguacccgcgaggaguucacaagaaaaguccgguccaaugcggccauuggcgcuguguuuguugaugagaaccaauggaauagcgccaaggaagcuguggaggacgagcgcuucugggaucugguccauagagaacgggagcuccacaaacaggggaagugcgcuaccugcguguauaacaugaugggaaaacgcgaaaagaagcugggcgaguuugggaaagccaagggcuccagagcgaucugguacauguggcugggagcucgguuccucgaguucgaggcccugggcuuuaugaaugaggaccauugguucagccgcgaaaacucucuuagcgggguugagggagaaggccugcacaaacucggguacauccugagagauauuuccaagaucccuggaggcaauauguaugccgacgauacagcugggugggacacccggauuacggaggaugaccuucagaacgaggccaaaaucacagaauuuauggagcccgaacaugcucugcucgccaccucuauuuucaagcugacauaccagaacaaagugguccgcgugcaaagaccggcgaagaauggcaccgucauggaugugaucagccggcgcgaccagagaggauccggccagguugggacguauggacugaacaccuuuacaaauauggaggugcagcucauccggcaaauggaaucugagggcauuuuccugccuagcgagcuugaaacccccaaccuggccgagagagucuuugauuggcucgaaaagcacggggcugagcgccugaaacggauggccaucuccggagacgacuguguggugaagccuauugaugacagauucgcuacagcccuuaccgcgcugaaugauaugggcaaaguucgcaaggacaucccccagugggaaccuucuaaaggguggaacgauuggcaacaggugcccuuuugcagccaccauuuccaccaacucauuaugaaggacggccgggagaucgucgugccguguagaaaucaggaugagcugguuggacgcgcccgggugucccagggcgcuggguggagccugagagaaacagccugccucggaaagucuuacgcucaaauguggcagcugauguauuuucaucgccgggaccuuagacuggccgcuaacgccaucuguuccgcggucccuguggauuggguccccaccagccgcacgacauggucuauucacgcccaccaucaguggaugaccaccgaggacaugcucuccguguggaaucggguuuggaucgaagagaaccccuggauggaagauaaaacacacgugagcuccugggaggaggucccuuaccugggcaagagagaagaccaguggugcgggucucuuauuggacugaccgcucgggccacaugggccacgaauauccaaguggcuauuaaccagguuagacgccucaucggcaaugagaacuaucuggacuacaugaccagcaugaaacgguucaagaaugaauccgauccggagggggcccugugguga

SEQ ID NO: 18661 - RNA, 9879 nt, Artificial Sequence
  derived and/or modified CDS sequence (opt5) from DENV-1__KJ189369__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucuguguguguccaucaugauugaagaggucaugagaucucgcuggagccggaagaugcucaugacagggacccuggcuguguuccuucugcucguuaugggacaacugaccuggaaugaccugaucagacuuugcauuauggugggcgccaacgccuccgaucgcaugggcauggggacaacguaucuggcucucauggccaccuuuaaaaugagaccuauguucgcggucggacugcucuuucggcgccugacaucuagagaggugcuucugcucaccaucggccugagccugguggcuuccgucgaacuucccaacucucuggaggaacucggggacggacuggccaugggcauuaugaugcucaagcugcuuacagaguuccagccccaccagcuguggaccacgcuccugagccugacauuuaucaaaaccacccuuucccuggauuacgccuggaagacaaccgcuauggcccucagcaucguuucucuguucccucucugucuguccacaacgagccagaaaaccacauggcuuccggugcugcuggggucuuuuggaugcaagccccucaccauguuccugauuacagaaaauaagaucuggggccggaaauccuggccucuuaacgagggcauuauggcuaucgggauugugagcauccugcucucuucccugcucaagaaugacgucccccuggccggaccucuuaucgcgggcgggaugcugauugccuguuaugugaucagcggauccagcgcugaucugucucucgagaaagccgcugaaguuagcugggagcaagaagccgagcauuccggcaccucucacaacauucugguggaaguccaggacgaugggacgaugaagaucaaagacgaggagcgcgaugacacccuuacaauucugcucaaggccacccugcucgcugugagcggaguuuaccccauguccaucccugcgacacuguuugugugguauuucuggcagaaaaagaagcagagaucuggcguccuuugggauacccccagcccgccugaaguggagcgggccguccuggacgauggcaucuaccgcauucugcaaagagggcuccugggacggucccaggugggcguugggguguuccaggacggagucuuucauacaauguggcacgugacgcgcggcgcuguucuuauguaucaggggaaaagacuggaacccucuugggccagcgugaagaaagaccucaucuccuacggaggcggcuggcgguuccaagggagcuggaauaccggagaggagguccaggugauugccguggaaccuggcaagaaccccaaaaauguucagacaaccccggggaccuuuaagacaccugagggagaagucggcgcuaucgcccuggauuucaagcccgggacgucuggauccccuauugugaacagagagggcaaaaucgugggccucuacgggaauggagucgugaccacaagcggcaccuauguuucugcgauugcucaagccaaggccucccaggaagggccccugcccgagaucgaggacgaaguguuuaaaaagcgcaaccuuacaaucauggaucugcacccuggaagcggcaaaacccggagauaccugccggcuauuguccgcgaggccaucaagcggaagcucagaacgcugauucuugcgcccacacgcgugguugcuuccgaaauggccgaggcccugaaagggaugccuauccgguaucagaccaccgcugugaagucugaacauacaggcagagagauugucgaccucaugugccacgccaccuucacaaugcgccugcugagccccgugcggguuccuaauuacaacaugaucaucauggaugaggcucauuuuaccgaccccgccuccauugcggccagaggauauaucagcacgcgggugggcaugggggaagcugccgcuauuuucaugacagccaccccuccgggaucugucgaggccuuuccccaguccaaugcugugauccaagaugaagagcgcgacauuccugaaagaagcuggaacucuggcuacgauuggaucacagacuuccccgggaaaaccgugugguuugucccuagcaucaaguccggaaaugauauugcgaacugucuccggaaaaacggcaagcgcguuauccagcuuucuagaaagacguucgacaccgaguaucagaaaacaaagaauaacgacugggauuacguggugaccacagacauuagcgagaugggggccaauuuccgggcugauagagucaucgacccccgccggugccugaaaccggugauucugaaggauggcccugaaagaguuauccucgccggacccaugcccgugaccgucgccuccgcugcccagcgccggggcagaauugggcgcaaccaaaauaaagagggagaccaguacguguauaugggccagccucugaacaaugaugaagaccacgcgcauuggacagaggcuaagaugcuucuggauaacaucaauacccccgaggggaucauuccugcccucuuugaaccggagcgggaaaagaacgccgcuaucgacggagaguacagacugcgcggcgaagccagaaaaacguucguugagcugaugcggcgcggggaucuccccguguggcuuucuuauaaggucgcgagcgagggcuuucaguacuccgacagacgguggugcuucgauggagaacgcaauaaccaagugcuggaggaaaauauggacgucgagauuuggacaaaagaaggcgagagaaagaaacugcggccuagauggcucgacgcccgcaccuauagcgauccccuggcucuucgggaguuuaaggaauucgccgcugggagacgcucuguguccggagaccugauccucgagauuggcaaacugccucagcaccugacccuccgggcccagaacgcucuugauaaucugguuaugcugcacaacagcgaacaggggggaaaggccuacagacaugcgauggaggaacuccccgacacaaucgagacccugaugcuucuggcccucaucgcugugcugacaggcggcgugacgcuguuuuuccucuccgggaagggacuuggcaaaaccucuauugggcugcugugugucacagccagcuccgcucuccuguggauggccucuguugagccgcacuggaucgccgcuagcauuauccuugaauuuuuccugauggugcuccugauuccugagcccgaucggcaacgcaccccucaggacaaccagcuggcguauguggucaucggacuccuuuuuaugauccugacaguggccgcuaaugaaaugggccugcucgagaccacgaagaaagaucuggggauuggacauguugccgccgagaaccaccaacacgcuaccaugcuugacguggaucugagacccgccuccgcguggacacucuacgccgucgcuaccacagugaucaccccuaugaugcggcauacgauugaaaauacaaccgccaacaucagccugacagcuauugccaaucaggcggccauccugaugggccucgacaagggcuggcccauuucuaaaauggauaucggggucccgcuucuggcucugggaugcuacucccaggugaacccucucacccugaccgccgcuguucuuaugcugguggcccacuaugcuaucauuggccccgggcuccaggccaaggcgacacgcgaggcccaaaagagaacggcugccggaaucaugaaaaaucccaccgucgacggcauuguggcuaucgaucuggacccuguuguguacgacgccaaguucgaaaaacagcuggggcagauuaugcuccuuauccuguguacaagccagauccugcucaugcggaccacaugggcccugugcgagucuauuacccuugcgacgggaccgcugacaacccucugggaaggcucccccggcaaguuuuggaacaccacaaucgcugucagcauggccaauauuuuccgcgggucuuaucuggcuggagccggccuggccuucagccucaugaaaucccuugggggaggcagacgggggaccggagcucaaggcgagacacugggcgagaaguggaagcgccagcugaaccagcucucuaaaagcgaauuuaauacguacaagagauccgggaucauggagguggaucggagcgaagccaaagagggacugaagagaggcgaaaccacaaaacaugcggugucccgcgggaccgccaagcuucggugguucguugagagaaaccuggucaagccugagggaaaagugauugaccucggcugugggcgcggaggcuggucuuauuacugcgcuggccugaagaaagugacagaagucaagggguauaccaaaggaggccccgggcacgaggaaccuauccccauggccacguacggauggaaucugguuaagcuccauagcggcaaagauguguuuuucaugccuccggagaagugugacacccuucugugcgauaucggggaauccucucccaacccuacaauugaggagggacggacccugagagugcucaagauggucgaacccuggcugcgcggcaaucaguuuuguaucaaaauucuuaacccuuacaugcccagcgugguugagacacuggaacaaaugcagcggaagcacggcgggaugcucgugagaaauccgcugucccgcaacucuacccacgagauguauugggucagcugcggaacaggcaacaucguguccgcuguuaauaugaccagccggaugcugcucaacagauucacgauggcccaucgcaaaccuacauacgagcgggacguggaucugggggcgggaaccagacacgucgccguggaacccgagguggcuaaucuugacauuaucggccagcgcauugaaaacaucaagaaugagcauaaaucuaccuggcacuaugaugaagacaaccccuacaagacaugggccuaucacggguccuacgaggucaagccuagcggaucugcuuccagcaugguuaauggcguggugagacugcucacgaaacccugggaugucaucccuauggugacccaaauugccaugacagacaccacaccguuuggccagcagcggguuuucaaggagaaaguggacacccgcacacccagagcuaagcgggggaccacgcagaucauggaagucaccgccaaauggcuguggggauuucuuucuagaaacaagaagccucggauuuguacacgcgaggaauucaccagaaaagugcgguccaaugcggccaucggcgcuguuuuuguggaugagaaccaauggaauagcgccaaggaagcugucgaggacgagcgcuucugggaucuggugcauagagaacgggagcuccacaaacaggggaagugcgccacaugcguuuauaacaugaugggaaaacgcgaaaagaagcugggcgaguuugggaaagccaagggcuccagagcgauuugguacauguggcugggagcucgguuccucgaauucgaggcccugggcuuuaugaaugaggaccauugguucagccgcgaaaacucucuuagcgggguggagggagaaggccugcacaaacucggguacauccugagagauaucuccaagauucccggaggcaauauguaugccgacgauaccgcugggugggacacgcggaucacagaggaugaccuucagaacgaggccaaaauuaccgaaaucauggagccugaacaugcucugcucgccacaucuauuuuuaagcugaccuaccagaacaaagucgugcgcguccaaagacccgcgaagaauggcacggugauggauguuaucagccggcgcgaccagagaggauccggccagguggggaccuauggacugaacacauucaccaauauggagguccagcucauccggcaaauggaaucugagggcauuuuucugccgagcgagcuugaaacaccuaaccuggccgagagagugcucgauuggcuggaaaagcacggggcugagcgccuuaaacggauggccaucuccggagacgacugugugguuaagcccauugaugacagauucgcuaccgcccugacagcgcucaaugauaugggcaaagugcgcaaggacaucccucagugggaacccucuaaaggguggaacgauuggcagcaggucccuuuuugcagccaccauuuccaccaacugauuaugaaggacggccgggagaucgugguucccuguagaaaucaggaugagcuggugggacgcgcccgggucucccagggcgcuggguggagccucagagaaaccgccugccugggaaagucuuacgcucaaauguggcagcuuauguauuuucaucgccgggaccugagacucgccgcuaacgccaucuguuccgcggugccggucgauugggugccuacgagccgcacaaccuggucuauucacgcccaccaucaguggaugaccacagaggacaugcuguccguuuggaaucggguguggaucgaagagaaccccuggauggaagauaaaacccacgucagcuccugggaggaggugcccuaccuuggcaagagagaagaccaguggugcgggucucugauuggacucacagcucgggccacgugggccaccaauauccaaguugcuauuaaccaggugagacgccugaucggcaaugagaacuaucuggacuacaugacaagcaugaaacgguucaagaaugaauccgauccugagggggcccucugguga

SEQ ID NO: 18662 - RNA, 9879 nt, Artificial Sequence
  derived and/or modified CDS sequence (opt5) from DENV-1__EU482615__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauugugucucuguucccucucugucuguccacaacgagccagaaaaccacauggcuuccgguccugcuggggucuuuuggaugcaagccccucaccauguuccugaucacagaaaauaagauuuggggccggaaauccuggccucuuaacgagggcaucauggccauugggaucguuagcauccugcucucuucccugcucaagaaugacgugccccuggcgggaccucuuauugccggcgggaugcugaucgcuuguuaugugauuagcggauccagcgccgaucugucucucgagaaagcugccgaagucagcugggagcaagaagccgagcauuccggcaccucucacaacauccugguggaaguucaggacgaugggacgaugaagauuaaagacgaggagcgcgaugacacccuuacaauccugcucaaggcuacccugcucgcggugagcggagucuaccccauguccaucccugccacacuguuugugugguauuucuggcagaaaaagaagcagagaucuggcguucuuugggauacccccagcccgccugaaguggagcgggcuguccuggacgauggcauuuaccgcauccugcaaagagggcuccugggacggucccaggugggcgucgggguguuccaggacggaguuuuucauacaauguggcacgugacgcgcggcgccguccuuauguaucaggggaaaagacuggaacccucuugggccagcgugaagaaagaccucauuuccuacggaggcggcuggcgguuccaagggagcuggaauaccggagaggagguucaggugaucgcugucgaaccuggcaagaaccccaaaaaugugcagacaaccccggggaccuuuaagacaccugagggagaagugggcgccauugcgcuggauuucaagcccgggacgucuggauccccuaucguuaacagagagggcaaaauugucggccucuacgggaauggaguggugaccacaagcggcaccuaugucucugcuaucgcccaagccaaggcuucccaggaagggccccugcccgagaucgaggacgaaguguuuaaaaagcgcaaccuuacaauuauggaucugcacccuggaagcggcaaaacccggagauaccugccggccaucguucgcgaggcgauuaagcggaagcucagaacgcugauccuugcucccacacgcguggucgccuccgaaauggccgaggcucugaaagggaugccuauucgguaucagaccaccgccgugaagucugaacauacaggcagagagaucguugaccucaugugccacgcuaccuucacaaugcgccugcugagccccgugcgggucccuaauuacaacaugaucauuauggaugaggcccauuuuaccgaccccgcguccaucgccgcuagaggauauauuagcacgcgggugggcaugggggaagccgcugccaucuucaugacagccaccccuccgggaucuguugaggcuuuuccccaguccaaugcggugauucaagaugaagagcgcgacaucccugaaagaagcuggaacucuggcuacgauuggaucacagacuuccccgggaaaaccgucugguuugugccuagcauuaaguccggaaaugauaucgccaacugucuccggaaaaacggcaagcgcgugauucagcuuucuagaaagacguucgacaccgaguaucagaaaacaaagaauaacgacugggauuacgucguuaccacagacaucagcgagaugggggcuaauuuccgggccgauagagugauugacccccgccggugccugaaaccggugauccugaaggauggcccugaaagagucauucucgccggacccaugcccgugaccguugcuuccgccgcgcagcgccggggcagaaucgggcgcaaccaaaauaaagagggagaccaguacguguauaugggccagccucugaacaaugaugaagaccacgcucauuggacagaggccaagaugcuucuggauaacaucaauacccccgaggggauuaucccugcccucuuugaaccggagcgggaaaagucugcugccauugacggagaguacagacugcgcggcgaagcgagaaaaacguucgucgagcugaugcggcgcggggaucuccccguguggcuuagcuauaagguugccuccgagggcuuucaguacagcgacagacgguggugcuucgauggagaacgcaacaaucaagugcuggaggaaaacauggacgucgagaucuggacaaaagaaggcgagagaaagaaacugcggccuagauggcucgacgcucgcaccuauucugauccccuggcccuucgggaguuuaaggaauucgcugccgggagacgcuccgugagcggagaccugauucucgagaucggcaaacugccucagcaccugacccuccgggcucagaaugcccuugauaaccuggucaugcugcacaauuccgaacaggggggaaaggcguacagacaugccauggaggaacuccccgacacaaucgagacccugaugcuucuggcucucauugccgugcugacaggcggcguuacgcuguuuuuccucucugggaagggacuuggcaaaaccagcaucgggcugcugugugugacagcuuccucugcccuccuguggauggccagcguggagccgcacuggauugcugcguccaucauucuugaauuuuuccugaugguccuccugaucccugagcccgaucggcaacgcaccccucaggacaaccagcuggccuauguugugaucggacuccuuuuuaugauucugacaguggcugccaacgaaaugggccugcucgagaccacgaagaaagaucuggggaucggacaugucgccgcugagaaucaccaacacgccaccaugcuugacguggaucugagacccgcgagcgccuggacacucuacgcuguugccaccacagugauuaccccuaugaugcggcauacgaucgaaaacacaaccgcuaauauuucucugacagccaucgcgaaccaggccgcuauucugaugggccucgacaagggcuggcccaucuccaaaauggauaucggggucccgcuucuggcccugggaugcuacagccaggugaauccucucacccugaccgcugccguccuuaugcugguggcucacuaugccauuaucggccccgggcuccaggcgaaggccacacgcgaggcucaaaagagaacggccgcuggaauuaugaaaaaccccaccguugacggcaucguggccauugaucuggacccugucguguacgacgccaaguucgaaaaacagcuggggcagaucaugcuccuuauccuguguacaucucagauucugcucaugcggaccacaugggcgcugugcgaguccaucacccuugcuacgggaccgcugacaacccucugggaaggcagccccggcaaguuuuggaauaccacaauugccguuucuauggcuaacaucuuccgcgggagcuaucuggccggagccggccuggcuuucucccucaugaaaucucuugggggaggcagacgggggaccggagcccaaggcgagacacugggcgagaaguggaagcgccagcugaaucagcucagcaaauccgaauuuaacacguacaagagaagcgggauuauggagguggaucgguccgaagcgaaagagggacugaagagaggcgaaaccacaaaacaugccgucucucgcgggaccgcuaagcuucggugguucguggagagaaaucuggugaagccugagggaaaaguuaucgaccucggcugugggcgcggaggcuggagcuauuacugcgccggccugaagaaagucacagaagugaagggguauaccaaaggaggccccgggcacgaggaaccuauccccauggcuacguacggauggaaccuggugaagcuccauuccggcaaagaugucuuuuucaugccuccggagaagugugacacccuucugugcgauauuggggaaucuagccccaauccuacaaucgaggagggacggacccugagaguucucaagaugguggaacccuggcugcgcggcaaccaguuuuguauuaaaauccuuaauccuuacaugcccuccguggucgagacacuggaacaaaugcagcggaagcacggcgggaugcucgugagaaacccgcugucucgcaauagcacccacgagauguauuggguuuccugcggaacaggcaacauugugagcgccgucaacaugaccucucggaugcugcucaauagauucacgauggcgcaucgcaaaccuacauacgagcgggacguggaucugggggccggaaccagacacguugcuguggaacccgaggucgccaaccuugacaucauuggccagcgcaucgaaaauaucaagaacgagcauaaauccaccuggcacuaugaugaagacaaucccuacaagacaugggcuuaucacgggagcuacgaggugaagccuucuggauccgccagcucuauggugaacggcgucguuagacugcucacgaaacccugggaugugauuccuauggugacccaaaucgcuaugacagacaccacaccguuuggccagcagcgggucuucaaggagaaaguggacacccgcacacccagagccaagcgggggaccacgcagauuauggaaguuaccgcgaaauggcuguggggauuucuuuccagaaauaagaagccucggaucuguacacgcgaggaauucaccagaaaagugcggagcaacgccgcuauuggcgccgucuuuguggaugagaaucaauggaacuccgcuaaggaagccguugaggacgagcgcuucugggaucuggugcauagagaacgggagcuccacaaacaggggaagugcgccacaugcgucuauaauaugaugggaaaacgcgaaaagaagcugggcgaguuugggaaagcgaagggcagcagagcuaucugguacauguggcugggagcccgguuccucgaauucgaggcccugggcuuuaugaacgaggaccauugguucucucgcgaaaauagccuuuccgggguggagggagaaggccugcacaaacucggguacauccugagagauauuucuaagauccccggaggcaacauguaugcugacgauaccgccgggugggacacgcggauuacagaggaugaccuucagaaugaggcuaaaaucaccgauauuauggaaccugagcaugcccugcucgcgacaagcaucuuuaagcugaccuaccagaacaaaguugugcgcguccaaagacccgccaagaacggcacggugauggacgucaucucccggcgcgaucagagaggaucuggccagguggggaccuauggacugaauacauucaccaacauggaaguucagcucauucggcaaauggagagcgaaggcaucuuucugccguccgagcuugagacaccuaaucuggcugaaagagugcucgacuggcuggagaagcacggggccgaacgccuuaaacggauggcuauuucuggagacgauugugucgugaagcccaucgacgauagauucgccaccgcgcugacagcccucaacgacaugggcaaagugcgcaaggauauuccucagugggagcccagcaaaggguggaaugacuggcagcagguuccuuuuugcucccaccauuuccaccaacugaucaugaaggauggccgggaaaucgugguccccuguagaaaccaggacgagcuggugggacgcgcucggguuagccagggcgccggguggucucucagagagaccgcuugccugggaaaguccuacgcccaaauguggcagcuuauguauuuucaucgccgggaucugagacucgcugccaaugcgauuuguagcgccgugccggucgacugggugccuacgucucgcacaaccugguccauccacgcucaccaucaguggaugaccacagaagauaugcugagcgucuggaaccggguguggauugaggaaaaucccuggauggaggacaaaacccacguuuccucuugggaagaggugcccuaccuuggcaagagagaggaccaguggugcgggagccugaucggacucacagcccgggccacgugggcuaccaacauucaagucgccaucaaucaggugagacgccugauuggcaacgaaaauuaucuggauuacaugacauccaugaaacgguucaagagcgagucugacccugaaggggcgcucugguga

SEQ ID NO: 18663 - RNA, 9879 nt, Artificial Sequence
  derived and/or modified CDS sequence (opt5) from DENV-1__EU482616__SS-prME
agcgugaccaugcugcucaugcugcuucccacagcccuggcuuuccaccucacgaccagaggcggggagccucauaugaucgucaacaagcaggaacggggaaaaucccugcuuuuuaagacaucugccggcguuaauaugugcacccugauugcgauggaccucggggagcugugugaagauacaaugaccuacaaaugcccgcaaaucacagaggcugaacccgacgauguggacuguuggugcaacgccaccgauacgugggugaccuauggaacauguagccagaccggcgagcaccgcagagacaagcgguccgucgcccuggcuccucauguggggcucggacuggagacacgcaccgaaacguggaugucuagcgagggcgccuggaaacagauucagagaguugaaacaugggcucuucggcaccccggcuucaccgugaucgcccuguuucucgcgcaugccauugggacauccaucacccaaaagggaaucauuuucauccugcuuaugcuggucaccccuucuauggcuaugcgcugcgugggcauugggaauagagauuuuguugagggacucagcggcgccacauggguggacgucgugcuggagcacggguccugugugacgaccauggcuaagaacaaacccacacuggauaucgaacuccugaagaccgaggucacaaauccugccauucuucggaaacugugcaucgaagcgaagauuagcaacaccacgacagacucucgcuguccgacccagggagaggccacccucguugaagagcaggaugcuaauuucgugugcagacggacauuuguggaccgcggcuggggcaacggguguggacuguucggcaaagggucccuucugaccugcgccaaguuuaagugcgucacaaaacucgagggaaagaucgugcaguacgaaaaucugaaauauagcguuaucgugacgguccacaccggcgaucaacaucagguggggaacgagacaaccgaacacggaacaauugcuaccaucacgccccaggccccuaccucugagauucagcugacagacuacggcgcccucacccuggacuguucccccagaacaggccuugauuucaaugaaaugguucugcucaccaugaaggagaaaagcuggcuggugcauaagcaaugguuucuugaccugccucuccccuggacgucuggggcuuccacaagccaggagaccuggaaccggcaggaucugcuggucacauucaaaaccgcgcacgccaagaagcaagaaguggucgugcucggaucccaggagggcgcuaugcacaccgcccugacaggggccacggaaauccagaccucuggaacaaccacaauuuuugcuggccaucuuaaaugccgccugaagauggacaaacucacccugaaggggacgagcuauguuauguguacaggcuccuucaaacuggagaaggaaguggccgagacccagcacggaaccguccuugugcaaguuaaguacgagggcacagaugcgccgugcaaaaucccuuucagcacccaggacgaaaagggggugacacagaauggaagacucaucacggcuaaccccauugucaccgauaaagagaagccugugaauaucgaaacagagccccccuuuggcgagucuuauauugugguuggggccggagaaaaagcccugaagcuguccugguucaagaaaggcagcucuaucgggaagauguuugaggcuaccgcccggggcgcuagacgcauggccauucucggagacacagcgugggauuucggcagcaucgggggagucuuuaccuccgugggcaaacuggugcaucaggucuucgggacggccuacggagugcuuuuuucuggcguuagcuggaccaugaagaucgggauuggcauccugcucacauggcugggacugaacucccggagcaccucucuuuccaugacauguauugcugugggcauggucacccucuaccugggggugaugguucaagccgacagcggaugcgugaucaacuggaaaggcagagaacugaagugugggucuggaauuuucgucacaaaugaggugcacaccuggacggaacaguauaaguuucaggcugauuccccuaaacgccucagcgccgcgaucggcaaggccugggaggaggggguuugcggcauucgguccgcuacaagacuggaaaacaucauguggaaacagaucucuaaugagcuuaaccauauucugcucgaaaaugacaugaaguucaccguggucgugggagacgccaacggcauccuggcucaagggaaaaagaugauucgcccgcagcccauggagcacaaauacagcuggaaguccuggggaaaggccaaaaucauuggcgccgauauccagaauaccacauuuaucauugacgggccugauacccccgaauguccugacgaucagcgggcuuggaacaucugggagguggaggacuauggauucggcauuuuuacgacaaauaucuggcugaagcuuagagauucuuacacccaaaugugcgaccaccgccucaugagcgcggccauuaaagauuccaaggcuguccaugccgacaugggcuauuggaucgaaagcgagaaaaacgaaacauggaagcuggcccgggcuucuuucaucgagguuaagaccuguacauggcccaaaucccacacccuguggagcaauggggugcucgaaucugagaugauuaucccgaagauuuacggaggcccuaucucccagcauaacuauagacccggguacuucacgcagaccgccggaccuuggcaccugggcaaacuugagcuggauuuugaccucugcgaagggacaaccguggucguggaugagcacugcggaaaucgcggccccagccugcggacaaccacgguuacaggcaagauuauccaugaaugguguugcagaucuuguacccugccuccccuucgguuccgcggggaggacggaugcugguacggcauggagaucagaccggugaaagaaaaggaggaaaaccucguccggagcaugguguccgcggggagcggagagguugacucuuuuucccugggcauucugugugcuagcaucaugauugaagaggugaugagaucccgcuggucucggaagaugcucaugacagggacccuggccgucuuccuucugcucaucaugggacaacugaccuggaaugaucugauuagacuuugcaucauggugggcgccaacgcuagcgaccgcaugggcauggggacaacguaucuggcccucauggcgaccuuuaaaaugagaccuauguucgcuguuggacugcucuuucggcgccugacauccagagaggugcuucugcucaccauuggccugucucuggucgccagcguggaacuucccaacucccuggaggaacucggggauggacuggccaugggcaucaugaugcucaagcugcuuacagaguuccagccccaccagcuguggaccacgcuccugucucugacauuuaucaaaaccacccuuagccuggacuacgcuuggaagacaaccgccauggcucucuccauugugagccuguucccucucugucugucuacaacgucccagaaaaccacauggcuuccgguccugcuggggagcuuuggaugcaagccccucaccauguuccugaucacagaaaauaagauuuggggccggaaaucuuggccucuuaacgagggcaucauggccauugggaucguuuccauccugcucagcucucugcucaagaaugaugugccccuggcgggaccucuuauugccggcgggaugcugaucgcuuguuaugugauuuccggaagcuccgccgaccugagccucgagaaagcugccgaagucucuugggagcaagaagccgagcauagcggcaccucccacaacauccugguggaaguucaggaugacgggacgaugaagauuaaagaugaggagaaggacgauacccuuacaauccugcucaaagcuacccugcucgcggugucuggagucuaccccaugagcaucccugccacacuguuugugugguauuucuggcagaagaagaaacagcgcuccggcguucuuugggacacccccucuccgccugaaguggagagagcuguccuggaugacggcauuuaccggauccugcaacgcgggcuccugggaagaagccaggugggcgucgggguguuccaggacggaguuuuucauacaauguggcacgugacgcggggcgccguccuuauguaucaggggaagcgccuggaacccuccugggccucugugaaaaaggaucucauuagcuacggaggcggcuggagauuccaaggguccuggaauaccggagaggagguucaggugaucgcugucgaaccuggcaaaaaccccaagaaugugcagacaaccccggggaccuuuaagacaccugagggagaagugggcgccauugcgcuggacuucaaacccgggacgagcggaucuccuaucguuaaccgggagggcaagauugucggccucuacgggaauggaguggugaccacauccggcaccuaugucagcgcuaucgcccaagccaaagcuucucaggaagggccccugcccgagaucgaggaugaaguguuuaagaaaagaaaccuuacaauuauggaccugcacccuggauccggcaagacccgccgguaccugccggccaucguuagagaggcgauuaagcgcaaacuccggacgcugauccuugcucccacaagaguggucgccagcgaaauggccgaggcucugaaggggaugccuauucgcuaucagaccaccgccgugaaauccgaacauacaggccgggagaucguugaucucaugugccacgcuaccuucacaaugagacugcugucucccgugcgcgucccuaauuacaacaugaucauuauggacgaggcccauuuuaccgaucccgcgagcaucgccgcucggggauauauuuccacgagagugggcaugggggaagccgcugccaucuucaugacagccaccccuccgggaagcguugaggcuuuuccccagucuaaugcggugauucaagacgaagagcgggauaucccugaacgcuccuggaacagcggcuacgacuggaucacagauuuccccgggaagaccgucugguuugugccuucuauuaaaagcggaaaugacaucgccaacugucucagaaagaacggcaagcgggugauucagcuuucccgcaaaacguucgacaccgaguaucagaagacaaaaaauaacgauugggacuacgucguuaccacagauaucucugagaugggggcuaauuucagagccgaccgggugauugaucccagacgcugccugaagccggugauccugaaagacggcccugaacgggucauucucgccggacccaugcccgugaccguugcuagcgccgcgcagagacgcggccggaucgggagaaaccaaaauaaggagggagaucaguacguguauaugggccagccucugaacaaugacgaagaucacgcucauuggacagaggccaagaugcuucuggacaacaucaauacccccgaggggauuaucccugcccucuuugaaccggagcgcgaaaaauccgcugccauugauggagaguaccggcugagaggcgaagcgcgcaagacguucgucgagcugaugagacggggggaccuccccguguggcuuucuuauaaaguugccagcgagggcuuucaguacuccgaucgcagauggugcuucgacggagaacggaacaaucaagugcuggaggaaaacauggacgucgagaucuggacaaaggaaggcgagcgcaaaaagcugagaccucgguggcucgaugcuagaaccuauagcgacccccuggcccuucgcgaguuuaaagaauucgcugccgggcggagaucuguguccggagaucugauucucgagaucggcaagcugccucagcaccugacccuccgcgcucagaaugcccuugacaaccuggucaugcugcacaauagcgaacaggggggaaaggcguaccggcaugccauggaggaacuccccgauacaaucgagacccugaugcuucuggcucucauugccgugcugacaggcggcguuacgcuguuuuuccucuccgggaaaggacuuggcaagaccucuaucgggcugcugugugugacagcuagcuccgcccuccuguggauggccucuguggagccgcacuggauugcugcgagcaucauucuugaauuuuuccugaugguccuccugaucccugagcccgacagacaacggaccccucaggauaaccagcuggccuauguugugaucggacuccuuuuuaugauucugacaguggcugccaacgaaaugggccugcucgagaccacgaaaaaggaccuggggaucggacaugucgccgcugagaaucaccaacacgccaccaugcuugauguggaccugcgccccgcguccgccuggacacucuacgcuguugccaccacagugauuaccccuaugaugagacauacgaucgaaaacacaaccgcuaauauuagccugacagccaucgcgaaccaggccgcuauucugaugggccucgauaaaggcuggcccaucucuaagauggacaucggggucccgcuucuggcccugggaugcuacucccaggugaauccucucacccugaccgcugccguccuuaugcugguggcucacuaugccauuaucggccccgggcuccaggcgaaggccacacgggaggcucaaaaacgcacggccgcuggaauuaugaagaaccccaccguugauggcaucguggccauugaccuggacccugucguguacgaugccaaauucgaaaagcagcuggggcagaucaugcuccuuauccuguguacaagccagauucugcucaugagaaccacaugggcgcugugcgagucuaucacccuugcuacgggaccgcugacaacccucugggaaggcucccccggcaaauuuuggaauaccacaauugccguuagcauggcuaacaucuuccgggggucuuaucuggccggagccggccuggcuuucagccucaugaagucccuugggggaggccgcagagggaccggagcccaaggcgagacacugggcgagaaguggaaacggcagcugaaucagcucucuaagagcgaauuuaacacguacaaacgcuccgggauuauggagguggacagaagcgaagcgaaggagggacugaaacggggcgaaaccacaaagcaugccgucuccagagggaccgcuaagcuucgcugguucguggagcggaaucuggugaaaccugagggaaagguuaucgaucucggcugugggagaggaggcuggucuuauuacugcgccggccugaaaaaggucacagaagugaaaggguauaccaagggaggccccgggcacgaggaaccuauccccauggcuacguacggauggaaccuggugaaacuccauagcggcaaggacgucuuuuucaugccuccggagaagugugauacccuucugugcgacauuggggaauccucucccaauccuacaaucgaggagggacgcacccugcggguucucaaaaugguggaacccuggcugagaggcaaccaguuuuguauuaagauccuuaauccuuacaugcccagcguggucgagacacuggaacaaaugcagcgcaaacacggcgggaugcucgugcggaacccgcuguccagaaauucuacccacgagauguauuggguuagcugcggaacaggcaacauuguguccgccgucaacaugaccagccgcaugcugcucaaucgguucacgauggcgcauagaaagccuacauacgagcgcgauguggaccugggggccggaacccggcacguugcuguggaacccgaggucgccaaccuugauaucauuggccagagaaucgaaaauaucaaaaacgagcauaagucuaccuggcacuaugacgaagauaaucccuacaagacaugggcuuaucacggguccuacgaggugaaaccuagcggaucugccuccagcauggugaacggcgucguucgccugcucacgaagcccugggacgugauuccuauggugacccaaaucgcuaugacagacaccacaccguuuggccagcagagagucuucaaagagaagguggauacccggacaccccgcgccaaaagagggaccacgcagauuauggaaguuaccgcgaaguggcuguggggauuucuuucucggaauaagaaaccuagaaucuguacacgggaggaauucacccgcaaggugagauccaacgccgcuauuggcgccgucuuuguggacgagaaucaauggaacagcgcuaaagaagccguugaggaugagcgguucugggaccuggugcaucgcgaaagagagcuccacaagcaggggaaaugcgccacaugcgucuauaauaugaugggaaagcgggaaaagaaacugggcgaguuugggaaggcgaaaggcucccgcgcuaucugguacauguggcugggagccagauuccucgaauucgaggcccugggcuuuaugaacgaggaucauugguucagccgggaaaauucucuuagcgggguggagggagaaggccugcacaagcucggguacauccugcgcgacauuuccaaaauccccggaggcaacauguaugcugaugacaccgccgggugggauacgagaauuacagaggacgaucuucagaaugaggcuaagaucaccgacauuauggaaccugagcaugcccugcucgcgacaucuaucuuuaaacugaccuaccagaacaagguugugcggguccaacgccccgccaagaacggcacggugauggaugucaucagcagacgggaccagcgcggauccggccagguggggaccuauggacugaauacauucaccaacauggaaguucagcucauuagacaaauggagucugaaggcaucuuucugccgagcgagcuugagacaccuaaucuggcuaaacgggugcucgacuggcuggaaaagcacggggccgagagacuuaaacgcauggcuauuuccggagaugacugugucgugaagcccaucgaugaccgguucgccaccgcgcugacagcccucaacgauaugggcaaagugagaaaggacauuccucagugggaacccucuaagggguggaaugauuggcagcagguuccuuuuugcagccaccauuuccaccaacugaucaugaaagacggccgcgagaucgugguccccugucggaaccaggaugaacuggugggaagagcucgcguuucccagggcgccggguggagccuccgggagaccgcuugccugggaaagucuuacgcccaaauguggcagcuuauguauuuucauagacgcgaccugcggcucgcugccaaugcgauuuguuccgccgugccggucgauugggugccuacgagcagaacaaccuggucuauccacgcucaccaucaguggaugaccacagaggacaugcuguccgucuggaaccgcguguggauugaagagaaucccuggauggaagacaaaacccacguuagcuccugggaggaagugcccuaccuuggcaagcgggaggaucaguggugcgggucucugaucggacucacagccagagccacgugggcuaccaacauucaagucgccaucaaucaggugcggagacugauuggcaacgagaauuaucuggacuacaugacaagcaugaaacgcuucaagaacgaauccgauccugagggggcgcucugguga

SEQ ID NO: 18664 - RNA, 9879 nt, Artificial Sequence
  derived and/or modified CDS sequence (opt5) from DENV-1__EU482618__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauugugucucuguucccucucugucuguccacaacgagccagaaaaccacauggcuuccgguccugcuggggucuuuuggaugcaagccccucaccauguuccugaucacagaaaauaagauuuggggccggaaauccuggccucuuaacgagggcaucauggccauugggaucguuagcauccugcucucuucccugcucaagaaugacgugccccuggcgggaccucuuauugccggcgggaugcugaucgcuuguuaugugauuagcggauccagcgccgaucugucucucgagaaagcugccgaagucagcugggagcaagaagccgagcauuccggcaccucucacaacauccugguggaaguucaggacgaugggacgaugaagauuaaagacgaggagcgcgaugacacccuuacaauccugcucaaggcuacccugcucgcggugagcggagucuaccccauguccaucccugccacacuguuugugugguauuucuggcagaaaaagaagcagagaucuggcguucuuugggauacccccagcccgccugaaguggagcgggcuguccuggacgauggcauuuaccgcauccugcaaagagggcuccugggacggucccaggugggcgucgggguguuccaggacggaguuuuucauacaauguggcacgugacgcgcggcgccguccuuauguaucaggggaaaagacuggaacccucuugggccagcgugaagaaagaccucauuuccuacggaggcggcuggcgguuccaagggagcuggaauaccggagaggagguucaggugaucgcugucgaaccuggcaagaaccccaaaaaugugcagacaaccccggggaccuuuaagacaccugagggagaagugggcgccauugcgcuggauuucaagcccgggacgucuggauccccuaucguuaacagagagggcaaaauugucggccucuacgggaauggaguggugaccacaagcggcaccuaugucucugcuaucgcccaagccaaggcuucccaggaagggccccugcccgagaucgaggacgaaguguuuaaaaagcgcaaccuuacaauuauggaucugcacccuggaagcggcaaaacccggagauaccugccggccaucguucgcgaggcgauuaagcggaagcucagaacgcugauccuugcucccacacgcguggucgccuccgaaauggccgaggcucugaaagggaugccuauucgguaucagaccaccgccgugaagucugaacauacaggcagagagaucguugaccucaugugccacgcuaccuucacaaugcgccugcugagccccgugcgggucccuaauuacaacaugaucauuauggaugaggcccauuuuaccgaccccgcguccaucgccgcuagaggauauauuagcacgcgggugggcaugggggaagccgcugccaucuucaugacagccaccccuccgggaucuguugaggcuuuuccccaguccaaugcggugauucaagaugaagagcgcgacaucccugaaagaagcuggaacucuggcuacgauuggaucacagacuuccccgggaaaaccgucugguuugugccuagcauuaaguccggaaaugauaucgccaacugucuccggaaaaacggcaagcgcgugauucagcuuucuagaaagacguucgacaccgaguaucagaaaacaaagaauaacgacugggauuacgucguuaccacagacaucagcgagaugggggcuaauuuccgggccgauagagugauugacccccgccggugccugaaaccggugauccugaaggauggcccugaaagagucauucucgccggacccaugcccgugaccguugcuuccgccgcgcagcgccggggcagaaucgggcgcaaccaaaauaaagagggagaccaguacguguauaugggccagccucugaacaaugaugaagaccacgcucauuggacagaggccaagaugcuucuggauaacaucaauacccccgaggggauuaucccugcccucuuugaaccggagcgggaaaagucugcugccauugacggagaguacagacugcgcggcgaagcgagaaaaacguucgucgagcugaugcggcgcggggaucuccccguguggcuuagcuauaagguugccuccgagggcuuucaguacagcgacagacgguggugcuucgauggagaacgcaacaaucaagugcuggaggaaaacauggacgucgagaucuggacaaaagaaggcgagagaaagaaacugcggccuagauggcucgacgcucgcaccuauucugauccccuggcccuucgggaguuuaaggaauucgcugccgggagacgcuccgugagcggagaccugauucucgagaucggcaaacugccucagcaccugacccuccgggcucagaaugcccuugauaaccuggucaugcugcacaauuccgaacaggggggaaaggcguacagacaugccauggaggaacuccccgacacaaucgagacccugaugcuucuggcucucauugccgugcugacaggcggcguuacgcuguuuuuccucucugggaagggacuuggcaaaaccagcaucgggcugcugugugugacagcuuccucugcccuccuguggauggccagcguggagccgcacuggauugcugcguccaucauucuugaauuuuuccugaugguccuccugaucccugagcccgaucggcaacgcaccccucaggacaaccagcuggccuauguugugaucggacuccuuuuuaugauucugacaguggcugccaacgaaaugggccugcucgagaccacgaagaaagaucuggggaucggacaugucgccgcugagaaucaccaacacgccaccaugcuugacguggaucugagacccgcgagcgccuggacacucuacgcuguugccaccacagugauuaccccuaugaugcggcauacgaucgaaaacacaaccgcuaauauuucucugacagccaucgcgaaccaggccgcuauucugaugggccucgacaagggcuggcccaucuccaaaauggauaucggggucccgcuucuggcccugggaugcuacagccaggugaauccucucacccugaccgcugccguccuuaugcugguggcucacuaugccauuaucggccccgggcuccaggcgaaggccacacgcgaggcucaaaagagaacggccgcuggaauuaugaaaaaccccaccguugacggcaucguggccauugaucuggacccugucguguacgacgccaaguucgaaaaacagcuggggcagaucaugcuccuuauccuguguacaucucagauucugcucaugcggaccacaugggcgcugugcgaguccaucacccuugcuacgggaccgcugacaacccucugggaaggcagccccggcaaguuuuggaauaccacaauugccguuucuauggcuaacaucuuccgcgggagcuaucuggccggagccggccuggcuuucucccucaugaaaucucuugggggaggcagacgggggaccggagcccaaggcgagacacugggcgagaaguggaagcgccagcugaaucagcucagcaaauccgaauuuaacacguacaagagaagcgggauuauggagguggaucgguccgaagcgaaagagggacugaagagaggcgaaaccacaaaacaugccgucucucgcgggaccgcuaagcuucggugguucguggagagaaaucuggugaagccugagggaaaaguuaucgaccucggcugugggcgcggaggcuggagcuauuacugcgccggccugaagaaagucacagaagugaagggguauaccaaaggaggccccgggcacgaggaaccuauccccauggcuacguacggauggaaccuggugaagcuccauuccggcaaagaugucuuuuucaugccuccggagaagugugacacccuucugugcgauauuggggaaucuagccccaauccuacaaucgaggagggacggacccugagaguucucaagaugguggaacccuggcugcgcggcaaccaguuuuguauuaaaauccuuaauccuuacaugcccuccguggucgagacacuggaacaaaugcagcggaagcacggcgggaugcucgugagaaacccgcugucucgcaauagcacccacgagauguauuggguuuccugcggaacaggcaacauugugagcgccgucaacaugaccucucggaugcugcucaauagauucacgauggcgcaucgcaaaccuacauacgagcgggacguggaucugggggccggaaccagacacguugcuguggaacccgaggucgccaaccuugacaucauuggccagcgcaucgaaaauaucaagaacgagcauaaauccaccuggcacuaugaugaagacaaucccuacaagacaugggcuuaucacgggagcuacgaggugaagccuucuggauccgccagcucuauggugaacggcgucguuagacugcucacgaaacccugggaugugauuccuauggugacccaaaucgcuaugacagacaccacaccguuuggccagcagcgggucuucaaggagaaaguggacacccgcacacccagagccaagcgggggaccacgcagauuauggaaguuaccgcgaaauggcuguggggauuucuuuccagaaauaagaagccucggaucuguacacgcgaggaauucaccagaaaagugcggagcaacgccgcuauuggcgccgucuuuguggaugagaaucaauggaacuccgcuaaggaagccguugaggacgagcgcuucugggaucuggugcauagagaacgggagcuccacaaacaggggaagugcgccacaugcgucuauaauaugaugggaaaacgcgaaaagaagcugggcgaguuugggaaagcgaagggcagcagagcuaucugguacauguggcugggagcccgguuccucgaauucgaggcccugggcuuuaugaacgaggaccauugguucucucgcgaaaauagccuuuccgggguggagggagaaggccugcacaaacucggguacauccugagagauauuucuaagauccccggaggcaacauguaugcugacgauaccgccgggugggacacgcggauuacagaggaugaccuucagaaugaggcuaaaaucaccgauauuauggaaccugagcaugcccugcucgcgacaagcaucuuuaagcugaccuaccagaacaaaguugugcgcguccaaagacccgccaagaacggcacggugauggacgucaucucccggcgcgaucagagaggaucuggccagguggggaccuauggacugaauacauucaccaacauggaaguucagcucauucggcaaauggagagcgaaggcaucuuucugccguccgagcuugagacaccuaaucuggcugaaagagugcucgacuggcuggagaagcacggggccgaacgccuuaaacggauggcuauuucuggagacgauugugucgugaagcccaucgacgauagauucgccaccgcgcugacagcccucaacgacaugggcaaagugcgcaaggauauuccucagugggagcccagcaaaggguggaaugacuggcagcagguuccuuuuugcucccaccauuuccaccaacugaucaugaaggauggccgggaaaucgugguccccuguagaaaccaggacgagcuggugggacgcgcucggguuagccagggcgccggguggucucucagagagaccgcuugccugggaaaguccuacgcccaaauguggcagcuuauguauuuucaucgccgggaucugagacucgcugccaaugcgauuuguagcgccgugccggucgacugggugccuacgucucgcacaaccugguccauccacgcucaccaucaguggaugaccacagaagauaugcugagcgucuggaaccggguguggauugaggaaaaucccuggauggaggacaaaacccacguuuccucuugggaagaggugcccuaccuuggcaagagagaggaccaguggugcgggagccugaucggacucacagcccgggccacgugggcuaccaacauucaagucgccaucaaucaggugagacgccugauuggcaacgaaaauuaucuggauuacaugacauccaugaaacgguucaagaacgagagcgacccugaaggggcgcucugguga

SEQ ID NO: 18665 - RNA, 9879 nt, Artificial Sequence
  derived and/or modified CDS sequence (opt5) from DENV-1__EU482619__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauugugucucuguucccucucugucuguccacaacgagccagaaaaccacauggcuuccgguccugcuggggucuuuuggaugcaagccccucaccauguuccugaucacagaaaauaagauuuggggccggaaauccuggccucuuaacgagggcaucauggccauugggaucguuagcauccugcucucuucccugcucaagaaugacgugccccuggcgggaccucuuauugccggcgggaugcugaucgcuuguuaugugauuagcggauccagcgccgaucugucucucgagaaagcugccgaagucagcugggagcaagaagccgagcauuccggcaccucucacaacauccugguggaaguucaggacgaugggacgaugaagauuaaagacgaggagcgcgaugacacccuuacaauccugcucaaggcuacccugcucgcggugagcggagucuaccccauguccaucccugccacacuguuugugugguauuucuggcagaaaaagaagcagagaucuggcguucuuugggauacccccagcccgccugaaguggagcgggcuguccuggacgauggcauuuaccgcauccugcaaagagggcuccugggacggucccaggugggcgucgggguguuccaggacggaguuuuucauacaauguggcacgugacgcgcggcgccguccuuauguaucaggggaaaagacuggaacccucuugggccagcgugaagaaagaccucauuuccuacggaggcggcuggcgguuccaagggagcuggaauaccggagaggagguucaggugaucgcugucgaaccuggcaagaaccccaaaaaugugcagacaaccccggggaccuuuaagacaccugagggagaagugggcgccauugcgcuggauuucaagcccgggacgucuggauccccuaucguuaacagagagggcaaaauugucggccucuacgggaauggaguggugaccacaagcggcaccuaugucucugcuaucgcccaagccaaggcuucccaggaagggccccugcccgagaucgaggacgaaguguuuaaaaagcgcaaccuuacaauuauggaucugcacccuggaagcggcaaaacccggagauaccugccggccaucguucgcgaggcgauuaagcggaagcucagaacgcugauccuugcucccacacgcguggucgccuccgaaauggccgaggcucugaaagggaugccuauucgguaucagaccaccgccgugaagucugaacauacaggcagagagaucguugaccucaugugccacgcuaccuucacaaugcgccugcugagccccgugcgggucccuaauuacaacaugaucauuauggaugaggcccauuuuaccgaccccgcguccaucgccgcuagaggauauauuagcacgcgggugggcaugggggaagccgcugccaucuucaugacagccaccccuccgggaucuguugaggcuuuuccccaguccaaugcggugauucaagaugaagagcgcgacaucccugaaagaagcuggaacucuggcuacgauuggaucacagacuuccccgggaaaaccgucugguuugugccuagcauuaaguccggaaaugauaucgccaacugucuccggaaaaacggcaagcgcgugauucagcuuucuagaaagacguucgacaccgaguaucagaaaacaaagaauaacgacugggauuacgucguuaccacagacaucagcgagaugggggcuaauuuccgggccgauagagugauugacccccgccggugccugaaaccggugauccugaaggauggcccugaaagagucauucucgccggacccaugcccgugaccguugcuuccgccgcgcagcgccggggcagaaucgggcgcaaccaaaauaaagagggagaccaguacguguauaugggccagccucugaacaaugaugaagaccacgcucauuggacagaggccaagaugcuucuggauaacaucaauacccccgaggggauuaucccugcccucuuugaaccggagcgggaaaagucugcugccauugacggagaguacagacugcgcggcgaagcgagaaaaacguucgucgagcugaugcggcgcggggaucuccccguguggcuuagcuauaagguugccuccgagggcuuucaguacagcgacagacgguggugcuucgauggagaacgcaacaaucaagugcuggaggaaaacauggacgucgagaucuggacaaaagaaggcgagagaaagaaacugcggccuagauggcucgacgcucgcaccuauucugauccccuggcccuucgggaguuuaaggaauucgcugccgggagacgcuccgugagcggagaccugauucucgagaucggcaaacugccucagcaccugacccuccgggcucagaaugcccuugauaaccuggucaugcugcacaauuccgaacaggggggaaaggcguacagacaugccauggaggaacuccccgacacaaucgagacccugaugcuucuggcucucauugccgugcugacaggcggcguuacgcuguuuuuccucucugggaagggacuuggcaaaaccagcaucgggcugcugugugugacagcuuccucugcccuccuguggauggccagcguggagccgcacuggauugcugcguccaucauucuugaauuuuuccugaugguccuccugaucccugagcccgaucggcaacgcaccccucaggacaaccagcuggccuauguugugaucggacuccuuuuuaugauucugacaguggcugccaacgaaaugggccugcucgagaccacgaagaaagaucuggggaucggacaugucgccgcugagaaucaccaacacgccaccaugcuugacguggaucugagacccgcgagcgccuggacacucuacgcuguugccaccacagugauuaccccuaugaugcggcauacgaucgaaaacacaaccgcuaauauuucucugacagccaucgcgaaccaggccgcuauucugaugggccucgacaagggcuggcccaucuccaaaauggauaucggggucccgcuucuggcccugggaugcuacagccaggugaauccucucacccugaccgcugccguccuuaugcugguggcucacuaugccauuaucggccccgggcuccaggcgaaggccacacgcgaggcucaaaagagaacggccgcuggaauuaugaaaaaccccaccguugacggcaucguggccauugaucuggacccugucguguacgacgccaaguucgaaaaacagcuggggcagaucaugcuccuuauccuguguacaucucagauucugcucaugcggaccacaugggcgcugugcgaguccaucacccuugcuacgggaccgcugacaacccucugggaaggcagccccggcaaguuuuggaauaccacaauugccguuucuauggcuaacaucuuccgcgggagcuaucuggccggagccggccuggcuuucucccucaugaaaucucuugggggaggcagacgggggaccggagcccaaggcgagacacugggcgagaaguggaagcgccagcugaaucagcucagcaaauccgaauuuaacacguacaagagaagcgggauuauggagguggaucgguccgaagcgaaagagggacugaagagaggcgaaaccacaaaacaugccgucucucgcgggaccgcuaagcuucggugguucguggagagaaaucuggugaagccugagggaaaaguuaucgaccucggcugugggcgcggaggcuggagcuauuacugcgccggccugaagaaagucacagaagugaagggguauaccaaaggaggccccgggcacgaggaaccuauccccauggcuacguacggauggaaccuggugaagcuccauuccggcaaagaugucuuuuucaugccuccggagaagugugacacccuucugugcgauauuggggaaucuagccccaauccuacaaucgaggagggacggacccugagaguucucaagaugguggaacccuggcugcgcggcaaccaguuuuguauuaaaauccuuaauccuuacaugcccuccguggucgagacacuggaacaaaugcagcggaagcacggcgggaugcucgugagaaacccgcugucucgcaauagcacccacgagauguauuggguuuccugcggaacaggcaacauugugagcgccgucaacaugaccucucggaugcugcucaauagauucacgauggcgcaucgcaaaccuacauacgagcgggacguggaucugggggccggaaccagacacguugcuguggaacccgaggucgccaaccuugacaucauuggccagcgcaucgaaaauaucaagaacgagcauaaauccaccuggcacuaugaugaagacaaucccuacaagacaugggcuuaucacgggagcuacgaggugaagccuucuggauccgccagcucuauggugaacggcgucguuagacugcucacgaaacccugggaugugauuccuauggugacccaaaucgcuaugacagacaccacaccguuuggccagcagcgggucuucaaggagaaaguggacacccgcacacccagagccaagcgggggaccacgcagauuauggaaguuaccgcgaaauggcuguggggauuucuuuccagaaauaagaagccucggaucuguacacgcgaggaauucaccagaaaagugcggagcaacgccgcuauuggcgccgucuuuaucgaugagaaucaauggaacuccgcuaaggaagccguggaggacgagcgcuucugggaucugguucauagagaacgggagcuccacaaacaggggaagugcgccacaugcguguauaauaugaugggaaaacgcgaaaagaagcugggcgaguuugggaaagcgaagggcagcagagcuaucugguacauguggcugggagcccgguuccucgaauucgaggcccugggcuuuaugaacgaggaccauugguucucucgcgaaaauagccuuuccggggucgagggagaaggccugcacaaacucggguacauucugagagauaucucuaagauucccggaggcaacauguaugcugacgauaccgccgggugggacacgcgggugacagaggaugaccuucagaaugaggcuaaaaucaccgauauuauggaaccugagcaugcccugcucgcgacaagcaucuuuaagcugaccuaccagaacaaaguugugcgcguccaaagacccgccaagaacggcacggugauggacgucaucucccggcgcgaucagagaggaucuggccagguggggaccuauggacugaauacauucaccaacauggaaguucagcucauucggcaaauggagagcgaaggcaucuuucugccguccgagcuugagacaccuaaucuggcugaaagagugcucgacuggcuggagaagcacggggccgaacgccuucggagaauggcuauuucuggagacgauugugucgugaaacccaucgacgaucgcuucgccaccgcgcugacagcccucaacgacaugggcaaggugcggaaagauauuccucagugggagcccagcaagggguggaaugacuggcagcagguuccuuuuugcucccaccauuuccaccaacugaucaugaaagauggcagagaaaucgugguccccugucgcaaccaggacgagcuggugggacgggcuagaguuagccagggcgccggguggucucuccgcgagaccgcuugccugggaaaguccuacgcccaaauguggcagcuuauguauuuucaucggagagaucugcgccucgcugccaaugcgauuuguagcgccgugccggucgacugggugccuacgucucggacaaccugguccauccacgcucaccaucaguggaugaccacagaagauaugcugagcgucuggaacagaguguggauugaggaaaaucccuggauggaggacaagacccacguuuccucuugggaagaggugcccuaccuuggcaaacgggaggaccaguggugcgggagccugaucggacucacagccagagccacgugggcuaccaacauucaagucgccaucaaucaggugcgccggcugauuggcaacgaaaauuaucuggauuacaugacauccaugaagagauucaaaaacgagagcgacccugaaggggcgcucugguga

SEQ ID NO: 18666 - RNA, 9879 nt, Artificial Sequence
  derived and/or modified CDS sequence (opt5) from DENV-1__FJ898433__SS-prME
agcgugaccaugcugcucaugcugcuucccaccgcucuggcuuuccaccucacgacccggggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccccagaucacagaggcugaacccgacgauguggacuguuggugcaaugccaccgauacgugggugaccuauggaacauguucccagaccggcgagcaccgcagagagaagcggucugucgcccuggcuccucauguggggcucggacuggaaacacgcaccgagacguggaugagcuccgaaggcgccuggaaacagauucagagaguugagacaugggcccuucggcaccccggcuucaccgugacagcccuguuucucgcgcaugccaucgggaccucuauuacccagaagggaaucaucuucauucugcuuaugcuggucacaccuagcauggcuaugcgcugcgugggcaucgggaacagagacuuuguugagggacucuccggcgccacguggguggaugucgugcuggaacacgggagcugugugaccacaauggcuaagaauaaacccacccuggacauugagcuccugaagacagaagucaccaacccugccauccuucggaaacugugcauugaggcgaagaucucuaauacgacaaccgauucccgcuguccgacccagggagaagccacacucguugaggagcaggacgcuaacuucgugugcagacggaccuuuguggaucgcggcuggggcaauggguguggacuguucggcaaagggagccuucugacaugcgccaaguuuaagugcgucacgaaacucgaaggaaagauugugcaguacgagaaccugaaauauucuguuaucgugaccguccacacaggcgaccaacaucagguggggaaugaaaccacagagcacggaaccaucgcuacgauuacaccccaggccccuacauccgaaauccagcugaccgauuacggcgcccucacacuggacuguagccccagaaccggccuugacuucaacgagaugguucugcucacgaugaaggagaaaucuuggcuggugcauaagcaaugguuucuugaucugccucuccccuggacauccggggcuagcaccucccaggaaacauggaaucggcaggaccugcuggucaccuucaaaaccgcgcacgccaagaagcaagagguggucgugcucggaucucaggaaggcgcuaugcacacagcccugacgggggccaccgagauucagacaagcggaaccacaaccaucuuugcuggccaucuuaaaugccgccugaagauggauaaacucacgcugaaggggacauccuauguuauguguaccggcagcuucaaacuggaaaaggagguggccgagacccagcacggaacaguccuugugcaaguuaaguacgaaggcaccgacgcgccgugcaaaauuccuuucucuacacaggaugagaagggggugacgcagaacggaagacucaucaccgcuaaucccaucgucacagacaaagaaaagccugugaacauugagaccgagccgcccuuuggcgaauccuauaucgugguuggggccggagagaaagcccugaagcugagcugguucaagaaaggcucuagcauugggaagauguuugaagcuacagcccggggcgcuagacgcauggccauccucggagauaccgcgugggacuucggcuccauugggggagucuuuacgucugugggcaaacuggugcaucaggucuucgggaccgccuacggagugcuuuuuagcggcguuuccuggacaaugaagaucgggaucggcauucugcucaccuggcugggacugaauagccggucuacaucccuuagcaugaccuguaucgcugugggcauggucacacucuaccugggggugaugguucaagccgauucuggaugcgugauuaacuggaaaggcagagagcugaaguguggguccggaaucuucgucaccaacgaagugcacacguggacagagcaguauaaguuucaggcugacagcccuaaacgccucuccgccgcgauuggcaaggccugggaggaagggguuugcggcauccggucugcuaccagacuggagaauauuauguggaaacagaucagcaacgaacuuaaucauauccugcucgagaacgauaugaaguucaccguggucgugggagacgccaauggcauucuggcucaagggaaaaagaugauccgcccgcagcccauggaacacaaauacuccuggaagucuuggggaaaggccaaaauuaucggcgccgacauucagaacacaaccuuuaucaucgaugggccugacacgcccgaguguccugauaaucagcgggcuuggaacauuugggagguggaagacuauggauucggcaucuuuacaaccaauauuuggcugaaacuuagagauagcuacacacaaaugugcgaccaccgccucauguccgcggccaucaaagauagcaaggcuguccaugccgacaugggcuauuggauugagucugagaagaacgagaccuggaagcuggcccgggcuuccuucaucgaaguuaagacauguaccuggcccaaaagccacacgcuguggucuaauggggugcucgaguccgagaugaucauuccgaagaucuacggaggcccuauuagccagcauaacuauagacccggguacuucacccagacagccggaccuuggcaccugggcaaacuugaacuggauuuugacucuugcgaggggaccacaguggucguggaugaacacugcggaaaucgcggccccagccuccggaccacgacaguuaccggcaagaucauucaugagugguguugcagauccuguacacugccuccccugcgguuccgcggggaggacggaugcugguacggcauggaaaucagaccggugaaagagaaggaagagaaccuuguccggagcauggugucugcgggguccggagaaguugauagcuuuucccucggcauccugugugugucuauuaugaucgaggaggucaugagaagccgcuggucccggaagaugcugaugaccgggacccucgcuguguuccugcuucugauuaugggacaacucacauggaaagaccugaucagacugugcauuaugguuggcgccaaugccucugaccgcaugggcauggggacgaccuaucuugcucugauggccacauuuaagaugagaccuauguucgcggugggacuccuguuucggcgccucaccagcagagaaguccugcuucugacaaucggccucucccugguggcuucuguggagcugcccaacagccuugaagaacugggggauggacucgccaugggcauuaugaugcugaaacuccugaccgaguuccacccccaucagcuuuggacgacacugcucucccugaccuuuaucaagaccacacugagccuugacuacgccuggaaaaccacagcuauggcccugucuaucgucucccucuucccucugugucucagcacgaccucucagaagacaaccuggcugccgguucuucugggguccuuuggaugcaagccccugacaauguuccucauuaccgagaacaaaaucuggggcagaaagagcuggccucugaaugagggcauuauggcuaucgggauugugucuauccuucuguccagccuccugaaaaacgaugugccccucgccggaccucugaucgcgggcgggaugcuuauugccuguuaugucaucuccggaagcucugcugaccugagccuggaaaaggccgcugagguguccugggaacaggaggccgaacacucuggcacgagccauaauauucucguugaggugcaagaugacgggaccaugaaaaucaaggaugaggaacgcgacgauacacugaccauucuucugaaagccacacuccuggcugucuccggaguguaccccaugucuaucccugcgacccucuuuguuugguauuucuggcagaagaagaaacagagaagcggcgugcugugggacacacccuccccgccugaggucgaacgggccgugcuugaugacggcaucuaccgcauucugcagagagggcugcucggacggucucaagucggcguggggguuuuccaggauggaguguuucacacgauguggcacgucacccgcggcgcugugcugauguaucaggggaagagacuugagcccagcugggccuccguuaaaaaggaccugaucagcuacggaggcggcuggcgguuccaggggucuuggaacacaggagaggaagugcaagucauugccguggagccuggcaaaaaucccaagaacgugcagaccaccccggggacauuuaagacgccugaaggagagguuggcgcuaucgcccucgacuucaaacccgggaccuccggaagcccuauugucaauagagaaggcaagaucgugggccuguacgggaacggaguggucacaaccucuggcacauauguguccgcgauugcucaggccaaagccagccaagaggggccccuccccgagaucgaagaugagguuuuuaagaaacgcaaucugaccaucauggaccuucauccuggauccggcaagacgcggagauaccugccggcuauugugcgcgaagccaucaagcggaaacugagaacacucauucuggcgcccacccgcgucguggcuucugagauggccgaagcccuuaaggggaugccuauccgguaucagaccacagcuguuaaaagcgagcacaccggcagagagauuguggaucugaugugccaugccacauucaccaugcgccuccugucccccguccgggugccuaacuacaauaugaucaucauggacgaagcucacuuuacggaucccgccagcauugcggccagaggauauaucucuacacggguuggcaugggggaggcugccgcuauuuucaugaccgccacaccuccgggauccguggaagccuuuccccagagcaacgcugucauccaggacgaggaacgcgauauuccugagagaucuuggaauagcggcuacgacuggaucaccgauuuccccgggaagacggugugguuugugccuuccaucaaaucuggaaacgacauugcgaauugucugcggaagaacggcaagcgcgucauccaacucagcagaaaaaccuucgauacagaguaucagaagaccaaaaacaaugacugggacuacguugugacaaccgauauuuccgaaaugggggccaacuuccgggcugacagagugaucgauccccgccggugccuuaagccggucauucugaaagacggcccugagagagugauccuggccggacccaugcccguuacaguggccucugcugcccagcgccggggcagaauugggcgcaaucagaacaaggaaggagaucaauacgucuauaugggccagccucucaauaacgacgaggaucaugcgcacuggaccgaggcuaagaugcugcuugacaauaucaacacgcccgaagggaucauuccugcccuguuugagccggaacgggagaaaagcgccgcuaucgauggagaauacagacuccgcggcgaggccagaaagacauucguggagcugaugcggcgcggggaccugcccguuuggcucuccuauaaaguggcgagcgaaggcuuucaguacucugauagacgguggugcuucgacggagagcgcaauaaccagguccuugaagagaauauggauguggaaauuuggaccaaggagggcgagcgcaagaagcugcggccuagauggcuggacgcccgcaccuauuccgacccccucgcucugcgggaauuuaaagaguucgccgcugggagacgcagcgucuccggagaucuuauccuggaaauuggcaagcucccucaacaccugacacugcgggcccagaacgcucucgacaaucuugugaugcugcauaacucugagcaagggggaaaggccuacagacacgcgauggaagaacugcccgauaccaucgagacacucaugcugcuugcccugaucgcuguucucacgggcggcgugacccuguuuuuccugagcgggaaaggacucggcaagacauccauugggcuucugugugugaccgccucuagcgcucugcucuggauggccuccgucgaaccgcauuggaucgccgcuagcauuauccuggaguuuuuccuuaugguucugcucauuccugaacccgaccggcagcgcacaccucaagauaaucagcuggcguauguggugaucggacugcucuuuaugauccuuaccgucgccgcuaacgagaugggccugcuggagacgaccaaaaaggaccucgggauuggacacguggccgccgaaaaccaccagcaugcuacaaugcuggauguugaccuuagacccgccucugcguggacccuguacgccguggcuacaaccgucaucacgccuaugaugcggcacacaauugagaauaccacagccaacaucucccucaccgcuauugccaaucaagcggccauccugaugggccuggauaaaggcuggcccauuagcaagauggacaucggggugccgcuccuugcucugggaugcuacucucaggucaacccucugacccucacagccgcugugcugaugcuuguugcccauuaugcuaucauuggccccgggcugcaggccaaggcgacgcgcgaagcccagaaaagaaccgcugccggaaucaugaagaaucccacaguggauggcauugucgcuaucgaccucgauccugugguuuacgacgccaaauucgagaagcaacuggggcagauuaugcugcucauccuuuguaccucccagauccugcugaugcggacaaccugggcccucugcgaaagcauuacgcuggcgacaggaccgcuuaccacccugugggagggcucucccggcaaauuuuggaacacaaccaucgcugugagcauggccaauauuuuccgcggguccuaucucgcuggagccggccuggccuucucucugaugaaaagccucgggggaggcagacgggggacaggagcucagggcgagacgcuuggcgaaaaguggaaacgccaacugaaccagcuguccaagagcgaguuuaauaccuacaaaagauccgggaucauggaagucgaccggucugaggccaaggaaggacucaaaagaggcgagacaaccaagcacgcggugagccgcgggacagccaagcugcggugguucguggagagaaaccuuguuaaaccugaaggaaaggucauugaucugggcugugggcgcggaggcugguccuauuacugcgcuggccucaaaaaggugaccgaggugaaaggguauacgaagggaggccccgggcaugaggaaccuauccccauggccaccuacggauggaaucuggucaaacugcacucuggcaaggacguguuuuucaugccuccggaaaagugugauacacuccuuugcgacaucggggagagcucccccaacccuaccauugaggaaggacggacacugagaguucugaaaaugguggagcccuggcuccgcggcaaucaguuuuguaucaagauucugaacccuuacaugcccucugucguggaaacccuugagcagaugcaacggaaacacggcgggaugcugguuagaaauccgcucagccgcaacuccacacaugagauguauugggugagcugcggaaccggcaauaucgucucugcugugaacaugacgucccggaugcugcugaacagauucacaauggcccaccgcaagccuaccuacgaaaaagauguugaccucggggcgggaacccggcauguggccgucgagcccgaaguggcuaaucuggauauuaucggccagagaauugagaacaucaagaaugaacacaagagcacauggcacuaugacgaggauaaccccuacaaaacgugggccuaucaugggucuuacgaggugaagccuuccggaagcgcuucuuccauggucaauggcguugugcgccuucugaccaaacccugggacgugaucccuauggucacacagauugccaugaccgauacaaccccguuuggccaacagagaguguucaaggaaaaaguugacacacggacccccagagcuaagagagggacgacccagaucauggaggugacagccaaguggcucuggggauuucugagccggaacaaaaagccuagaauuuguacccgggaagaguucacacgcaaagucagauccaaugcggccaucggcgcuguguuuguugacgaaaaccaguggaauagcgccaaggaggcuguggaggaugaacgguucugggaccuuguccaccgcgagagagaacugcauaaacaagggaagugcgcuaccugcguguauaacaugaugggaaagcgggagaaaaagcucggcgaauuugggaaagccaagggcucucgcgcgauuugguacauguggcugggagcuagauuccuggaguucgaggcccucggcuuuaugaaugaagaucacugguucagccgggagaacucccugucugggguugaaggagagggccuucauaaacugggguacauccuccgcgacaucagcaagauucccggaggcaauauguaugccgaugacacggcugggugggauacaagaaucaccgaggacgaucugcagaacgaagccaaaauuacagacaucauggagccugaacacgcccuucuggccaccuccauuuuuaagcucacguaccagaauaaggugguccgggugcagcgccccgcgaaaaacggcaccgucauggaugugaucucuagacgggaccaacgcggaagcggccagguugggacauauggacugaacaccuucacaaauauggaggugcagcugaucagacagauggaauccgagggcauuuuucucccgucugagcuggaaaccccuaaccuugccgagcggguccuggauuggcucgggaagcacggagcugaaagacugaaacgcauggccaucagcggcgacgacuguguggugaagcccauugaugaccgguucgcuacagcccuuaccgcgcugaaugauauggggaaaguuagaaaggacaucccucaaugggagcccuccaagggcuggaacgauuggcaacaggugccuuuuugcagccaucacuuccaucagcucauuaugaaagacggacgcgaaaucgucgugcccugucggaaucaagaugagcugguuggcagagcccgcgugucucagggggcuggauggucccugaaggagacggccugccucggcaaaagcuacgcucagauguggcaacugauguauuuucaccggagagaccuucgccuggccgcuaacgccaucuguucugcggucccgguggauugggucccuacaucccggaccaccuggagcauucacgcccaucaccaguggaugacaaccgaagacaugcucuccguguggaauagaguuuggaucgaggaaaaccccuggauggaggauaagacacaugugucuagcugggaagagguccccuaccuggggaaacgcgaggaccaguggugcggaucccuuauuggccugacggcucgggccaccugggccacaaauauccagguggcuauuaaccaaguuagacggcucaucgggaaugaaaacuaucuggacuacaugaccagcaugaagagauucaagaaugagucugauccugaaggcgcccugugguga

SEQ ID NO: 18667 - RNA, 9879 nt, Artificial Sequence
  derived and/or modified CDS sequence (opt5) from DENV-1__FJ547088__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauugugucucuguucccucucugucuguccacaacgagccagaaaaccacauggcuuccgguccugcuggggucuuuuggaugcaagccccucaccauguuccugaucacagaaaauaagauuuggggccggaaauccuggccucuuaacgagggcaucauggccauugggaucguuagcauccugcucucuucccugcucaagaaugacgugccccuggcgggaccucuuauugccggcgggaugcugaucgcuuguuaugugauuagcggauccagcgccgaucugucucucgagaaagcugccgaagucagcugggagcaagaagccgagcauuccggcaccucucacaacauccugguggaaguucaggacgaugggacgaugaagauuaaagacgaggagcgcgaugacacccuuacaauccugcucaaggcuacccugcucgcggugagcggagucuaccccauguccaucccugccacacuguuugugugguauuucuggcagaaaaagaagcagagaucuggcguucuuugggauacccccagcccgccugaaguggagcgggcuguccuggacgauggcauuuaccgcauccugcaaagagggcuccugggacggucccaggugggcgucgggguguuccaggacggaguuuuucauacaauguggcacgugacgcgcggcgccguccuuauguaucaggggaaaagacuggaacccucuugggccagcgugaagaaagaccucauuuccuacggaggcggcuggcgguuccaagggagcuggaauaccggagaggagguucaggugaucgcugucgaaccuggcaagaaccccaaaaaugugcagacaaccccggggaccuuuaagacaccugagggagaagugggcgccauugcgcuggauuucaagcccgggacgucuggauccccuaucguuaacagagagggcaaaauugucggccucuacgggaauggaguggugaccacaagcggcaccuaugucucugcuaucgcccaagccaaggcuucccaggaagggccccugcccgagaucgaggacgaaguguuuaaaaagcgcaaccuuacaauuauggaucugcacccuggaagcggcaaaacccggagauaccugccggccaucguucgcgaggcgauuaagcggaagcucagaacgcugauccuugcucccacacgcguggucgccuccgaaauggccgaggcucugaaagggaugccuauucgguaucagaccaccgccgugaagucugaacauacaggcagagagaucguugaccucaugugccacgcuaccuucacaaugcgccugcugagccccgugcgggucccuaauuacaacaugaucauuauggaugaggcccauuuuaccgaccccgcguccaucgccgcuagaggauauauuagcacgcgggugggcaugggggaagccgcugccaucuucaugacagccaccccuccgggaucuguugaggcuuuuccccaguccaaugcggugauucaagaugaagagcgcgacaucccugaaagaagcuggaacucuggcuacgauuggaucacagacuuccccgggaaaaccgucugguuugugccuagcauuaaguccggaaaugauaucgccaacugucuccggaaaaacggcaagcgcgugauucagcuuucuagaaagacguucgacaccgaguaucagaaaacaaagaauaacgacugggauuacgucguuaccacagacaucagcgagaugggggcuaauuuccgggccgauagagugauugacccccgccggugccugaaaccggugauccugaaggauggcccugaaagagucauucucgccggacccaugcccgugaccguugcuuccgccgcgcagcgccggggcagaaucgggcgcaaccaaaauaaagagggagaccaguacguguauaugggccagccucugaacaaugaugaagaccacgcucauuggacagaggccaagaugcuucuggauaacaucaauacccccgaggggauuaucccugcccucuuugaaccggagcgggaaaagucugcugccauugacggagaguacagacugcgcggcgaagcgagaaaaacguucgucgagcugaugcggcgcggggaucuccccguguggcuuagcuauaagguugccuccgagggcuuucaguacagcgacagacgguggugcuucgauggagaacgcaacaaucaagugcuggaggaaaacauggacgucgagaucuggacaaaagaaggcgagagaaagaaacugcggccuagauggcucgacgcucgcaccuauucugauccccuggcccuucgggaguuuaaggaauucgcugccgggagacgcuccgugagcggagaccugauucucgagaucggcaaacugccucagcaccugacccuccgggcucagaaugcccuugauaaccuggucaugcugcacaauuccgaacaggggggaaaggcguacagacaugccauggaggaacuccccgacacaaucgagacccugaugcuucuggcucucauugccgugcugacaggcggcguuacgcuguuuuuccucucugggaagggacuuggcaaaaccagcaucgggcugcugugugugacagcuuccucugcccuccuguggauggccagcguggagccgcacuggauugcugcguccaucauucuugaauuuuuccugaugguccuccugaucccugagcccgaucggcaacgcaccccucaggacaaccagcuggccuauguugugaucggacuccuuuuuaugauucugacaguggcugccaacgaaaugggccugcucgagaccacgaagaaagaucuggggaucggacaugucgccgcugagaaucaccaacacgccaccaugcuugacguggaucugagacccgcgagcgccuggacacucuacgcuguugccaccacagugauuaccccuaugaugcggcauacgaucgaaaacacaaccgcuaauauuucucugacagccaucgcgaaccaggccgcuauucugaugggccucgacaagggcuggcccaucuccaaaauggauaucggggucccgcuucuggcccugggaugcuacagccaggugaauccucucacccugaccgcugccguccuuaugcugguggcucacuaugccauuaucggccccgggcuccaggcgaaggccacacgcgaggcucaaaagagaacggccgcuggaauuaugaaaaaccccaccguugacggcaucguggccauugaucuggacccugucguguacgacacaaaguucgaaaaacagcuggggcagaucaugcuccuuauccuguguaccucucagauucugcucaugcggacaaccugggcccugugcgaguccaucacgcuugcgacaggaccgcugaccacccucugggaaggcagccccggcaaguuuuggaauacaaccauugcuguuucuauggccaacaucuuccgcgggagcuaucuggcuggagccggccuggccuucucccucaugaaaucucuugggggaggcagacgggggacaggagcucaaggcgagacgcugggcgagaaguggaagcgccagcugaaucagcucagcaaauccgaauuuaacauuuacaagagaagcgggaucauggagguggaucgguccgaagccaaagagggacugaagagaggcgaaaccacaaaacaugcggucucucgcgggaccgccaagcuucggugguucguggagagaaaucuggugaagccugagggaaaaguuaucgaccucggcugugggcgcggaggcuggagcuauuacugcgcuggccugaagaaagucacagaagugaagggguauaccaaaggaggccccgggcacgaggaaccuauucccauggccacguacggauggaaccuggugaagcuccauuccggcaaagaugucuuuuucaugccuccggagaagugugacacccuucugugcgauaucggggaaucuagccccaauccuacaauugaggagggacggacccugagaguucucaagaugguggaacccuggcugcgcggcaaccaguuuuguaucaaaauucuuaauccuuacaugcccuccguggucgagacacuggaacaaaugcagcggaaguauggcgggaugcucgugagaaacccgcugucucgcaauagcacccacgagauguacuggguuuccugcggaacaggcaacaucgugagcgcugucaacaugaccucucggaugcugcucaauagauucacgauggcccaccgcaaaccuacauaugagcgggacguggaucugggggcgggaaccagacauguugccguggaacccgaggucgcuaaccuugacauuaucggccagcgcaucgaaaauauuaagaacgagcacaaauccaccuggcauuacgaugaagacaaucccuauaagacaugggccuaccacgggagcuaugaggugaagccuucuggauccgcuagcucuauggugaacggcgucguuagacugcucacgaaacccugggaugugaucccuauggugacccaaauugccaugacagacaccacaccguuuggccagcagcgggucuucaaggagaaaguggacacccgcacacccagagcuaagcgggggaccacgcagaucauggaaguuaccgccaaauggcuguggggauuucuuuccagaaauaagaagccucggauuuguacacgcgaggaauucaccagaaaagugcggagcaacgcggccaucggcgcugucuuuguggaugagaaucaauggaacuccgccaaggaagcuguugaggacgagcgcuucugggaucuggugcacagagaacgggagcuccauaaacaggggaagugcgccacaugcgucuacaauaugaugggaaaacgcgaaaagaagcugggcgaguuugggaaagccaagggcagcagagcgaucugguacauguggcugggagcucgguuccucgaauucgaggcccugggcuuuaugaacgaggaccacugguucucucgcgaaaauagccuuuccgggguggagggagaaggccugcauaaacucggguauauucugagagauaucucuaagauucccggaggcaacauguacgccgacgauaccgcugggugggacacgcggaucacagaggaugaccuucagaaugaggccaaaauuaccgauaucauggaaccugagcacgcucugcucgccacaagcaucuuuaagcugaccuaucagaacaaaguugugcgcguccaaagacccgcgaagaacggcacggugauggacgucauuucccggcgcgaucagagaggaucuggccagguggggaccuacggacugaauacauucaccaacauggaaguucagcucauccggcaaauggagagcgaaggcauuuuucugccguccgagcuugagacaccuaaucuggccgggagagugcucgacuggcuggaaaagcauggagcugagcgccuuaaacggauggccaucucuggcgacgauugugucgugaagcccauugacgauagauucgcuaccgcccugacagcgcucaacgacauggggaaagugcgcaaggauaucccucagugggaacccagcaaaggcuggaaugacuggcagcagguuccuuuuugcucccaccacuuccaucaacugaucaugaaggauggacgggagauugugguccccuguagaaaccaggacgaacuggugggccgcgcccggguuagccagggggcuggauggucucucagagagaccgccugccugggcaaguccuaugcucaaauguggcagcuuauguacuuucaccgccgggaucugagacucgccgcuaaugccaucuguagcgcggugccggucgacugggugccuacgucucgcacaaccugguccauucaugcccaccaccaguggaugaccacagaggauaugcugagcgucuggaaccggguguggaucgaagagaaucccuggauggaagacaaaacccauguuuccucuugggaggaagugcccuaucuugggaagagagaggaccaguggugcggaagccugauuggccucacagcucgggccacgugggccaccaacauccaagucgcuauuaaucaggugagacgccugaucgggaacgagaauuaccuggauuacaugacauccaugaaacgguucaagaacgaaagcgacccugagggcgcccucugguga

SEQ ID NO: 18668 - RNA, 9879 nt, Artificial Sequence
  derived and/or modified CDS sequence (opt5) from DENV-1__FJ810419__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauugugucucuguucccucucugucuguccacaacgagccagaaaaccacauggcuuccgguccugcuggggucuuuuggaugcaagccccucaccauguuccugaucacagaaaauaagauuuggggccggaaauccuggccucuuaacgagggcaucauggccauugggaucguuagcauccugcucucuucccugcucaagaaugacgugccccuggcgggaccucuuauugccggcgggaugcugaucgcuuguuaugugauuagcggauccagcgccgaucugucucucgagaaagcugccgaagucagcugggagcaagaagccgagcauuccggcaccucucacaacauccugguggaaguucaggacgaugggacgaugaagauuaaagacgaggagcgcgaugacacccuuacaauccugcucaaggcuacccugcucgcggugagcggagucuaccccauguccaucccugccacacuguuugugugguauuucuggcagaaaaagaagcagagaucuggcguucuuugggauacccccagcccgccugaaguggagcgggcuguccuggacgauggcauuuaccgcauccugcaaagagggcuccugggacggucccaggugggcgucgggguguuccaggacggaguuuuucauacaauguggcacgugacgcgcggcgccguccuuauguaucaggggaaaagacuggaacccucuugggccagcgugaagaaagaccucauuuccuacggaggcggcuggcgguuccaagggagcuggaauaccggagaggagguucaggugaucgcugucgaaccuggcaagaaccccaaaaaugugcagacaaccccggggaccuuuaagacaucugagggagaagugggcgccauugcgcuggauuucaagccugggacguccggaagccccaucguuaacagagagggcaaaauugucggccucuacgggaauggaguggugaccacaucuggcaccuaugucuccgcuaucgcccaagccaaggcuagccaggaagggccucugcccgagaucgaggacgaaguguuuaaaaagcgcaaccuuacaauuauggaucugcaccccggauccggcaaaacccggagauaccugccugccaucguucgcgaggcgauuaagcggaagcucagaacgcugauccuugcuccgacacgcguggucgccucugaaauggccgaggcucugaaagggaugcccauucgguaucagaccaccgccgugaagagcgaacauacaggcagagagaucguugaccucaugugccacgcuaccuucacaaugcgccugcuguccccugugcggguccccaauuacaacaugaucauuauggaugaggcccauuuuaccgacccugcgagcaucgccgcuagaggauauauuucuacgcgggugggcaugggggaagccgcugccaucuucaugacagccacccccccuggauccguugaggcuuuuccgcagagcaaugcggugauucaagaugaagagcgcgacauccccgaaagaucuuggaacagcggcuacgauuggaucacagacuucccugggaaaaccgucugguuugugcccuccauuaagucuggaaaugauaucgccaacugucuccggaaaaacggcaagcgcgugauucagcuuagcagaaagacguucgacaccgaguaucagaaaacaaagaauaacgacugggauuacgucguuaccacagacaucuccgagaugggggcuaauuuccgggccgauagagugauugacccucgccggugccugaaacccgugauccugaaggauggcccggaaagagucauucucgccggaccuaugcccgugaccguugcuucugccgcgcagcgccggggcagaaucgggcgcaaccaaaauaaagagggagaccaguacguguauaugggccagccccugaacaaugaugaagaccacgcucauuggacagaggccaagaugcuucuggauaacaucaauaccccugaggggauuauccccgcccucuuugaaccugagcgggaaaagagcgcugccauugacggagaguacagacugcgcggcgaagcgagaaaaacguucgucgagcugaugcggcgcggggaucucccgguguggcuuuccuauaagguugccagcgagggcuuucaguacucugacagacgguggugcuucgauggagaacgcaacaaucaagugcuggaggaaaacauggacgucgagaucuggacaaaagaaggcgagagaaagaaacugcggcccagauggcucgacgcucgcaccuauuccgauccucuggcccuucgggaguuuaaggaauucgcugccgggagacgcagcguguccggagaccugauucucgagaucggcaaacugccccagcaccugacccuccgggcucagaaugcccuugauaaccuggucaugcugcacaauucugaacaggggggaaaggcguacagacaugccauggaggaacucccugacacaaucgagacccugaugcuucuggcucucauugccgugcugacaggcggcguuacgcuguuuuuccucagcgggaagggacuuggcaaaaccuccaucgggcugcugugugugacagcuucuagcgcccuccuguggauggccuccguggagccccacuggauugcugcgagcaucauucuugaauuuuuccugaugguccuccugaucccggagccugaucggcaacgcaccccccaggacaaccagcuggccuauguugugaucggacuccuuuuuaugauucugacaguggcugccaacgaaaugggccugcucgagaccacgaagaaagaucuggggaucggacaugucgccgcugagaaucaccaacacgccaccaugcuugacguggaucugagaccugcgucugccuggacacucuacgcuguugccaccacagugauuacccccaugaugcggcauacgaucgaaaacacaaccgcuaauauuucccugacagccaucgcgaaccaggccgcuauucugaugggccucgacaagggcuggccuaucagcaaaauggauaucggggucccccuucuggcccugggaugcuacucucaggugaauccgcucacccugaccgcugccguccuuaugcugguggcucacuaugccauuaucggcccugggcuccaggcgaaggccacacgcgaggcucaaaagagaacggccgcuggaauuaugaaaaaccccaccguugacggcaucguggccauugaucuggaccccgucguguacgacgccaaguucgaaaaacagcuggggcagaucaugcuccuuauccuguguacaucccagauucugcucaugcggaccacaugggcgcugugcgagagcaucacccuugcuacgggaccucugacaacccucugggaaggcucuccgggcaaguuuuggaauaccacaauugccguuagcauggcuaacaucuuccgcggguccuaucuggccggagccggccuggcuuucucucucaugaaaagccuugggggaggcagacgggggaccggagcccaaggcgagacacugggcgagaaguggaagcgccagcugaaucagcucuccaaaagcgaauuuaacacguacaagagauccgggauuauggagguggaucggucugaagcgaaagagggacugaagagaggcgaaaccacaaaacaugccgucagccgcgggaccgcuaagcuucggugguucguggagagaaaucuggugaagcccgagggaaaaguuaucgaccucggcugugggcgcggaggcugguccuauuacugcgccggccugaagaaagucacagaagugaagggguauaccaaaggaggcccugggcacgaggaacccaucccuauggcuacguacggauggaaccuggugaagcucuacucuggcaaagaugucuuuuucaugcccccugagaagugugacacccuucugugcgauauuggggaaagcuccccgaaucccacaaucgaggagggacggacccugagaguucucaagaugguggaaccuuggcugcgcggcaaccaguuuuguauuaaaauccuuaaucccuauaugccuucuguggucgagacacuggaacaaaugcagcggaagcauggcgggaugcucgugagaaacccccugagccgcaauuccacccacgagauguacuggguuagcugcggaacaggcaacauugugucugccgucaacaugaccucccggaugcugcucaauagauucacgauggcgcaccgcaaaccgacauaugagcgggacguggaucugggggccggaaccagacauguugcuguggaaccugaggucgccaaccuugacaucauuggccagcgcaucgaaaauaucaagaacgagcacaaaagcaccuggcauuacgaugaagacaaucccuauaagacaugggcuuaccacgggucuuaugaggugaagcccuccggaagcgccucuuccauggugaacggcgucguuagacugcucacgaaaccuugggaugugauucccauggugacccaaaucgcuaugacagacaccacaccuuuuggccagcagcgggucuucaaggagaaaguggacacccgcacaccgagagccaagcgggggaccacgcagauuauggaaguuaccgcgaaauggcuguggggauuucuuagcagaaauaagaagccccggaucuguacacgcgaggaauucaccagaaaagugcgguccaacgccgcuauuggcgccgucuuuguggaugagaaucaauggaacagcgcuaaggaagccguugaggacgagcgcuucugggaucuggugcacagagaacgggagcuccauaaacaggggaagugcgccacaugcgucuacaauaugaugggaaaacgcgaaaagaagcugggcgaguuugggaaagcgaagggcucuagagcuaucugguacauguggcugggagcccgguuccucgaauucgaggcccugggcuuuaugaacgaggaccacugguucagccgcgaaaauucccuuucugggguggagggagaaggccugcauaaacucggguauauccugagagauauuagcaagaucccuggaggcaacauguacgcugacgauaccgccgggugggacacgcggauuacagaggaugaccuucagaaugaggcuaaaaucaccgauauuauggaacccgagcacgcccugcucgcgacauccaucuuuaagcugaccuaucagaacaaaguugugcgcguccaaagaccugccaagaacggcacggugauggacgucaucucucggcgcgaucagagaggaagcggccagguggggaccuacggacugaauacauucaccaacauggaaguucagcucauucggcaaauggaguccgaaggcaucuuucugcccucugagcuugagacaccgaaucuggcugaaagagugcucgacuggcuggagaagcauggggccgaacgccuuaaacggauggcuauuagcggagacgauugugucgugaagccuaucgacgauagauucgccaccgcgcugacagcccucaacgacaugggcaaagugcgcaaggauauuccccagugggagccuuccaaaggguggaaugacuggcagcagguucccuuuugcagccaccacuuccaucaacugaucaugaaggauggccgggaaaucguggucccuuguagaaaccaggacgagcuggugggacgcgcucggguuucucagggcgccggguggucccucagagagaccgcuugccugggaaagagcuaugcccaaauguggcagcuuauguacuuucaccgccgggaucugagacucgcugccaaugcgauuuguucugccgugcccgucgacugggugccgacgucccgcacaaccuggagcauccaugcucaccaccaguggaugaccacagaagauaugcuguccgucuggaaccggguguggauugaggaaaauccuuggauggaggacaaaacccauguuucuagcugggaagaggugcccuaucuuggcaagagagaggaccaguggugcgggucccugaucggacucacagcccgggccacgugggcuaccaacauucaagucgccaucaaucaggugagacgccugauuggcaacgaaaauuaccuggauuacaugacaagcaugaaacgguucaagaacgagucugaccccgaaggggcgcucugguga

SEQ ID NO: 18669 - RNA, 9879 nt, Artificial Sequence
  derived and/or modified CDS sequence (opt5) from DENV-1__FJ547068__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggccgccuccgucgaacuucccaacucucuggaggaacucggggacggacuggcuaugggcaucaugaugcucaagcugcuuacagaguuccagccccaccagcuguggaccacgcuccugagccugacauuuaucaaaaccacccuuucccuggauuacgccuggaagacaaccgcuauggcccucagcauugugucucuguucccucucugucuguccacaacgagccagaaaaccacauggcuuccggugcugcuggggucuuuuggaugcaagccccucaccauguuccugaucacagaaaauaagauuuggggccggaaauccuggccucuuaacgagggcaucauggcgauugggaucgucagcauccugcucucuucccugcucaagaaugacguuccccuggccggaccucuuauugcuggcgggaugcugaucgccuguuaugugauuagcggauccagcgcugaucugucucucgagaaagccgccgaagugagcugggagcaagaagcugagcauuccggcaccucucacaacauccuggucgaagugcaggacgaugggacgaugaagauuaaagacgaggagcgcgaugacacccuuacaauccugcucaaggcgacccugcucgccguuagcggaguguaccccauguccaucccugcuacacuguuugucugguauuucuggcagaaaaagaagcagagaucuggcgugcuuugggauacccccagcccgccugaaguugagcgggccgugcuggacgauggcauuuaccgcauccugcaaagagggcuccugggacggucccaggucggcgugggggucuuccaggacggaguguuucauacaauguggcacguuacgcgcggcgccgugcuuauguaucaggggaaaagacuggaacccucuugggcuagcgucaagaaagaccucauuuccuacggaggcggcuggcgguuccaagggagcuggaauaccggagaggaggugcagguuaucgccguggaaccuggcaagaaccccaaaaauguccagacaaccccggggaccuuuaagacaccugagggagaagugggcgcgauugcucuggauuucaagcccgggacgucuggauccccuaucgugaacagagagggcaaaauuguuggccucuacgggaauggagucgugaccacaagcggcaccuaugugucugccaucgcccaagcuaaggccucccaggaagggccccugcccgagaucgaggacgaagucuuuaaaaagcgcaaccuuacaauuauggaucugcacccuggaagcggcaaaacccggagauaccugccggcgaucgugcgcgaggcuauuaagcggaagcucagaacgcugauccuugcccccacacgcguuguggccuccgaaauggcugaggcccugaaagggaugccuauucgguaucagaccaccgcugucaagucugaacauacaggcagagagaucguggaccucaugugccacgccaccuucacaaugcgccugcugagccccguucgggugccuaauuacaacaugaucauuauggaugaggcgcauuuuaccgaccccgccuccaucgcugccagaggauauauuagcacgcgggucggcaugggggaagcugccgccaucuucaugacagcuaccccuccgggaucuguggaggcguuuccccaguccaaugccguuauucaagaugaagagcgcgacaucccugaaagaagcuggaacucuggcuacgauuggaucacagacuuccccgggaaaaccgugugguuugucccuagcauuaaguccggaaaugauaucgcuaacugucuccggaaaaacggcaagcgcgugauucagcuuucuagaaagacguucgacaccgaguaucagaaaacaaagaauaacgacugggauuacguggucaccacagacaucagcgagaugggggccaauuuccgggccgauagaguuauugacccccgccggugccugaaaccggugauccugaaggauggcccugaaagagugauucucgcuggacccaugcccgucaccguggccuccgcggcucagcgccggggcagaaucgggcgcaaccaaaauaaagagggagaccaguacguuuauaugggccagccucugaacaaugaugaagaccacgcccauuggacagaggccaagaugcuucuggauaacaucaauacccccgaggggauuaucccugcucucuuugaaccggagcgggaaaagucugccgcgauugacggagaguacagacugcgcggcgaagccagaaaaacguucguggagcugaugcggcgcggggaucuccccgucuggcuuagcuauaagguggcuuccgagggcuuucaguacagcgacagacgguggugcuucgauggagaacgcaacaaucaaguucuggaggaaaacauggacguggagaucuggacaaaagaaggcgagagaaagaaacugcggccuagauggcucgacgcccgcaccuauucugauccccuggcucuucgggaguuuaaggaauucgccgcugggagacgcuccgucagcggagaccugauucucgagaucggcaaacugccucagcaccugacccuccgggcccagaaugcgcuugauaaccuggugaugcugcacaauuccgaacaggggggaaaggccuacagacaugcuauggaggaacuccccgacacaaucgagacccugaugcuucuggcccucauugcuguccugacaggcggcgugacgcuguuuuuccucucugggaagggacuuggcaaaaccagcaucgggcugcuguguguuacagccuccucugcccuccuguggauggcuagcguggagccgcacuggauugcggccuccaucauucuugaauuuuuccugauggugcuccugaucccugagcccgaucggcaacgcaccccucaggacaaccagcuggcuuaugucguuaucggacuccuuuuuaugauucugacaguggccgccaacgaaaugggccugcucgagaccacgaagaaagaucuggggaucggacauguggcugccgagaaucaccaacacgcgaccaugcuugacgucgaucugagacccgccagcgcuuggacacucuacgccguggcuaccacaguuauuaccccuaugaugcggcauacgaucgaaaacacaaccgccaauauuucucugacagcgaucgccaaccaggcugccauucugaugggccucgacaagggcuggcccaucuccaaaauggauaucggggugccgcuucuggcucugggaugcuacagccaggucaauccucucacccugaccgccgcugugcuuaugcuggucgcccacuaugcgauuaucggccccgggcuccaggccaaggcuacacgcgaggcccaaaagagaacggcugccggaauuaugaaaaaccccaccguggacggcaucguugccauugaucuggacccuguggucuacgacgcgaaguucgaaaaacagcuggggcagaucaugcuccuuauccuguguacaucucagauucugcucaugcggaccacaugggcucugugcgaguccaucacccuugccacgggaccgcugacaacccucugggaaggcagccccggcaaguuuuggaauaccacaauugcugugucuauggccaacaucuuccgcgggagcuaucuggccggagcuggccuggccuucucccucaugaaaucucuugggggaggcagacgggggaccggagcgcaaggcgagacacugggcgagaaguggaagcgccagcugaaucagcucagcaaauccgaauuuaacacguacaagagaagcgggauuauggagguugaucgguccgaagccaaagagggacugaagagaggcgaaaccacaaaacaugcugugucucgcgggaccgccaagcuucggugguucgucgagagaaaucuggugaagccugagggaaaagugaucgaccucggcugugggcgcggaggcuggagcuauuacugcgcuggccugaagaaaguuacagaagucaagggguauaccaaaggaggccccgggcacgaggaaccuauccccauggccacguacggauggaaccuggugaagcuccauuccggcaaagauguguuuuucaugccuccggagaagugugacacccuucugugcgauauuggggaaucuagccccaauccuacaaucgaggagggacggacccugagaguccucaagaugguugaacccuggcugcgcggcaaccaguuuuguauuaaaauccuuaauccuuacaugcccuccgugguggagacacuggaacaaaugcagcggaagcacggcgggaugcucgucagaaacccgcugucucgcaauagcacccacgagauguauuggguguccugcggaacaggcaacauuguuagcgcggugaacaugaccucucggaugcugcucaauagauucacgauggcccaucgcaaaccuacauacgagcgggacgucgaucugggggcuggaaccagacacguggccguugaacccgagguggcuaaccuugacaucauuggccagcgcaucgaaaauaucaagaacgagcauaaauccaccuggcacuaugaugaagacaaucccuacaagacaugggccuaucacgggagcuacgaggucaagccuucuggauccgcuagcucuauggugaacggcguggucagacugcucacgaaacccugggauguuauuccuauggugacccaaaucgccaugacagacaccacaccguuuggccagcagcggguguucaaggagaaagucgacacccgcacacccagagcgaagcgggggaccacgcagauuauggaagugaccgccaaauggcuguggggauuucuuuccagaaauaagaagccucggaucuguacacgcgaggaauucaccagaaaaguucggagcaacgcugccauuggcgcuguguuugucgaugagaaucaauggaacuccgccaaggaagccguggaggacgagcgcuucugggaucugguucauagagaacgggagcuccacaaacaggggaagugcgcgacaugcguguauaauaugaugggaaaacgcgaaaagaagcugggcgaguuugggaaagcuaagggcagcagagccaucugguacauguggcugggagcccgguuccucgaauucgaggcucugggcuuuaugaacgaggaccauugguucucucgcgaaaauagccuuuccggggucgagggagaaggccugcacaaacucggguacauccugagagauauuucuaagauccccggaggcaacauguaugccgacgauaccgcugggugggacacgcggauuacagaggaugaccuucagaaugaggccaaaaucaccgauauuauggaaccugagcaugcgcugcucgccacaagcaucuuuaagcugaccuaccagaacaaagugguucgcgugcaaagacccgcuaagaacggcacggucauggacgugaucucccggcgcgaucagagaggaucuggccaggucgggaccuauggacugaauacauucaccaacauggaagugcagcucauucggcaaauggagagcgaaggcaucuuucugccguccgagcuugagacaccuaaucuggccgaaagaguucucgacuggcuggagaagcacggggcugaacgccuuaaacggauggccauuucuggagacgauuguguggucaagcccaucgacgauagauucgcgaccgcccugacagcucucaacgacaugggcaaagugcgcaaggauauuccucagugggagcccagcaaaggguggaaugacuggcagcaggugccuuuuugcucccaccauuuccaccaacugaucaugaaggauggccgggaaaucguugugcccuguagaaaccaggacgagcuggucggacgcgcccgggugagccagggcgcuggguggucucucagagagaccgccugccugggaaaguccuacgcucaaauguggcagcuuauguauuuucaucgccgggaucugagacucgccgcgaaugccauuuguagcgcuguuccgguggacugggucccuacgucucgcacaaccugguccauccacgcccaccaucaguggaugaccacagaagauaugcugagcguguggaaccgggucuggauugaggaaaaucccuggauggaggacaaaacccacguguccucuugggaagagguucccuaccuuggcaagagagaggaccaguggugcgggagccugaucggacucacagcccgggcuacgugggccaccaacauucaaguggcgaucaaucaggucagacgccugauuggcaacgaaaauuaucuggauuacaugacauccaugaaacgguucaagaacgagagcgacccugaaggggcucucugguga

SEQ ID NO: 18670 - RNA, 9879 nt, Artificial Sequence
  derived and/or modified CDS sequence (opt5) from DENV-1__FJ562104__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauugugucucuguucccucucugucuguccacaacgagccagaaaaccacauggcuuccgguccugcuggggucuuuuggaugcaagccccucaccauguuccugaucacagaaaauaagauuuggggccggaaauccuggccucuuaacgagggcaucauggccauugggaucguuagcauccugcucucuucccugcucaagaaugacgugccccuggcgggaccucuuauugccggcgggaugcugaucgcuuguuaugugauuagcggauccagcgccgaucugucucucgagaaagcugccgaagucagcugggagcaagaagccgagcauuccggcaccucucacaacauccugguggaaguucaggacgaugggacgaugaagauuaaagacgaggagcgcgaugacacccuuacaauccugcucaaggcuacccugcucgcggugagcggagucuaccccauguccaucccugccacacuguuugugugguauuucuggcagaaaaagaagcagagaucuggcguucuuugggauacccccagcccgccugaaguggagcgggcuguccuggacgauggcauuuaccgcauccugcaaagagggcuccugggacggucccaggugggcgucgggguguuccaggacggaguuuuucauacaauguggcacgugacgcgcggcgccguccuuauguaucaggggaaaagacuggaacccucuugggccagcgugaagaaagaccucauuuccuacggaggcggcuggcgguuccaagggagcuggaauaccggagaggagguucaggugaucgcugucgaaccuggcaagaaccccaaaaaugugcagacaaccccggggaccuuuaagacaccugagggagaagugggcgccauugcgcuggauuucaagcccgggacgucuggauccccuaucguuaacagagagggcaaaauugucggccucuacgggaauggaguggugaccacaagcggcaccuaugucucugcuaucgcccaagccaaggcuucccaggaagggccccugcccgagaucgaggacgaaguguuuaaaaagcgcaaccuuacaauuauggaucugcacccuggaagcggcaaaacccggagauaccugccggccaucguucgcgaggcgauuaagcggaagcucagaacgcugauccuugcucccacacgcguggucgccuccgaaauggccgaggcucugaaagggaugccuauucgguaucagaccaccgccgugaagucugaacauacaggcagagagaucguugaccucaugugccacgcuaccuucacaaugcgccugcugagccccgugcgggucccuaauuacaacaugaucauuauggaugaggcccauuuuaccgaccccgcguccaucgccgcuagaggauauauuagcacgcgggugggcaugggggaagccgcugccaucuucaugacagccaccccuccgggaucuguugaggcuuuuccccaguccaaugcggugauucaagaugaagagcgcgacaucccugaaagaagcuggaacucuggcuacgauuggaucacagacuuccccgggaaaaccgucugguuugugccuagcauuaaguccggaaaugauaucgccaacugucuccggaaaaacggcaagcgcgugauucagcuuucuagaaagacguucgacaccgaguaucagaaaacaaagaauaacgacugggauuacgucguuaccacagacaucagcgagaugggggcuaauuuccgggccgauagagugauugacccccgccggugccugaaaccggugauccugaaggauggcccugaaagagucauucucgccggacccaugcccgugaccguugcuuccgccgcgcagcgccggggcagaaucgggcgcaaccaaaauaaagagggagaccaguacguguauaugggccagccucugaacaaugaugaagaccacgcucauuggacagaggccaagaugcuucuggauaacaucaauacccccgaggggauuaucccugcccucuuugaaccggagcgggaaaagucugcugccauugacggagaguacagacugcgcggcgaagcgagaaaaacguucgucgagcugaugcggcgcggggaucuccccguguggcuuagcuauaagguugccuccgagggcuuucaguacagcgacagacgguggugcuucgauggagaacgcaacaaucaagugcuggaggaaaacauggacgucgagaucuggacaaaagaaggcgagagaaagaaacugcggccuagauggcucgacgcucgcaccuauucugauccccuggcccuucgggaguuuaaggaauucgcugccgggagacgcuccgugagcggagaccugauucucgagaucggcaaacugccucagcaccugacccuccgggcucagaaugcccuugauaaccuggucaugcugcacaauuccgaacaggggggaaaggcguacagacaugccauggaggaacuccccgacacaaucgagacccugaugcuucuggcucucauugccgugcugacaggcggcguuacgcuguuuuuccucucugggaagggacuuggcaaaaccagcaucgggcugcugugugugacagcuuccucugcccuccuguggauggccagcguggagccgcacuggauugcugcguccaucauucuugaauuuuuccugaugguccuccugaucccugagcccgaucggcaacgcaccccucaggacaaccagcuggccuauguugugaucggacuccuuuuuaugauucugacaguggcugccaacgaaaugggccugcucgagaccacgaagaaagaucuggggaucggacaugucgccgcugagaaucaccaacacgccaccaugcuugacguggaucugagacccgcgagcgccuggacacucuacgcuguugccaccacagugauuaccccuaugaugcggcauacgaucgaaaacacaaccgcuaauauuucucugacagccaucgcgaaccaggccgcuauucugaugggccucgacaagggcuggcccaucuccaaaauggauaucggggucccgcuucuggcccugggaugcuacagccaggugaauccucucacccugaccgcugccguccuuaugcugguggcucacuaugccauuaucggccccgggcuccaggcgaaggccacacgcgaggcucaaaagagaacggccgcuggaauuaugaaaaaccccaccguugacggcaucguggccauugaucuggacccugucguguacgacacaaaguucgaaaaacagcuggggcagaucaugcuccuuauccuguguaccucucagauucugcucaugcggacaaccugggcccugugcgaguccaucacgcuugcgacaggaccgcugaccacccucugggaaggcagccccggcaaguuuuggaauacaaccauugcuguuucuauggccaacaucuuccgcgggagcuaucuggcuggagccggccuggccuucucccucaugaaaucucuugggggaggcagacgggggacaggagcucaaggcgagacgcugggcgagaaguggaagcgccagcugaaucagcucagcaaauccgaauuuaacauuuacaagagaagcgggaucauggagguggaucgguccgaagccaaagagggacugaagagaggcgaaaccacaaaacaugcggucucucgcgggaccgccaagcuucggugguucguggagagaaaucuggugaagccugagggaaaaguuaucgaccucggcugugggcgcggaggcuggagcuauuacugcgcuggccugaagaaagucacagaagugaagggguauaccaaaggaggccccgggcacgaggaaccuauucccauggccacguacggauggaaccuggugaagcuccauuccggcaaagaugucuuuuucaugccuccggagaagugugacacccuucugugcgauaucggggaaucuagccccaauccuacaauugaggagggacggacccugagaguucucaagaugguggaacccuggcugcgcggcaaccaguuuuguaucaaaauucuuaauccuuacaugcccuccguggucgagacacuggaacaaaugcagcggaaguauggcgggaugcucgugagaaacccgcugucucgcaauagcacccacgagauguacuggguuuccugcggaacaggcaacaucgugagcgcugucaacaugaccucucggaugcugcucaauagauucacgauggcccaccgcaaaccuacauaugagcgggacguggaucugggggcgggaaccagacauguugccguggaacccgaggucgcuaaccuugacauuaucggccagcgcaucgaaaauauuaagaacgagcacaaauccaccuggcauuacgaugaagacaaucccuauaagacaugggccuaccacgggagcuaugaggugaagccuucuggauccgcuagcucuauggugaacggcgucguuagacugcucacgaaacccugggaugugaucccuauggugacccaaauugccaugacagacaccacaccguuuggccagcagcgggucuucaaggagaaaguggacacccgcacacccagagcuaagcgggggaccacgcagaucauggaaguuaccgccaaauggcuguggggauuucuuuccagaaauaagaagccucggauuuguacacgcgaggaauucaccagaaaagugcggagcaacgcggccaucggcgcugucuuuguggaugagaaucaauggaacuccgccaaggaagcuguugaggacgagcgcuucugggaucuggugcacagagaacgggagcuccauaaacaggggaagugcgccacaugcgucuacaauaugaugggaaaacgcgaaaagaagcugggcgaguuugggaaagccaagggcagcagagcgaucugguacauguggcugggagcucgguuccucgaauucgaggcccugggcuuuaugaacgaggaccacugguucucucgcgaaaauagccuuuccgggguggagggagaaggccugcauaaacucggguauauucugagagauaucucuaagauucccggaggcaacauguacgccgacgauaccgcugggugggacacgcggaucacagaggaugaccuucagaaugaggccaaaauuaccgauaucauggaaccugagcacgcucugcucgccacaagcaucuuuaagcugaccuaucagaacaaaguugugcgcguccaaagacccgcgaagaacggcacggugauggacgucauuucccggcgcgaucagagaggaucuggccagguggggaccuacggacugaauacauucaccaacauggaaguucagcucauccggcaaauggagagcgaaggcauuuuucugccguccgagcuugagacaccuaaucuggccgaaagagugcucgacuggcuggagaagcauggggcugaacgccuuaaacggauggccaucucuggagacgauugugucgugaagcccauugacgauagauucgcuaccgcccugacagcgcucaacgacaugggcaaagugcgcaaggauaucccucagugggagcccagcaaaggguggaaugacuggcagcagguuccuuuuugcucccaccacuuccaucaacugaucaugaaggauggccgggaaauugugguccccuguagaaaccaggacgagcuggugggacgcgcccggguuagccagggcgcuggguggucucucagagagaccgccugccugggaaaguccuaugcucaaauguggcagcuuauguacuuucaccgccgggaucugagacucgccgcuaaugccaucuguagcgcggugccggucgacugggugccuacgucucgcacaaccugguccauucaugcccaccaccaguggaugaccacagaagauaugcugagcgucuggaaccggguguggaucgaggaaaaucccuggauggaggacaaaacccauguuuccucuugggaagaggugcccuaucuuggcaagagagaggaccaguggugcgggagccugauuggacucacagcucgggccacgugggccaccaacauccaagucgcuauuaaucaggugagacgccugaucggcaacgaaaauuaccuggauuacaugacauccaugaaacgguucaagaacgagagcgacccugaaggggcccucugguga

SEQ ID NO: 18671 - RNA, 9879 nt, Artificial Sequence
  derived and/or modified CDS sequence (opt5) from DENV-1__GQ199857__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauuaucucucuguucccucucugucuguccacaacgagccagaaaaccacauggcuuccggugcugcuggggucuuuuggaugcaagccccucaccauguuccugauuacagaaaauaagaucuggggccggaaauccuggccucuuaacgagggcauuauggccaucgggaucgucagcauucugcucucuucccugcucaagaaugacguuccccuggcgggaccucuuaucgccggcgggaugcugauugcuuguuaugugaucagcggauccagcgccgaucugucucucgagaaagcugccgaagugagcugggagcaagaagccgagcauuccggcaccucucacaacauucuggucgaagugcaggacgaugggacgaugaagaucaaagacgaggagcgcgaugacacccuuacaauccugcucaaggcuacccugcucgcgguuagcggaguguaccccauguccauuccugccacacuguuugucugguauuucuggcagaaaaagaagcagagaucuggcgugcuuugggauacccccagcccgccugaaguugagcgggcugugcuggacgauggcaucuaccgcauucugcaaagagggcuccugggacggucccaggucggcgugggggucuuccaggacggaguguuucauacaauguggcacguuacgcgcggcgccgugcuuauguaucaggggaaaagacuggaacccucuugggccagcgucaagaaagaccucaucuccuacggaggcggcuggcgguuccaagggagcuggaauaccggagaggaggugcagguuauugcuguggaaccuggcaagaaccccaaaaauguccagacaaccccggggaccuuuaagacaccugagggagaagugggcgccaucgcgcuggauuucaagcccgggacgucuggauccccuauugugaacagagagggcaaaaucguuggccucuacgggaauggagucgugaccacaagcggcaccuaugugucugcuaucgcccaagccaaggcuucccaggaagggccccugcccgagauugaggacgaagucuuuaaaaagcgcaaccuuacaaucauggaucugcacccuggaagcggcaaaacccggagauaccugccggccauugugcgcgaggcgaucaagcggaagcucagaacgcugauucuugcucccacacgcguuguggccuccgaaauggccgaggcucugaaagggaugccuauccgguaucagaccaccgccgucaagucugaacauacaggcagagagaucguggaccucaugugccacgcuaccuucacaaugcgccugcugagccccguucgggugccuaauuacaacaugauuaucauggaugaggcccauuuuaccgaccccgcguccauugccgcuagaggauauaucagcacgcgggucggcaugggggaagccgcugccauuuucaugacagccaccccuccgggaucuguggaggcuuuuccccaguccaaugcgguuauccaagaugaagagcgcgacaucccugaaagaagcuggaacucuggcuacgauuggauuacagacuuccccgggaaaaccgugugguuugucccuagcaucaaguccggaaaugauauugccaacugucuccggaaaaacggcaagcgcgugauccagcuuucuagaaagacguucgacaccgaguaucagaaaacaaagaauaacgacugggauuacguggucaccacagacauuagcgagaugggggcuaauuuccgggccgauagaguuaucgacccccgccggugccugaaaccggugauucugaaggauggcccugaaagagugauccucgccggacccaugcccgucaccguggcuuccgccgcgcagcgccggggcagaaucgggcgcaaccaaaauaaagagggagaccaguacguuuauaugggccagccucugaacaaugaugaagaccacgcucauuggacagaggccaagaugcuucuggauaacauuaauacccccgaggggaucauuccugcccucuuugaaccggagcgggaaaagucugcugccaucgacggagaguacagacugcgcggcgaagcgagaaaaacguucguggagcugaugcggcgcggggaucuccccgucuggcuuagcuauaagguggccuccgagggcuuucaguacagcgacagacgguggugcuucgauggagaacgcaacaaucaaguucuggaggaaaacauggacguggagauuuggacaaaagaaggcgagagaaagaaacugcggccuagauggcucgacgcucgcaccuauucugauccccuggcccuucgggaguuuaaggaauucgcugccgggagacgcuccgucagcggagaccugauccucgagaucggcaaacugccucagcaccugacccuccgggcucagaaugcccuugauaaccuggugaugcugcacaauuccgaacaggggggaaaggcguacagacaugccauggaggaacuccccgacacaauugagacccugaugcuucuggcucucaucgccguccugacaggcggcgugacgcuguuuuuccucucugggaagggacuuggcaaaaccagcauugggcugcuguguguuacagcuuccucugcccuccuguggauggccagcguggagccgcacuggaucgcugcguccauuauccuugaauuuuuccugauggugcuccugaucccugagcccgaucggcaacgcaccccucaggacaaccagcuggccuaugucguuauuggacuccuuuuuaugauccugacaguggcugccaacgaaaugggccugcucgagaccacgaagaaagaucuggggauuggacauguggccgcugagaaucaccaacacgccaccaugcuugacgucgaucugagacccgcgagcgccuggacacucuacgcuguggccaccacaguuaucaccccuaugaugcggcauacgauugaaaacacaaccgcuaauaucucucugacagccauugcgaaccaggccgcuauccugaugggccucgacaagggcuggcccaucuccaaaauggauauuggggugccgcuucuggcccugggaugcuacagccaggucaauccucucacccugaccgcugccgugcuuaugcuggucgcucacuaugccaucauuggccccgggcuccaggcgaaggccacacgcgaggcucaaaagagaacggccgcuggaaucaugaaaaaccccaccguggacggcauuguugccaucgaucuggacccuguggucuacgacacaaaguucgaaaaacagcuggggcagaucaugcuccuuauucuguguaccucucagauccugcucaugcggacaaccugggcccugugcgaguccauuacgcuugcgacaggaccgcugaccacccucugggaaggcagccccggcaaguuuuggaauacaaccaucgcugugucuauggccaacauuuuccgcgggagcuaucuggcuggagccggccuggccuucucccucaugaaaucucuugggggaggcagacgggggacaggagcucaaggcgagacgcugggcgagaaguggaagcgccagcugaaucagcucagcaaauccgaauuuaacaucuacaagagaagcgggaucauggagguugaucgguccgaagccaaagagggacugaagagaggcgaaaccacaaaacaugcggugucucgcgggaccgccaagcuucggugguucgucgagagaaaucuggugaagccugagggaaaagugauugaccucggcugugggcgcggaggcuggagcuauuacugcgcuggccugaagaaaguuacagaagucaagggguauaccaaaggaggccccgggcacgaggaaccuauccccauggccacguacggauggaaccuggugaagcuccauuccggcaaagauguguuuuucaugccuccggagaagugugacacccuucugugcgauauuggggaaucuagccccaauccuacaaucgaggagggacggacccugagaguccucaagaugguugaacccuggcugcgcggcaaccaguuuuguauuaaaauccuuaauccuuacaugcccuccgugguggagacacuggaacaaaugcagcggaaguauggcgggaugcucgucagaaacccgcugucucgcaauagcacccacgagauguacuggguguccugcggaacaggcaacauuguuagcgcugugaacaugaccucucggaugcugcucaauagauucacgauggcccaccgcaaaccuacauaugagcgggacgucgaucugggggcgggaaccagacauguggccguugaacccgagguggcuaaccuugacaucaucggccagcgcauugaaaauaucaagaacgagcacaaauccaccuggcauuacgaugaagacaaucccuauaagacaugggccuaccacgggagcuaugaggucaagccuucuggauccgcuagcucuauggugaacggcguggucagacugcucacgaaacccugggauguuauuccuauggugacccaaaucgccaugacagacaccacaccguuuggccagcagcggguguucaaggagaaagucgacacccgcacacccagagcuaagcgggggaccacgcagauuauggaagugaccgccaaauggcuguggggauuucuuuccagaaauaagaagccucggaucuguacacgcgaggaauucaccagaaaaguucggagcaacgcggccaucggcgcuguguuuauugaugagaaucaauggaacuccgccaaggaagcugucgaggacgagcgcuucugggaucuggugcacagagaacgggagcuccauaaacaggggaagugcgccacaugcguuuacaauaugaugggaaaacgcgaaaagaagcugggcgaguuugggaaagccaagggcagcagagcgaucugguacauguggcugggagcucgguuccucgaauucgaggcccugggcuuuaugaacgaggaccacugguucucucgcgaaaauagccuuuccgggguggagggagaaggccugcauaaacucggguauauucugagagauaucucuaagauucccggaggcaacauguacgccgacgauaccgcugggugggacacgcggaucacagaggaugaccuucagaaugaggccaaaaucaccgauauuauggaaccugagcacgcucugcucgccacaagcaucuuuaagcugaccuaucagaacaaagucgugcgcguucaaagacccgcgaagaacggcacggugauggacgucauuucccggcgcgaucagagaggaucuggccagguggggaccuacggacugaauacauucaccaacauggaaguccagcucauccggcaaauggagagcgaaggcauuuuucugccguccgagcuugagacaccuaaucuggccgaaagagugcucgacuggcuggagaagcauggggcugaacgccuuaaacggauggccaucucuggagacgauuguguugugaagcccaucgacgauagauucgcuaccgcccugacagcgcucaacgacaugggcaaaguccgcaaggauauuccucagugggagcccagcaaaggguggaaugacuggcagcaggugccuuuuugcucccaccacuuccaucaacugaucaugaaggauggccgggaaauugugguucccuguagaaaccaggacgagcuggugggacgcgcccgggucagccagggcgcuggguggucucucagagagaccgccugccugggaaaguccuaugcucaaauguggcagcuuauguacuuucaccgccgggaucugagacucgccgcuaaugccaucuguagcgcggugccgguugacugggugccuacgucucgcacaaccugguccauucaugcccaccaccaguggaugaccacagaagauaugcugagcgucuggaaccggguguggaucgaggaaaaucccuggauggaggacaaaacccaugucuccucuugggaagaggugcccuaucuuggcaagagagaggaccaguggugcgggagccugauuggacucacagcucgggccacgugggccaccaacauccaaguugcuaucaaucaggugagacgccugauuggcaacgaaaauuaccuggauuacaugacauccaugaaacgguucaagaacgagagcgacccugaaggggcccucugguga

SEQ ID NO: 18672 - RNA, 9879 nt, Artificial Sequence
  derived and/or modified CDS sequence (opt5) from DENV-1__GQ199858__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauuaucucucuguucccucucugucuguccacaacgagccagaaaaccacauggcuuccggugcugcuggggucuuuuggaugcaagccccucaccauguuccugauuacagaaaauaagaucuggggccggaaauccuggccucuuaacgagggcauuauggccaucgggaucgucagcauucugcucucuucccugcucaagaaugacguuccccuggcgggaccucuuaucgccggcgggaugcugauugcuuguuaugugaucagcggauccagcgccgaucugucucucgagaaagcugccgaagugagcugggagcaagaagccgagcauuccggcaccucucacaacauucuggucgaagugcaggacgaugggacgaugaagaucaaagacgaggagcgcgaugacacccuuacaauccugcucaaggcuacccugcucgcgguuagcggaguguaccccauguccauuccugccacacuguuugucugguauuucuggcagaaaaagaagcagagaucuggcgugcuuugggauacccccagcccgccugaaguugagcgggcugugcuggacgauggcaucuaccgcauucugcaaagagggcuccugggacggucccaggucggcgugggggucuuccaggacggaguguuucauacaauguggcacguuacgcgcggcgccgugcuuauguaucaggggaaaagacuggaacccucuugggccagcgucaagaaagaccucaucuccuacggaggcggcuggcgguuccaagggagcuggaauaccggagaggaggugcagguuauugcuguggaaccuggcaagaaccccaaaaauguccagacaaccccggggaccuuuaagacaccugagggagaagugggcgccaucgcgcuggauuucaagcccgggacgucuggauccccuauugugaacagagagggcaaaaucguuggccucuacgggaauggagucgugaccacaagcggcaccuaugugucugcuaucgcccaagccaaggcuucccaggaagggccccugcccgagauugaggacgaagucuuuaaaaagcgcaaccuuacaaucauggaucugcacccuggaagcggcaaaacccggagauaccugccggccauugugcgcgaggcgaucaagcggaagcucagaacgcugauucuugcucccacacgcguuguggccuccgaaauggccgaggcucugaaagggaugccuauccgguaucagaccaccgccgucaagucugaacauacaggcagagagaucguggaccucaugugccacgcuaccuucacaaugcgccugcugagccccguucgggugccuaauuacaacaugauuaucauggaugaggcccauuuuaccgaccccgcguccauugccgcuagaggauauaucagcacgcgggucggcaugggggaagccgcugccauuuucaugacagccaccccuccgggaucuguggaggcuuuuccccaguccaaugcgguuauccaagaugaagagcgcgacaucccugaaagaagcuggaacucuggcuacgauuggauuacagacuuccccgggaaaaccgugugguuugucccuagcaucaaguccggaaaugauauugccaacugucuccggaaaaacggcaagcgcgugauccagcuuucuagaaagacguucgacaccgaguaucagaaaacaaagaauaacgacugggauuacguggucaccacagacauuagcgagaugggggcuaauuuccgggccgauagaguuaucgacccccgccggugccugaaaccggugauucugaaggauggcccugaaagagugauccucgccggacccaugcccgucaccguggcuuccgccgcgcagcgccggggcagaaucgggcgcaaccaaaauaaagagggagaccaguacguuuauaugggccagccucugaacaaugaugaagaccacgcucauuggacagaggccaagaugcuucuggauaacauuaauacccccgaggggaucauuccugcccucuuugaaccggagcgggaaaagucugcugccaucgacggagaguacagacugcgcggcgaagcgagaaaaacguucguggagcugaugcggcgcggggaucuccccgucuggcuuagcuauaagguggccuccgagggcuuucaguacagcgacagacgguggugcuucgauggagaacgcaacaaucaaguucuggaggaaaacauggacguggagauuuggacaaaagaaggcgagagaaagaaacugcggccuagauggcucgacgcucgcaccuauucugauccccuggcccuucgggaguuuaaggaauucgcugccgggagacgcuccgucagcggagaccugauccucgagaucggcaaacugccucagcaccugacccuccgggcucagaaugcccuugauaaccuggugaugcugcacaauuccgaacaggggggaaaggcguacagacaugccauggaggaacuccccgacacaauugagacccugaugcuucuggcucucaucgccguccugacaggcggcgugacgcuguuuuuccucucugggaagggacuuggcaaaaccagcauugggcugcuguguguuacagcuuccucugcccuccuguggauggccagcguggagccgcacuggaucgcugcguccauuauccuugaauuuuuccugauggugcuccugaucccugagcccgaucggcaacgcaccccucaggacaaccagcuggccuaugucguuauuggacuccuuuuuaugauccugacaguggcugccaacgaaaugggccugcucgagaccacgaagaaagaucuggggauuggacauguggccgcugagaaucaccaacacgccaccaugcuugacgucgaucugagacccgcgagcgccuggacacucuacgcuguggccaccacaguuaucaccccuaugaugcggcauacgauugaaaacacaaccgcuaauaucucucugacagccauugcgaaccaggccgcuauccugaugggccucgacaagggcuggcccaucuccaaaauggauauuggggugccgcuucuggcccugggaugcuacagccaggucaauccucucacccugaccgcugccgugcuuaugcuggucgcucacuaugccaucauuggccccgggcuccaggcgaaggccacacgcgaggcucaaaagagaacggccgcuggaaucaugaaaaaccccaccguggacggcauuguugccaucgaucuggacccuguggucuacgacacaaaguucgaaaaacagcuggggcagaucaugcuccuuauucuguguaccucucagauccugcucaugcggacaaccugggcccugugcgaguccauuacgcuugcgacaggaccgcugaccacccucugggaaggcagccccggcaaguuuuggaauacaaccaucgcugugucuauggccaacauuuuccgcgggagcuaucuggcuggagccggccuggccuucucccucaugaaaucucuugggggaggcagacgggggacaggagcucaaggcgagacgcugggcgagaaguggaagcgccagcugaaucagcucagcaaauccgaauuuaacaucuacaagagaagcgggaucauggagguugaucgguccgaagccaaagagggacugaagagaggcgaaaccacaaaacaugcggugucucgcgggaccgccaagcuucggugguucgucgagagaaaucuggugaagccugagggaaaagugauugaccucggcugugggcgcggaggcuggagcuauuacugcgcuggccugaagaaaguuacagaagucaagggguauaccaaaggaggccuggggcacgaggaacccaucccuauggccacguacggauggaaccucgugaagcuucauuccggcaaagauguguuuuucaugcccccugagaagugugacacccugcugugcgauauuggggaaucuagcccgaaucccacaaucgaggagggacggacccucagaguccugaagaugguugaaccuuggcuucgcggcaaccaguuuuguauuaaaauccugaaucccuacaugccuuccgugguggagacacucgaacaaaugcagcggaaguauggcgggaugcuggucagaaacccccugucucgcaauagcacccacgagauguacuggguguccugcggaacaggcaacauuguuagcgcugugaacaugaccucucggaugcuccugaauagauucacgauggcccaccgcaaaccgacauaugagcgggacgucgaucuuggggcgggaaccagacauguggccguugaaccugagguggcuaaccuggacaucaucggccagcgcauugaaaauaucaagaacgagcacaaauccaccuggcauuacgaugaagacaaucccuauaagacaugggccuaccacgggagcuaugaggucaagcccucuggauccgcuagcucuauggugaacggcguggucagacuccugacgaaaccuugggauguuauucccauggugacccaaaucgccaugacagacaccacaccuuuuggccagcagcggguguucaaggagaaagucgacacccgcacaccgagagcuaagcgggggaccacgcagauuauggaagugaccgccaaauggcuuuggggauuucuguccagaaauaagaagccccggaucuguacacgcgaggaauucaccagaaaaguucggagcaacgcggccaucggcgcuguguuugucgaugagaaucaauggaacuccgccaaggaagcuguggaggacgagcgcuucugggaucucguucacagagaacgggagcugcauaaacaggggaagugcgccacaugcguguacaauaugaugggaaaacgcgaaaagaagcugggcgaguuugggaaagccaagggcagcagagcgauuugguacauguggcucggagcucgguuccuggaauucgaggcccuuggcuuuaugaacgaggaccacugguucucucgcgaaaauagccuguccggggucgagggagaaggccuccauaaacugggguauauccuuagagauauuucuaagaucccuggaggcaacauguacgccgacgauaccgcugggugggacacgcggauuacagaggaugaccugcagaaugaggccaaaaucaccgauaucauggaacccgagcacgcucuccuggccacaagcauuuuuaagcugaccuaucagaacaaagugguucgcgugcaaagaccugcgaagaacggcacggucauggacgugaucucccggcgcgaucagagaggaucuggccaggucgggaccuacggacucaauacauucaccaacauggaagugcagcugauucggcaaauggagagcgaaggcaucuuucuucccuccgagcuggagacaccgaaucucgccgaaagaguucuggacuggcuugagaagcauggggcugaacgccugaaacggauggccauuucuggagacgauuguguggucaagccuaucgacgauagauucgcuaccgcccucacagcgcugaacgacaugggcaaagugcgcaaggauaucccccagugggagccuagcaaaggguggaaugacuggcagcaggugcccuuuugcucccaccacuuccaucaacugauuaugaaggauggccgggaaaucguugugccuuguagaaaccaggacgagcucgucggacgcgcccgggugagccagggcgcuggguggucucugagagagaccgccugccuuggaaaguccuaugcucaaauguggcagcugauguacuuucaccgccgggaucucagacuggccgcuaaugccauuuguagcgcgguucccguggacugggucccgacgucucgcacaaccugguccauccaugcccaccaccaguggaugaccacagaagauaugcuuagcguguggaaccgggucuggauugaggaaaauccuuggauggaggacaaaacccauguguccucuugggaagagguucccuaucugggcaagagagaggaccaguggugcgggagccucaucggacugacagcucgggccacgugggccaccaacauucaaguggcuaucaaucaggucagacgccugaucggcaacgaaaauuaccucgauuacaugacauccaugaaacgguucaagaacgagagcgaccccgaaggggcccugugguga

SEQ ID NO: 18673 - RNA, 9879 nt, Artificial Sequence
  derived and/or modified CDS sequence (opt5) from DENV-1__GQ199859__SS-prME
agcgugaccaugcugcucaugcugcuucccacagcccuggcuuuccaccucacgaccagaggcggggagccucauaugaucgucuccaagcacgaacggggaaaaucucugcuuuuuaagacaagcaccggcguuaacaugugcacacugauugccauggaccucggggagcugugugaagauaccaugacauacaaaugcccgcgcaucaccgaggcggaacccgacgauguggacuguuggugcaaugcuacggauaccugggugacauauggaaccuguucccagacaggcgagcauagacgggacaagcgcucugucgcccuggccccucacguggggcucggacuggagaccagaacggaaacauggaugagcuccgagggcgcuuggaaacaaauucagcggguugaaaccugggcccuucgccaucccggcuucacagugaucgcucuguuucucgcccacgcgauugggaccucuaucacccagaagggaaucauuuucauccugcuuaugcuggucacaccuagcauggccaugagaugcgugggcauugggaaccgggauuuuguugagggacucuccggcgcuacguggguggacgucgugcuggagcacgggagcugugugaccacaauggccaagaauaaacccacccuggauaucgaacuccugaagacagaggucaccaacccugcuguucuucgcaaacugugcauugaagccaagaucucuaauacgacaaccgacuccagauguccgacccagggagaggcgacacucguggaagagcaagaugccaacuucgugugccggcgcacccuggucgacagaggcuggggcaauggguguggacuuuuuggcaaagggagccugcucacaugcgcuaaguucaagugcgugacgaaacuggagggaaagauuguucaguacgaaaaccugaaauauucugugaucgucaccgugcauacaggcgaucagcaccagguugggaaugagaccacagaacauggaaccaucgccacgauuaccccccaagcuccuacauccgagauccagcucaccgacuacggcgcccugacacuugacuguagcccccggaccggccuggauuuuaacgaaauggugcuccugacgaugaaggagaaaucuuggcuuguccacaagcagugguuccuggaccucccucugcccuggacauccggggccagcaccucccaggagacauggaaucgccaagaucugcucgugaccuuuaaaaccgcucacgcgaagaagcaggaagucgugguucugggaucucaggagggcgccaugcauacagcucuuacgggggccaccgaaauucaaacaagcggaaccacaaccaucuucgccggccaccugaaaugcagacucaagauggacaaacugacgcugaaggggacauccuaugugauguguaccggcagcuuuaaacuugagaaggaagucgcugagacccagcauggaacagugcucguucaggugaaguacgagggcaccgaugccccgugcaaaauuccuuucucuacacaggacgaaaagggggucacgcaaaacggacggcugaucaccgcgaaucccaucgugacagauaaagagaagccugugaacauugaaaccgagccccccuucggcgaguccuauaucguugucggggcuggagaaaaagcccugaagcucagcugguuuaagaaaggcucuagcauugggaagauguucgaggccacagcuagaggcgcccgccggauggcuauccugggagacaccgccugggauuuuggcuccauugggggaguguucacgucugugggcaaacuuguccaccagguguuugggaccgcguacggaguucuguucagcggcguguccuggacaaugaagaucgggaucggcauucuccugaccuggcugggacuuaauagcagaucuacaucccucagcaugaccuguaucgccgucggcauggugacacuguaccuggggguuauggugcaggcugacucuggaugcgucauuaacuggaaaggccgcgaacucaaguguggguccggaaucuuugugaccaacgagguucauacguggacagaacaguauaaguuccaagccgauagcccuaaacggcuguccgcugccauuggcaaggcgugggaggagggggugugcggcaucagaucugccacccgccuugaaaauauuauguggaaacagaucagcaacgagcugaaucacauccuccuggaaaacgacaugaaguuuaccgucguggugggagacgcuaauggcauucuggcccaggggaaaaagaugauccggccgcagcccauggagcacaaauacuccuggaagucuuggggaaaggcuaaaauuaucggcgccgauauucaaaacacaaccuucaucaucgacgggccugauacgcccgaauguccugacgaucagagagccuggaauauuugggaggucgaggacuauggauuuggcaucuucacaaccaacauuuggcuuaagcuccgcgauagcuacacacagaugugcgaccaucggcugauguccgcugcgaucaaagauagcaaggccguucacgcugacaugggcuauuggauugaaucugagaaaaaugaaaccuggaagcuggccagagccuccuuuaucgaggugaagacauguaccuggcccaaaagccauacgcucuggucuaacggggugcuggaauccgagaugaucauuccgaagaucuacggaggcccuauuagccagcacaauuaucgccccggguacuucacccaaacagcuggaccuuggcaccuuggcaaacuggagcucgauuucgaccugugcgaagggaccacagucgugguugaugagcauugcggaaaccggggccccucucugagaaccacgacagugaccggcaagaucauucacgaaugguguugccggagcuguacacuuccuccccuccgcuuuagaggggaggacggaugcugguacggcauggagauccggccggucaaagaaaaggaggaaaaucuggugagauccaugguuagcgccgggucuggagagguggacuccuucagccugggcauccucugugucuccauuaugaucgaagaggugaugcgcucucgguggagcagaaagaugcugaugaccgggacccuugcgguuuuucugcuccugauuaugggacagcugacauggaacgaucuuauccgccugugcauuauggugggcgcuaaugccuccgacagaaugggcauggggacgaccuaucucgcccugauggcuacauucaaaaugcggccuauguuugccgucggaauccucuuccgcagacugaccucucgggaggugcuucugcucacaauuggccugagccugguggcguccgucgaacuucccaacucucuggaggaacucggggauggacuggcuaugggcaucaugaugcucaagcugcuuaccgaguuucagccccaucaacuguggacgacacuccugagccugaccuucaucaaaaccacacuuucccuggacuacgccuggaagaccacagccauggcucucagcauuguuucucuguuuccucucugucuguccacgaccagccagaaaacaaccuggcuuccggugcugcuggggucuuucggaugcaagccccucacaauguaucugaucaccgaaaacaagauuuggggccgcaaauccuggccuaucaaugagggcauuauggccaucgggaucgugagcauucuucugucuucccuccugaagaacgaugucccccucgcuggaccucugaucgccggcgggaugcuuauugcguguuacgugaucagcggauccagcgccgaccugucucuggagaaagcugccgaaguuagcugggagcaggaagcugagcacuccggcacgucucauaauauucucguggaaguccaggaugacgggaccaugagaaucaaggaugaggagaaagacgauacacugaccauccuucugaaggccacacuccuggccgugagcggaguuuaucccauguccauuccugcuacccucuuugugugguacuucuggcaaaaaaagaagcagcggucuggcguccugugggacacacccagcccgccugaaguggagcgcgcgguccuugaugacggcaucuauagaauucugcagcgggggcugcucggacgcucccaggugggcguugggguguuucaagacggagucuuccacacgauguggcacgugaccagaggcgccguucugauguaccaggggaaacggcuugaacccucuugggcuagcgugaagaaagaucugaucuccuacggaggcggcuggagauuccaggggagcuggaacacaggagaggagguccaggugauugccguggaaccuggcaagaaucccaaaaacguucaaaccaccccggggacauuuaagacgccugagggagaagucggcgccaucgcucucgacuucaagcccgggaccucuggauccccuauugugaaucgcgagggcaaaaucgugggccuguaugggaacggagucgugacaaccagcggcacauacguuucugccaucgcgcaggcuaaggccucccaggaagggccccuccccgagauugaggaugaaguguuuaaaaagcggaaucugaccaucauggaccuucauccuggaagcggcaaaacgagacgcuaucugccggccauuguccgggaggcuaucaagagaaagcugcgcacacucauucuggcccccacccgggugguugcguccgaaauggcugaggcccuuaaagggaugccuaucagauaccaaaccacagccgugaagucugaacacaccggccgcgagaucgucgaucugaugugccaugcuacauucaccaugcggcuccugagccccgugagaguuccuaacuauaauaugauuaucauggacgaggcccacuuuacggaucccgcuuccauugccgcgcggggauacaucagcacacgcgugggcaugggggaagccgcugccauuuucaugaccgcuacaccuccgggaucugucgaggccuuuccccaguccaacgccgugauccaggacgaagagagagauaucccugaacggagcuggaauucuggcuaugacuggauuaccgauuuccccgggaaaacggugugguuugucccuagcaucaaguccggaaacgacauugcuaauugucugcgcaaaaacggcaagagaguuauccagcucucucggaagaccuucgacacagaguaccaaaaaaccaagaacaaugauugggacuacguggugacaaccgauauuagcgagaugggggcgaacuuuagagccgaccgcgucaucgauccccggagaugccuuaaaccggugauucugaaggacggcccugaacgcguuauccuggcuggacccaugcccgugacagucgccuccgccgcucagcggagaggccgcaucgggcggaaucagaacaaagagggagaucaguauguguacaugggccaaccucucaauaacgacgaagaucaugcccacuggaccgaggcgaagaugcugcuugacaauauuaacacgcccgaggggaucauuccugcucuguucgaaccggagagagaaaagucugccgccaucgauggagaguaucgccucagaggcgaagcucggaaaacauucguugagcugaugcgcagaggggaccugcccguguggcucagcuacaaggucgccuccgagggcuuucaguauagcgaucggcgcuggugcuucgacggagaaagaaauaaccaggugcuugaggaaaauauggacgucgagauuuggaccaaagaaggcgagcggaagaaacugagaccucgcuggcuggaugcgcggaccuacucugacccccucgcccugagagaguuuaaggaauucgcugccgggcgccgguccgugagcggagaucuuauccuggagaucggcaaacucccucagcaccugacacugagagcucaaaacgcccucgacaaucuuguuaugcugcauaacuccgaacaggggggaaaggcuuaucggcacgccauggaggaacugcccgauaccauugagacacucaugcugcuugcgcugaucgccgugcucacgggcggcgugacccuguuuuuccugucugggaagggacucggcaaaacaagcauugggcuucugugugucaccgcuuccucugcccugcucuggauggcuagcguugagccgcauuggaucgccgccuccauuauccuggaauuuuuccuuauggugcugcucaucccugagcccgaccgccagagaacaccucaggauaaucaacuggcuuacguggucauuggacugcucuuuaugauccuuaccguggcggccaacgaaaugggccugcuggagacgaccaagcgggaccucgggauuggacacguugcugccgagaaccaccagcaugccacaaugcuggauguggaccuucgccccgcuagcgccuggacccuguacgcggucgccacaaccgugaucacgccuaugaugagacacacaauugaaaauaccacagcuaacaucucucucaccgccauugcuaaucaggccgcgauccugaugggccuggauaaaggcuggcccaucuccaagauggacauuggggucccgcuccuugcccugggaugcuauagccaagugaacccucugacccucacagcugccguucugaugcuuguggcucauuacgccaucauuggccccgggcugcaggcuaaagccacgcgggaggcgcagaagcgcaccgccgcuggaaucaugaagaaucccacagucgauggcauuguggccaucgaccucgacccuguuguguaugaugcuaaauucgaaaagcagcuggggcaaaucaugcugcucauucuuuguaccucucagauccugcugaugagaacaaccugggcccucugcgaguccauuacgcuggccacaggaccgcuuaccacccugugggaaggcagccccggcaaauuuuggaacacaaccaucgcggucucuauggcuaauauuuuccgggggagcuaccucgccggagcuggccuggccuuuucccugaugaagucucucgggggaggccgcagagggacaggagcccagggcgagacgcuuggcgagaaauggaagcggcagcugaaccaacugagcaagccugaauucaauaccuauaaaagauccgggaucauggagguggaccgcagcgaagcuaaggagggacucaaacggggcgaaacaaccaagcacgccguguccagagggacagcgaaacugcgcugguucguugagcggaaccuugucaagcccgagggaaaggugaucgaucugggcugugggagaggaggcuggucuuacuauugcgccggccucaaaaaggugaccgaagucaaaggguacacgaagggaggcccugggcaugaggaacccauuccuauggcuaccuacggauggaaucugguuaaacugcacagcggcaaggacguguuuuucaugccgcccgagaaaugugauacacuccuuugcgacaucggggaauccucuccuaaccccaccauugaggagggacgcacacugcgggugcugaagauggucgaaccuuggcucagaggcaaucaguuuuguaucaagauucugaaccccuauaugccgagcgugguugagacccuugaacagaugcagcgcaaacacggcgggaugcuggugcggaauccucucuccagaaacucuacacaugagauguacugggucagcugcggaaccggcaauaucguguccgccguuaacaugacgagccgcaugcugcugaaccgguucacaauggcucacagaaagcccaccuaugagcgcgauguggaccucggggccggaaccagacaugucgcgguggaacccgagguggccaaucuggauauuaucggccaacggaucgaaaacauuaaaaaugagcacaagucuacauggcacuacgacgaagauaacccuuauaaaacgugggcuuaccauggguccuaugaggucaagcccagcggaucugccuccagcaugguuaauggcguggugcgccuucugaccaagccuugggacgucaucccgauggugacacagauugcuaugaccgacacaacccccuuuggccagcaaagaguuuucaaagagaagguggauacacggaccccuagagccaaacgggggacgacccagaucauggaagucacagcuaaguggcucuggggauuucugucucgcaacaaaaagcccagaauuuguacccgggaggaauucacacgcaaggugagauccaaugccgcgaucggcgccguuuuuguggacgagaaccaguggaauagcgcuaaagaagccgucgaggaugagcgguucugggaccuugugcaccgcgaaagagagcugcauaagcaggggaaaugcgcuaccugcguuuacaacaugaugggaaagcgggaaaaaaagcucggcgaguuugggaaggccaaaggcucccgcgccaucugguacauguggcugggagcgagauuccuggaauuugaggcucucggcuucaugaaugaggaucacugguucagccgggaaaacucucugagcgggguggagggagaaggccuucauaagcugggguauauucuccgcgacaucuccaaaauuccuggaggcaauauguacgccgaugacacggccgggugggauacaagaaucaccgaggacgaucugcaaaacgaggcuaagauuacagacaucauggaacccgagcacgcccuucuggcuaccucuaucuuuaaacucacguaucagaauaaggucgugcggguccagcgcccggccaaaaacggcaccgugauggauguuauuagcagacgggaccagagaggauccggccaaguggggacauacggacugaacaccuucacaaauauggaaguccagcugauccgccagauggagucugaaggcauuuuucucccuagcgagcuggagacccccaaccuugcggaacgggugcuggacuggcucgagaagcacggggccgaaagacugaagcgcauggcuaucuccggagaugacugugugguuaaaccuauugaugaccgguucgccacagcucuuaccgcccugaaugauaugggcaaggugagaaaagacaucccccagugggagccuucuaagggguggaacgauuggcaacagguccccuuuugcagccaucacuuccaucagcucaucaugaaagacggccgcgaaauugugguuccgugucggaaucaggaugagcuggugggaagagcgcgcgucucccaaggcgccggguggagccugcgggagacggcuugccucggaaagucuuaugcccagauguggcagcugauguacuuucacagacgcgaccuucggcuggcugccaacgcuaucuguuccgccgugccugucgauugggugcccacaagcagaaccaccuggucuauucacgcgcaucaccaauggaugacaaccgaagacaugcucuccguuuggaaucggguguggaucgaggaaaaccccuggauggaggacaagacacaugucagcuccugggaagaggugccuuaucugggcaaaagagaggaucaguggugcgggucucuuauuggacugacggcccgcgcuaccugggccacaaauauccagguugccauuaaccaggugcggagacucaucggcaaugaaaacuaccuggacuacaugaccagcaugaagcgcuucaaaaaugaguccgauccggaaggggcucugugguga

SEQ ID NO: 18674 - RNA, 9879 nt, Artificial Sequence
  derived and/or modified CDS sequence (opt5) from DENV-1__JF937645__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacacugguggaccgcggcuggggcaauggguguggacuuuuuggcaaagggagccugcucaccugcgccaaguucaagugcgucacaaaacuggagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcucacagacuacggcgcccugacccuugacuguagccccagaacaggccuggauuuuaacgaaaugguucuccugaccaugaaggagaaaucuuggcuugugcauaagcaaugguuccuggaccucccucugcccuggacguccggggcuagcacaucccaggagaccuggaaucggcaggaucugcucgucacauuuaaaaccgcgcacgccaagaagcaagaaguggucgugcugggaucucaggagggcgcuaugcacaccgcccuuacaggggccacggaaauccagaccagcggaacaaccacaauuuucgcuggccaucugaaaugccgccucaagauggacaaacugacccugaaggggacguccuauguuauguguacaggcagcuuuaaacuugagaaggaaguggccgagacccagcacggaaccguccucgugcaaguuaaguacgagggcacagaugcgccgugcaaaaucccuuucucuacccaggacgaaaagggggugacacagaacggaagacugaucacggcuaaucccauugucaccgauaaagagaagccugugaacaucgaaacagagccccccuucggcgaguccuauauugugguuggggccggagaaaaagcccugaagcucagcugguuuaagaaaggcucuagcaucgggaagauguucgaggcuaccgcccggggcgcuagacgcauggccauucugggagacacagcgugggauuuuggcuccaucgggggagucuucaccucugugggcaaacuugugcaucaggucuuugggacggccuacggagugcuguucagcggcguuuccuggaccaugaagaucgggauuggcauccuccugacauggcugggacuuaauagccggucuaccucccucagcaugacauguauugcugugggcauggucacccuguaccugggggugaugguucaagccgacucuggaugcgugaucaacuggaaaggcagagaacucaaguguggguccggaauuuuugucacaaacgaggugcacaccuggacggaacaguauaaguuccaggcugauagcccuaaacgccuguccgccgcgaucggcaaggccugggaggaggggguuugcggcauucggucugcuacaagacuugaaaauaucauguggaaacagaucagcaacgagcugaaucauauucuccuggaaaacgacaugaaguuuaccguggucgugggagacgccaauggcauccuggcucaagggaaaaagaugauucgcccgcagcccauggagcacaaauacuccuggaagucuuggggaaaggccaaaaucauuggcgccgauauccagaacaccacauucaucauugacgggccugauacccccgaauguccugacaaucagcgggcuuggaacaucugggagguggaggauuauggauuuggcauuuucacgacaaauaucuggcuuaagcucagagacagcuacacccaaaugugcgaucaccgccugauguccgcggccauuaaagacagcaaggcuguccaugccgauaugggcuauuggaucgaaucugagaaaaacgaaacauggaagcuggcccgggcuuccuuuaucgagguuaagaccuguacauggcccaaaagccacacccucuggucuaauggggugcuggaauccgagaugauuaucccgaagauuuacggaggcccuaucagccagcauaacuauagacccggguacuucacgcagaccgccggaccuuggcaccuuggcaaacuggagcucgacuucgaucugugcgaagggacaaccguggucguggacgagcacugcggaaaucgcggccccucucugcggacaaccacgguuacaggcaagauuauccaugaaugguguugcagaagcuguacccuuccuccccuccgguuucgcggggaggauggaugcugguacggcauggagaucagaccggugaaagaaaaggaggaaaaccugguccgguccauggugagcgcggggucuggagagguugacuccuucagccugggcauucucugugcuuccaucaugauugaagaggugaugagaucucgcuggagccggaagaugcugaugacagggacccuugccgucuuucugcuccugaucaugggacaacugaccuggaaugaccuuauuagacugugcaucauggugggcgccaacgcuuccgaucgcaugggcauggggacaacguaucucgcccugauggcgaccuucaaaaugagaccuauguuugcuguuggacuccuguuccggcgccuuacaucuagagaggugcugcuccugaccauuggccugagccuugucgccuccguggaacugcccaacucucucgaggaacugggggacggacucgccaugggcaucaugaugcugaagcuucugacagaguuucagccccaccagcucuggaccacgcugcugagccuuacauucaucaaaaccacccugucccucgauuacgcuuggaagacaaccgccauggcucugagcauugugucucucuuuccucugugucuuuccacaacgagccagaaaaccacauggcugccgguccugcucgggucuuucggaugcaagccccugaccauguuucuuaucacagaaaauaagauuuggggccggaaauccuggccucugaacgagggcaucauggccauugggaucguuagcauccuccugucuucccuccugaagaaugacgugccccuugcgggaccucugauugccggcgggaugcugaucgcuuguuaugugauuagcggauccagcgccgaucucucucuggagaaagcugccgaagucagcugggagcaagaagccgagcauuccggcaccucucacaacauccuuguggaaguucaggacgaugggacgaugaagauuaaagacgaggagcgcgaugacacccugacaauccuccugaaggcuacccuccuggcggugagcggagucuaccccauguccaucccugccacacuuuucgugugguauuuuuggcagaaaaagaagcagagaucuggcguucugugggauacccccagcccgccugaaguggagcgggcuguccuggacgauggcauuuaccgcauccuccaaagagggcugcuuggacggucccaggugggcgucgggguguuccaggacggaguuuuccauacaauguggcacgugacgcgcggcgccguccugauguaucaggggaaaagacucgaacccucuugggccagcgugaagaaagaccugauuuccuacggaggcggcuggcgguuucaagggagcuggaauaccggagaggagguucaggugaucgcugucgaaccuggcaagaaccccaaaaaugugcagacaaccccggggaccuucaagacaccugagggagaagugggcgccauugcgcucgauuuuaagcccgggacgucuggauccccuaucguuaacagagagggcaaaauugucggccuguacgggaauggaguggugaccacaagcggcaccuaugucucugcuaucgcccaagccaaggcuucccaggaagggccccuucccgagaucgaggacgaaguguucaaaaagcgcaaccugacaauuauggaucugcacccuggaagcggcaaaacccggagauaccucccggccaucguucgcgaggcgauuaagcggaagcugagaacgcuuauccuggcucccacacgcguggucgccuccgaaauggccgaggcucucaaagggaugccuauucgguaucagaccaccgccgugaagucugaacauacaggcagagagaucguugaccugaugugccacgcuaccuuuacaaugcgccugcucagccccgugcgggucccuaauuacaacaugaucauuauggaugaggcccauuucaccgaccccgcguccaucgccgcuagaggauauauuagcacgcgggugggcaugggggaagccgcugccaucuuuaugacagccaccccuccgggaucuguugaggcuuucccccaguccaaugcggugauucaagaugaagagcgcgacaucccugaaagaagcuggaacucuggcuacgauuggaucacagacuuucccgggaaaaccgucugguucgugccuagcauuaaguccggaaaugauaucgccaacugucuucggaaaaacggcaagcgcgugauucagcugucuagaaagacguuugacaccgaguaucagaaaacaaagaauaacgacugggauuacgucguuaccacagacaucagcgagaugggggcuaauuuccgggccgauagagugauugacccccgccggugccugaaaccggugauccucaaggauggcccugaaagagucauucuggccggacccaugcccgugaccguugcuuccgccgcgcagcgccggggcagaaucgggcgcaaccaaaauaaagagggagaccaguacguguauaugggccagccucuuaacaaugaugaagaccacgcucauuggacagaggccaagaugcugcucgauaacaucaauacccccgaggggauuaucccugcccuguucgaaccggagcgggaaaagucugcugccauugacggagaguacagacugcgcggcgaagcgagaaaaacguuugucgagcucaugcggcgcggggaucuucccguguggcugagcuauaagguugccuccgagggcuuccaguacagcgacagacgguggugcuuugauggagaacgcaacaaucaagugcuggaggaaaacauggacgucgagaucuggacaaaagaaggcgagagaaagaaacuccggccuagauggcuggacgcucgcaccuauucugauccccuugcccugcgggaguucaaggaauuugcugccgggagacgcuccgugagcggagaccucauucuggagaucggcaaacugccucagcaccucacccuucgggcucagaaugcccuggauaaccuggucaugcuccacaauuccgaacaggggggaaaggcguacagacaugccauggaggaacugcccgacacaaucgagacccuuaugcugcucgcucugauugccgugcugacaggcggcguuacgcucuucuuucuuucugggaagggacugggcaaaaccagcaucgggcugcucugugugacagcuuccucugcccugcuuuggauggccagcguggagccgcacuggauugcugcguccaucauucuggaauucuuucucaugguccugcugaucccugagcccgaucggcaacgcaccccucaggacaaccagcucgccuauguugugaucggacuucuguucaugauucugacaguggcugccaacgaaaugggccuccuggagaccacgaagaaagaucuugggaucggacaugucgccgcugagaaucaccaacacgccaccaugcuggacguggaucucagacccgcgagcgccuggacacuguacgcuguugccaccacagugauuaccccuaugaugcggcauacgaucgaaaacacaaccgcuaauauuucucugacagccaucgcgaaccaggccgcuauucucaugggccuugacaagggcuggcccaucuccaaaauggauaucggggucccgcugcuggcccucggaugcuacagccaggugaauccucugacccuuaccgcugccguccugaugcucguggcucacuaugccauuaucggccccgggcugcaggcgaaggccacacgcgaggcucaaaagagaacggccgcuggaauuaugaaaaaccccaccguugacggcaucguggccauugaucuggacccugucguguacgacgccaaguuugaaaaacagcucgggcagaucaugcuucugauccuguguacaucucagauucuccugaugcggaccacaugggcgcuuugcgaguccaucacccuggcuacgggaccgcucacaacccugugggaaggcagccccggcaaguucuggaauaccacaauugccguuucuauggcuaacaucuuucgcgggagcuaucuggccggagccggccucgcuuucucccuuaugaaaucucuggggggaggcagacgggggaccggagcccaaggcgagacacugggcgagaaguggaagcgccagcucaaucagcugagcaaauccgaauucaacacguacaagagaagcgggauuauggagguggaucgguccgaagcgaaagagggacuuaagagaggcgaaaccacaaaacaugccgucucucgcgggaccgcuaagcugcggugguuuguggagagaaaucucgugaagccugagggaaaaguuaucgaccugggcugugggcgcggaggcuggagcuauuacugcgccggccugaagaaagucacagaagugaagggguauaccaaaggaggccccgggcacgaggaaccuauccccauggcuacguacggauggaaccucgugaagcuucauuccggcaaagaugucuucuuuaugccuccggagaagugugacacccugcugugcgauauuggggaaucuagccccaauccuacaaucgaggagggacggacccucagaguucugaagaugguggaacccuggcuucgcggcaaccaguucuguauuaaaauccugaauccuuacaugcccuccguggucgagacacucgaacaaaugcagcggaagcacggcgggaugcuggugagaaacccgcugucucgcaauagcacccacgagauguauuggguuuccugcggaacaggcaacauugugagcgccgucaacaugaccucucggaugcuccugaauagauuuacgauggcgcaucgcaaaccuacauacgagcgggacguggaucuuggggccggaaccagacacguugcuguggaacccgaggucgccaaccuggacaucauuggccagcgcaucgaaaauaucaagaacgagcauaaauccaccuggcacuaugaugaagacaaucccuacaagacaugggcuuaucacgggagcuacgaggugaagccuucuggauccgccagcucuauggugaacggcgucguuagacuccugacgaaacccugggaugugauuccuauggugacccaaaucgcuaugacagacaccacaccguucggccagcagcgggucuuuaaggagaaaguggacacccgcacacccagagccaagcgggggaccacgcagauuauggaaguuaccgcgaaauggcuuuggggauuccuguccagaaauaagaagccucggaucuguacacgcgaggaauuuaccagaaaagugcggagcaacgccgcuauuggcgccgucuucguggaugagaaucaauggaacuccgcuaaggaagccguugaggacgagcgcuuuugggaucucgugcauagagaacgggagcugcacaaacaggggaagugcgccacaugcgucuauaauaugaugggaaaacgcgaaaagaagcugggcgaguucgggaaagcgaagggcagcagagcuaucugguacauguggcucggagcccgguuucuggaauucgaggcccuuggcuucaugaacgaggaccauugguuuucucgcgaaaauagccuguccgggguggagggagaaggccuccacaaacugggguacauccuuagagauauuucuaagauccccggaggcaacauguaugcugacgauaccgccgggugggacacgcggauuacagaggaugaccugcagaaugaggcuaaaaucaccgauauuauggaaccugagcaugcccuccuggcgacaagcaucuucaagcugaccuaccagaacaaaguugugcgcguccaaagacccgccaagaacggcacggugauggacgucaucucccggcgcgaucagagaggaucuggccagguggggaccuauggacucaauacauuuaccaacauggaaguucagcugauucggcaaauggagagcgaaggcaucuuccuuccguccgagcuggagacaccuaaucucgcugaaagagugcuggacuggcuugagaagcacggggccgaacgccugaaacggauggcuauuucuggagacgauugugucgugaagcccaucgacgauagauuugccaccgcgcucacagcccugaacgacaugggcaaagugcgcaaggauauuccucagugggagcccagcaaaggguggaaugacuggcagcagguuccuuucugcucccaccauuuucaccaacugaucaugaaggauggccgggaaaucgugguccccuguagaaaccaggacgagcucgugggacgcgcucggguuagccagggcgccggguggucucugagagagaccgcuugccuuggaaaguccuacgcccaaauguggcagcugauguauuuccaucgccgggaucucagacuggcugccaaugcgauuuguagcgccgugccggucgacugggugccuacgucucgcacaaccugguccauccacgcucaccaucaguggaugaccacagaagauaugcuuagcgucuggaaccggguguggauugaggaaaaucccuggauggaggacaaaacccacguuuccucuugggaagaggugcccuaccugggcaagagagaggaccaguggugcgggagccucaucggacugacagcccgggccacgugggcuaccaacauucaagucgccaucaaucaggugagacgccugauuggcaacgaaaauuaucucgauuacaugacauccaugaaacgguuuaagaacgagagcgacccugaaggggcgcugugguga

SEQ ID NO: 18675 - RNA, 9879 nt, Artificial Sequence
  derived and/or modified CDS sequence (opt5) from DENV-1__FJ850114__SS-prME
agcgugaccaugcugcuuaugcugcuucccacagcucuggcuuuccaccucacgaccagaggcggggaaccucauaugaucguguccaagcaggaacggggaaagucucugcuuuuuaagacaagcgccggcguuaacaugugcacccugauugcgauggaccucggggagcugugugaagauacaaugaccuacaagugcccccagaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaucuccugccauucuucggaaacugugcaucgaagcgaagauuuccaacaccacgacagacagccgcuguccgacccagggagaggccacccucguugaagaacaggaugcuaauuucgugugcagacggacauuuguggaccgcggcuggggcaacggguguggacuguucggcaaagggucucuucugaccugcgccaaguuuaagugcgucacaaaacucgagggaaagaucgugcaguacgaaaaucugaaauauuccguuaucgugacgguccacaccggcgaucaacaucagguggggaacgagacaaccgaacacggaacaauugcuaccaucacgccccaggccccuaccagcgagauucagcugacagacuacggcgcccucacccuggacuguucucccagaacaggccuugauuucaaugaaaugguucugcucaccaugaaggagaaauccuggcuggugcauaagcaaugguuucuugaccugccucuccccuggacgagcggggcuuccacaucucaggagaccuggaaccggcaggaucugcuggucacauucaaaaccgcgcacgccaagaagcaagaaguggucgugcucggaagccaggagggcgcuaugcacaccgcccugacaggggccacggaaauccagaccuccggaacaaccacaauuuuugcuggccaucuuaaaugccgccugaagauggacaaacucacccugaaggggacgagcuauguuauguguacaggcucuuucaaacuggagaaggaaguggccgagacccagcacggaaccguccuugugcaaguuaaguacgagggcacagaugcgccgugcaaaaucccuuucuccacccaggacgaaaagggggugacacagaauggaagacucaucacggcuaaccccauugucaccgauaaagagaagccugugaauaucgaaacagagccgcccuuuggcgagagcuauauugugguuggggccggagaaaaagcccugaagcugucuugguucaagaaaggcagcuccaucgggaagauguuugaggcuaccgcccggggcgcuagacgcauggccauucucggagacacagcgugggauuucggcucuaucgggggagucuuuaccagcgugggcaaacuggugcaucaggucuucgggacggccuacggagugcucuuuuccggcguuagcuggaccaugaagaucgggauuggcauccugcucacauggcugggacugaacucucgguccaccagccuuucuaugacauguauugcugugggcauggucacccucuaccugggggugaugguucaagccgacuccggaugcgugaucaauuggaaaggcagagaacugaagugugggagcggaauuuucgucacaaacgaggugcacaccuggacggaacaguauaaguuucaggcugauuccccuaaacgccucucugccgcgaucggcaaggccugggaggaggggguuugcggcauucggagcgcuacaagacuggaaaacaucauguggaaacagaucuccaaugagcuuaaccauauucugcucgaaaaugacaugaaguucaccguggucgugggagacgccaacggcauccuggcucaagggaaaaagaugauucgcccgcagcccauggagcacaaauacucuuggaaaagcuggggaaaggccaagaucauuggcgccgauauccagaauaccacauuuaucauugacgggccugauacccccgaauguccugacaaccagcgggcuuggaauaucugggagguggaggauuauggauucggcauuuuuacgacaaacaucuggcugaaacuuagagacuccuacacccaaaugugcgaucaccgccucaugagcgcggccauuaaagacucuaaggcuguccaugccgauaugggcuauuggaucgaauccgagaaaaaugaaacauggaagcuggcccgggcuagcuucaucgagguuaagaccuguacauggcccaaaucucacacccugugguccaacggggugcucgaaagcgagaugauuaucccgaagacguacggaggcccuauuucucagcauaauuauagacccggguacuucacccagacagccggaccuuggcaccugggcaaacuugagcuggacuuugaucucugcgaagggaccacaguggucguggacgagcacugcggaaaccgcggccccagccugcggaccacgacaguuaccggcaagaucauucaugaaugguguugcagauccuguacacugccuccccuucgguuccgcggggaggauggaugcugguacggcauggagaucagaccggugaaagaaaaggaggaaaaucucguccggagcauggugucugcgggguccggagagguugacagcuuuucccugggcauccugugugcuucuauuaugaucgaagaggugaugagaagccgcuggucccggaagaugcucaugaccgggacccuggccgucuuccuucugcucauuaugggacaacugacauggaacgaccugaucagacuuugcauuauggugggcgccaaugcuucugaucgcaugggcauggggacgaccuaucuggcccucauggcgacauuuaaaaugagaccuauguucgcuguuggacugcucuuucggcgccugaccagcagagaggugcuucugcucacaaucggccugucccuggucgccucuguggaacuucccaacagccuggaggaacucggggacggacuggccaugggcauuaugaugcucaagcugcuuaccgaguuccagccccaccagcuguggacgacacuccugucccugaccuuuaucaaaaccacacuuagccuggauuacgcuuggaagaccacagccauggcucucucuaucgugucccuguucccucucugucugagcacgaccucucagaaaacaaccuggcuuccgguccugcugggguccuuuggaugcaagccccucacaauguuccugauuaccgaaaacaagaucuggggccggaaaagcuggccucuuaaugagggcauuauggccaucgggauuguuucuauccugcucuccagccugcucaagaacgacgugccccuggcgggaccucuuaucgccggcgggaugcugauugcuuguuaugugaucuccggaagcucugccgaucugagccucgagaaagcugccgaagucuccugggagcaagaagccgagcauucuggcacgagccacaauauucugguggaaguucaggacgaugggaccaugaagaucaaagacgaggagcgcgaugacacacuuaccauucugcucaaggcuacacugcucgcgguguccggagucuaccccaugucuaucccugccacccuguuugugugguauuucuggcagaaaaagaagcagagaagcggcguucuuugggauacacccuccccgccugaaguggagcgggcuguccuggacgauggcaucuaccgcauucugcaaagagggcuccugggacggucucaggugggcgucgggguguuccaggacggaguuuuucauacgauguggcacgugacccgcggcgccguccuuauguaucaggggaaaagacuggaacccagcugggccuccgugaagaaagaccucaucagcuacggaggcggcuggcgguuccaagggucuuggaacacaggagaggagguucaggugauugcugucgaaccuggcaagaaucccaaaaacgugcagaccaccccggggacauuuaagacgccugagggagaagugggcgccaucgcgcuggauuucaagcccgggaccuccggaagcccuauuguuaauagagagggcaaaaucgucggccucuacgggaacggaguggugacaaccucuggcacauaugucuccgcuauugcccaagccaaggcuagccaggaagggccccugcccgagaucgaggacgaaguguuuaaaaagcgcaaucuuaccaucauggaucugcacccuggauccggcaaaacgcggagauaccugccggccauuguucgcgaggcgaucaagcggaagcucagaacacugauucuugcucccacccgcguggucgccucugaaauggccgaggcucugaaagggaugccuauccgguaucagaccacagccgucaagagcgaacauaccggcagagagauuguugaccucaugugccacgcuacauucaccaugcgccugcugucccccgugcgggucccuaacuacaauaugaucaucauggaugaggcccauuuuacggaccccgcgagcauugccgcuagaggauauaucucuacacgggugggcaugggggaagccgcugccauuuucaugaccgccacaccuccgggauccguugaggcuuuuccccagagcaacgcggugauccaagaugaagaacgcgacauuccugaaagaucuuggaauagcggcuacgauuggaucaccgacuuccccgggaaaacggucugguuugugccuuccaucaagucuggaaacgauauugccaauugucuccggaaaaacggcaagcgcgugauccagcuuagcagaaagaccuucgacacagaguaucagaaaaccaagaacaaugacugggauuacgucguuacaaccgacauuuccgagaugggggcuaacuuccgggccgauagagugaucgacccccgccggugccugaaaccggugauucugaaggauggcccugaaagagucauccucgccggacccaugcccgugacaguugcuucugccgcgcagcgccggggcagaauugggcgcaaucaaaacaaagagggagaccaguacguguauaugggccagccucugaauaacgaugaagaccacgcucauuggaccgaggccaagaugcuucuggauaauaucaacacgcccgaggggaucauuccugcccucuuugaaccggagcgggaaaagagcgcugccaucgacggagaguacagacugcgcggcgaagcgagaaaaacauucgucgagcugaugcggcgcggggaucuccccguguggcuuuccuauaagguugccagcgagggcuuucaguacucugacagacgguggugcuucgauggagaacgcaauaaccaagugcuggaggaaaauauggacgucgagauuuggaccaaagaaggcgagagaaagaaacugcggccuagauggcucgacgcucgcaccuauuccgauccccuggcccuucgggaguuuaaggaguucgcugccgggagacgcagcguguccggagaccugauccucgagauuggcaaacugccucagcaccugacacuccgggcucagaacgcccuugauaaucuggucaugcugcacaacucugaacaagggggaaaggcguacagacaugccauggaggaacuccccgacaccaucgagacacugaugcuucuggcucucaucgccgugcugacgggcggcguuacccuguuuuuccucagcgggaagggacuuggcaaaacauccauugggcugcugugugugaccgcuucuagcgcccuccuguggauggccuccguggagccgcacuggaucgcugcgagcauuauccuugaauuuuuccugaugguccuccugauuccugagcccgaucggcaacgcacaccucaggacaaucagcuggccuauguugugaucggacuccuuuuuaugauccugaccguggcugccaacgaaaugggccugcucgagacgaccaagaaagaucuggggauuggacaugucgccgcugagaaccaccaacacgccacaaugcuugacguggaucugagacccgcgucugccuggacccucuacgcuguugccacaaccgugaucacgccuaugaugcggcauacaauugaaaauaccacagcuaacaucucccugaccgccauugcgaaucaggccgcuauccugaugggccucgacaagggcuggcccauuagcaaaauggauaucggggucccgcuucuggcccugggaugcuacucucaggugaacccucucacccugacagcugccguccuuaugcugguggcucacuaugccaucauuggccccgggcuccaggcgaaggccacgcgcgaggcucaaaagagaaccgccgcuggaaucaugaaaaaucccacaguugacggcauuguggccaucgaucuggacccugucguguacgacgccaaguucgaaaaacagcuggggcagauuaugcuccuuauccuguguaccucccagauccugcucaugcggacaaccugggcgcugugcgagagcauuacgcuugcuacaggaccgcugaccacccucugggaaggcucucccggcaaguuuuggaacacaaccaucgccguuagcauggcuaauauuuuccgcggguccuaucuggccggagccggccuggcuuucucucucaugaaaagccuugggggaggcagacgggggacaggagcccaaggcgagacgcugggcgagaaguggaagcgccagcugaaccagcucuccaaaagcgaauuuaauaccuacaagagauccgggaucauggagguggaucggucugaagcgaaagagggacugaagagaggcgaaacaaccaaacaugccgucagccgcgggacagcuaaacuucggugguucguggagagaaaccuggugaagccugagggaaaaguuauugaccucggcugugggcgcggaggcugguccuauuacugcgccggccugaagaaagucaccgaagugaagggguauacgaaaggaggccccgggcacgaggaaccuauccccauggcuaccuacggauggaaucuggugaagcuccauucuggcaaagaugucuuuuucaugccuccggagaagugugacacacuucugugcgauaucggggaaagcucccccaacccuaccauugaggagggacggacacugagaguucucaagaugguggaacccuggcugcgcggcaaucaguuuuguaucaaaauucuuaacccuuacaugcccucuguggucgagauccuggaacaaaugcagcggaagcacggcgggaugcucgugagaaauccgcugagccgcaacuccacccacgagauguauuggguuagcugcggaacaggcaauauugugucugccgucaacaugaccucccggaugcugcucaacagauucacgauggcgcaucgcaaaccuacauacgagcgggacguggaucugggggccggaaccagacacguugcuguggaacccgaggucgccaaucuugacaucauuggccagcgcaucgaaaacaucaagaaugagcauaaaagcaccuggcacuaugaugaagacaaccccuacaagacaugggcuuaucacgggucuuacgaggugaagccuuccggaagcgccucuuccauggugaauggcgucguuagacugcucacgaaacccugggaugugauuccuauggugacccaaaucgcuaugacagacaccacaccguuuggccagcagcgggucuucaaggagaaaguggacacccgcacacccagagccaagcgggggaccacgcagauuauggaaguuaccgcgaaauggcuguggggauuucuuagcagaaacaagaagccucggaucuguacacgcgaggaguucaccagaaaagugcgguccaaugccgcuauuggcgccgucuuuguggaugagaaccaauggaauagcgcuaaggaagccguugaggacgagcgcuucugggaucuggugcauagagaacgggagcuccacaaacaggggaagugcgccacaugcgucuauaacaugaugggaaaacgcgaaaagaagcugggcgaguuugggaaagcgaagggcucuagagcuaucugguacauguggcugggagcccgguuccucgaguucgaggcccugggcuuuaugaaugaggaccauugguucagccgcgaaaacucccuuucugggguggagggagaaggccugcacaaacucggguacauccugagagauauuagcaagauccccggaggcaauauguaugcugacgauaccgccgggugggacacgcggauuacagaggaugaccuucagaacgaggcuaaaaucaccgauauuauggaaccugagcaugcccugcucgcgacauccaucuuuaagcugaccuaccagaauaaaguugugcgcguccaaagacccgccaagaacggcacggugauggacgucaucucucggcgcgaucagagaggaagcggccagguggggaccuauggacugaacacauucaccaauauggaaguucagcucauucggcaaauggaguccgaaggcaucuuucugccgucugagcuugagacaccuaaccuggcugaaagagugcucgacuggcuggagaagcacggggccgaacgccuuaaacggauggcuauuagcggagacgauugugucgugaagcccaucgacgauagauucgccaccgcgcugacagcccucaaugacaugggcaaagugcgcaaggauauuccucagugggagcccuccaaaggguggaacgacuggcagcagguuccuuuuugcagccaccauuuccaccaacugaucaugaaggauggccgggaaaucgugguccccuguagaaaucaggacgagcuggugggacgcgcucggguuucucagggcgccggguggucccucagagagaccgcuugccugggaaagagcuacgcccaaauguggcagcuuauguauuuucaucgccgggaucugagacucgcugccaacgcgauuuguucugccgugccggucgacugggugccuacgucccgcacaaccuggagcauccacgcucaccaucaguggaugaccacagaagauaugcuguccgucuggaaucggguguggauugaggaaaaccccuggauggaggacaaaacccacguuucuagcugggaagaggugcccuaccuuggcaagagagaggaccaguggugcgggucccugaucggacucacagcccgggccacgugggcuaccaauauucaagucgccaucaaccaggugagacgccugauuggcaaugaaaacuaucuggauuacaugaucagcaugaaacgguucaagaaugagucugacccugaaggggcgcucugguga

SEQ ID NO: 18676 - RNA, 9879 nt, Artificial Sequence
  derived and/or modified CDS sequence (opt5) from DENV-1__JN819402__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauugugucucuguucccucucugucuguccacaacgagccagaaaaccacauggcuuccgguccugcuggggucuuuuggaugcaagccccucaccauguuccugaucacagaaaauaagauuuggggccggaaauccuggccucuuaacgagggcaucauggccauugggaucguuagcauccugcucucuucccugcucaagaaugacgugccccuggcgggaccucuuauugccggcgggaugcugaucgcuuguuaugugauuagcggauccagcgccgaucugucucucgagaaagcugccgaagucagcugggagcaagaagccgagcauuccggcaccucucacaacauccugguggaaguucaggacgaugggacgaugaagauuaaagacgaggagcgcgaugacacccuuacaauccugcucaaggcuacccugcucgcggugagcggagucuaccccauguccaucccugccacacuguuugugugguauuucuggcagaaaaagaagcagagaucuggcguucuuugggauacccccagcccgccugaaguggagcgggcuguccuggacgauggcauuuaccgcauccugcaaagagggcuccugggacggucccaggugggcgucgggguguuccaggacggaguuuuucauacaauguggcacgugacgcgcggcgccguccuuauguaucaggggaaaagacuggaacccucuugggccagcgugaagaaagaccucauuuccuacggaggcggcuggcgguuccaagggagcuggaauaccggagaggagguucaggugaucgcugucgaaccuggcaagaaccccaaaaaugugcagacaaccccggggaccuuuaagacaccugagggagaagugggcgccauugcgcuggauuucaagcccgggacgucuggauccccuaucguuaacagagagggcaaaauugucggccucuacgggaauggaguggugaccacaagcggcaccuaugucucugcuaucgcccaagccaaggcuucccaggaagggccccugcccgagaucgaggacgaaguguuuaaaaagcgcaaccuuacaauuauggaucugcacccuggaagcggcaaaacccggagauaccugccggccaucguucgcgaggcgauuaagcggaagcucagaacgcugauccuugcucccacacgcguggucgccuccgaaauggccgaggcucugaaagggaugccuauucgguaucagaccaccgccgugaagucugaacauacaggcagagagaucguugaccucaugugccacgcuaccuucacaaugcgccugcugagccccgugcgggucccuaauuacaacaugaucauuauggaugaggcccauuuuaccgaccccgcguccaucgccgcuagaggauauauuagcacgcgggugggcaugggggaagccgcugccaucuucaugacagccaccccuccgggaucuguugaggcuuuuccccaguccaaugcggugauucaagaugaagagcgcgacaucccugaaagaagcuggaacucuggcuacgauuggaucacagacuuccccgggaaaaccgucugguuugugccuagcauuaaguccggaaaugauaucgccaacugucuccggaaaaacggcaagcgcgugauucagcuuucuagaaagacguucgacaccgaguaucagaaaacaaagaauaacgacugggauuacgucguuaccacagacaucagcgagaugggggcuaauuuccgggccgauagagugauugacccccgccggugccugaaaccggugauccugaaggauggcccugaaagagucauucucgccggacccaugcccgugaccguugcuuccgccgcgcagcgccggggcagaaucgggcgcaaccaaaauaaagagggagaccaguacguguauaugggccagccucugaacaaugaugaagaccacgcucauuggacagaggccaagaugcuucuggauaacaucaauacccccgaggggauuaucccugcccucuuugaaccggagcgggaaaagucugcugccauugacggagaguacagacugcgcggcgaagcgagaaaaacguucgucgagcugaugcggcgcggggaucuccccguguggcuuagcuauaagguugccuccgagggcuuucaguacagcgacagacgguggugcuucgauggagaacgcaacaaucaagugcuggaggaaaacauggacgucgagaucuggacaaaagaaggcgagagaaagaaacugcggccuagauggcucgacgcucgcaccuauucugauccccuggcccuucgggaguuuaaggaauucgcugccgggagacgcuccgugagcggagaccugauucucgagaucggcaaacugccucagcaccugacccuccgggcucagaaugcccuugauaaccuggucaugcugcacaauuccgaacaggggggaaaggcguacagacaugccauggaggaacuccccgacacaaucgagacccugaugcuucuggcucucauugccgugcugacaggcggcguuacgcuguuuuuccucucugggaagggacuuggcaaaaccagcaucgggcugcugugugugacagcuuccucugcccuccuguggauggccagcguggagccgcacuggauugcugcguccaucauucuugaauuuuuccugaugguccuccugaucccugagcccgaucggcaacgcaccccucaggacaaccagcuggccuauguugugaucggacuccuuuuuaugauucugacaguggcugccaacgaaaugggccugcucgagaccacgaagaaagaucuggggaucggacaugucgccgcugagaaucaccaacacgccaccaugcuugacguggaucugagacccgcgagcgccuggacacucuacgcuguugccaccacagugauuaccccuaugaugcggcauacgaucgaaaacacaaccgcuaauauuucucugacagccaucgcgaaccaggccgcuauucugaugggccucgacaagggcuggcccaucuccaaaauggauaucggggucccgcuucuggcccugggaugcuacagccaggugaauccucucacccugaccgcugccguccuuaugcugguggcucacuaugccauuaucggccccgggcuccaggcgaaggccacacgcgaggcucaaaagagaacggccgcuggaauuaugaaaaaccccaccguugacggcaucguggccauugaucuggacccugucguguacgacgccaaguucgaaaaacagcuggggcagaucaugcuccuuauccuguguacaucucagauucugcucaugcggaccacaugggcgcugugcgaguccaucacccuugcuacgggaccgcugacaacccucugggaaggcagccccggcaaguuuuggaauaccacaauugccguuucuaugaccaacaucuuccgcgggagcuaucuggcuggagccggccuggccuucucccucaugaaaucucuugggggaggcagacgggggacaggagcucaaggcgagacgcugggcgagaaguggaagcgccagcugaaucagcucagcaaauccgaauuuaacaccuacaagagaagcgggauuauggagguggaucgguccgaagccaaagagggacugaagagaggcgaaacaaccaaacaugcggucucucgcgggacagccaagcuucggugguucguggagagaaaucuggugaagccugagggaaaaguuaucgaccucggcugugggcgcggaggcuggagcuauuacugcgcuggccugaagaaagucaccgaagugaagggguauacgaaaggaggccccgggcacgaggaaccuauccccauggccaccuacggauggaaccuggugaagcuccauuccggcaaagaugucuuuuucaugccuccggagaagugugacacacuucugugcgauauuggggaaucuagccccaauccuaccaucgaggagggacggacacugagaguucucaagaugguggaacccuggcugcgcggcaaccaguuuuguauuaaaauccuuaauccuuacaugcccuccguggucgagacccuggaacaaaugcagcggaagcacggcgggaugcucgugagaaacccgcugucucgcaauagcacacacgagauguauuggguuuccugcggaaccggcaacauugugagcgcugucaacaugacgucucggaugcugcucaauagauucacaauggcccaucgcaaaccuaccuacgagcgggacguggaucugggggcgggaaccagacacguugccguggaacccgaggucgcuaaccuugacaucauuggccagcgcaucgaaaauaucaagaacgagcauaaauccacauggcacuaugaugaagacaaucccuacaagacgugggccuaucacgggagcuacgaggugaagccuucuggauccgcuagcucuauggugaacggcgucguuagacugcucaccaaacccugggaugugauuccuauggugacacaaaucgccaugaccgacacaaccccguuuggccagcagcgggucuucaaggagaaaguggacacacgcacccccagagcuaagcgggggacgacccagauuauggaaguuacagccaaauggcuguggggauuucuuuccagaaauaagaagccucggaucuguacccgcgaggaauucacaagaaaagugcggagcaacgcggccauuggcgcugucuuuguggaugagaaucaauggaacuccgccaaggaagcuguugaggacgagcgcuucugggaucuggugcauagagaacgggagcuccacaaacaggggaagugcgccaccugcgucuauaauaugaugggaaaacgcgaaaagaagcugggcgaguuugggaaagccaagggcagcagagcgaucugguacauguggcugggagcucgguuccucgaauucgaggcccugggcuuuaugaacgaggaccauugguucucucgcgaaaauagccuuuccgggguggagggagaaggccugcacaaacucggguacauccugagagauauuucuaagauccccggaggcaacauguaugccgacgauacggcugggugggacacacggauuaccgaggaugaccuucagaaugaggccaaaaucacagauauuauggaaccugagcaugcucugcucgccaccagcaucuuuaagcugacguaccagaacaaaguugugcgcguccaaagacccgcgaagaacggcaccgugauggacgucaucucccggcgcgaucagagaggaucuggccagguggggacauauggacugaauaccuucacaaacauggaaguucagcucauucggcugauggagagcgaaggcaucuuucuuccguccgagcuggagaccccuaaucucgccgaaagagugcuggacuggcuugagaagcacggggcugaacgccugaaacggauggccauuucuggagacgauugugucgugaagcccaucgacgauagauucgcuacagcccucaccgcgcugaacgacaugggcaaagugcgcaaggauauuccucaaugggagcccagcaaaggguggaaugacuggcagcagguuccuuuuugcucccaccauuuccaccagcugaucaugaaggauggccgggaaaucgugguccccuguagaaaccaagacgagcucgugggacgcgcccggguuagccagggcgcuggguggucucugagagagacggccugccuuggaaaguccuacgcucagauguggcaacugauguauuuucaucgccgggaucucagacuggccgcuaaugccauuuguagcgcggugccggucgacugggugccuacaucucgcaccaccugguccauccacgcccaccaucaguggaugacaaccgaagauaugcuuagcgucuggaaccggguguggauugaggaaaaucccuggauggaggacaaaacacacguuuccucuugggaagaggugcccuaccugggcaagagagaggaccaguggugcgggagccucaucggacugacggcucgggccaccugggccacaaacauucaggucgcuaucaaucaagugagacgccugauuggcaacgaaaauuaucucgauuacaugaccuccaugaaacgguucaagagcgagucugacccugaaggggcccugugguga

SEQ ID NO: 18677 - RNA, 9879 nt, Artificial Sequence
  derived and/or modified CDS sequence (opt5) from DENV-1__FJ850113__SS-prME
agcgugaccaugcugcucaugcugcuucccacagcucuggcuuuccaccucacgaccagaggcggggaaccucauaugaucgucuccaagcaggaacggggaaagucucugcuuuuuaagacaagcgcuggcguuaacaugugcacccugauugcgauggaccucggggagcugugugaagauacaaugaccuacaagugcccccagaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagaacaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccgcccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaaacuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggugcucagcauugucucucuguucccucucugucuguccacaacgagccagaaaaccacauggcuuccgguucugcuggggucuuuuggaugcaagccccucaccauguuccugaucacagaaaauaagauuuggggccggaaauccuggccucuuaacgagggcaucauggcuauugggaucgugagcauccugcucucuucccugcucaagaaugacgugccccuggccggaccucuuauugcgggcgggaugcugaucgccuguuaugucauuagcggauccagcgcugaucugucucucgagaaagccgcugaagugagcugggagcaagaagccgagcauuccggcaccucucacaacauccugguugaagugcaggacgaugggacgaugaagauuaaagacgaggagcgcgaugacacccuuacaauccugcucaaggccacccugcucgcugucagcggaguguaccccauguccaucccugcgacacuguuuguuugguauuucuggcagaaaaagaagcagagaucuggcgugcuuugggauacccccagcccgccugaagucgagcgggccgugcuggacgauggcauuuaccgcauccugcaaagagggcuccugggacggucccaggucggcguggggguuuuccaggacggaguguuucauacaauguggcacgucacgcgcggcgcugugcuuauguaucaggggaaaagacuggaacccucuugggccagcguuaagaaagaccucauuuccuacggaggcggcuggcgguuccaagggagcuggaauaccggagaggaggugcaggucaucgccguggaaccuggcaagaaccccaaaaaugugcagacaaccccggggaccuuuaagacaccugagggagaaguuggcgcuauugcccuggauuucaagcccgggacgucuggauccccuaucgucaacagagagggcaaaauugugggccucuacgggaauggaguggucaccacaagcggcaccuaugugucugcgaucgcucaagccaaggccucccaggaagggccccugcccgagaucgaggacgaaguuuuuaaaaagcgcaaccuuacaauuauggaucugcacccuggaagcggcaaaacccggagauaccugccggcuaucgugcgcgaggccauuaagcggaagcucagaacgcugauccuugcgcccacacgcgucguggcuuccgaaauggccgaggcccugaaagggaugccuauucgguaucagaccaccgcuguuaagucugaacauacaggcagagagaucguggaccucaugugccacgccaccuucacaaugcgccugcugagccccguccgggugccuaauuacaacaugaucauuauggaugaggcucauuuuaccgaccccgccuccaucgcggccagaggauauauuagcacgcggguuggcaugggggaagcugccgcuaucuucaugacagccaccccuccgggaucuguggaggccuuuccccaguccaaugcugucauucaagaugaagaacgcgacaucccugaaagaagcuggaacucuggcuacgauuggaucacagacuuccccgggaaaaccgugugguuugugccuagcauuaaguccggaaaugauaucgcgaacugucuccggaaaaacggcaagcgcgucauucagcuuucuagaaagacguucgacaccgaguaucagaaaacaaagaauaacgacugggauuacguugugaccacagacaucagcgagaugggggccaauuuccgggcugauagagugauugacccccgccggugccugaaaccggucauccugaaggauggcccugaaagagugauucucgccggacccaugcccguuaccguggccuccgcugcccagcgccggggcagaaucgggcgcaaccaaaauaaagagggagaccaguacgucuauaugggccagccucugaacaaugaugaagaccacgcgcauuggacagaggcuaagaugcuucuggauaacaucaauacccccgaggggauuaucccugcccucuuugaaccggagcgggaaaagucugccgcuauugacggagaguacagacugcgcggcgaagccagaaaaacguucguggagcugaugcggcgcggggaucuccccguuuggcuuagcuauaagguggcguccgagggcuuucaguacagcgacagacgguggugcuucgauggagaacgcaacaaucaaguccuggaggaaaacauggacguggagaucuggacaaaagaaggcgagagaaagaaacugcggccuagauggcucgacgcccgcaccuauucugauccccuggcccuucgggaguuuaaggaguucgccgcugggagacgcuccgucagcggagaccugauucucgagaucggcaaacugccucagcaccugacccuccgggcccagaaugcucuugauaaccuggugaugcugcacaauuccgaacaagggggaaaggccuacagacaugcgauggaggaacuccccgacacaaucgagacccugaugcuucuggcccucauugcuguucugacaggcggcgugacgcuguuuuuccucucugggaagggacuuggcaaaaccagcaucgggcugcugugugugacagccuccucugcucuccuguggauggccagcgucgagccgcacuggauugccgcuuccaucauucuugaauuuuuccugaugguucuccugaucccugagcccgaucggcaacgcaccccucaggacaaccagcuggcguauguggugaucggacuccuuuuuaugauucugacagucgccgcuaacgaaaugggccugcucgagaccacgaagaaagaucuggggaucggacauguggccgccgagaaucaccaacacgcuaccaugcuugacguugaucugagacccgccagcgcguggacacucuacgccguggcuaccacagucauuaccccuaugaugcggcauacgaucgaaaacacaaccgccaauauuucucugacagcuaucgccaaccaggcggccauucugaugggccucgacaagggcuggcccaucuccaaaauggauaucggggugccgcuucuggcucugggaugcuacagccaggucaauccucucacccugaccgccgcugugcuuaugcugguugcccacuaugcuauuaucggccccgggcuccaggccaaggcgacacgcgaggcccaaaagagaacggcugccggaauuaugaaaaaccccaccguggacggcaucgucgcuauugaucuggacccugugguuuacgacgccaaguucgaaaaacagcuggggcagaucaugcuccuuauccuguguacaucucagauucugcucaugcggaccacaugggcccugugcgaguccaucacccuugcgacgggaccgcugacaacccucugggaaggcagccccggcaaguuuuggaauaccacaauugcugugucuauggccaacaucuuccgcgggagcuaucuggcuggagccggccuggccuucucccucaugaaaucucuugggggaggcagacgggggaccggagcucaaggcgagacacugggcgagaaguggaagcgccagcugaaucagcucagcaaauccgaauuuaacacguacaagagaagcgggauuauggaggucgaucgguccgaagccaaagagggacugaagagaggcgaaaccacaaaacaugcggugucucgcgggaccgccaaacuucggugguucguggagagaaaucugguuaagccugagggaaaagucaucgaccucggcugugggcgcggaggcuggagcuauuacugcgcuggccugaagaaagugacagaagugaagggguauaccaaaggaggccccgggcacgaggaaccuauccccauggccacguacggauggaaccuggucaagcuccauuccggcaaagauguguuuuucaugccuccggagaagugugacacccuucugugcgauauuggggaaucuagccccaauccuacaaucgaggagggacggacccugagaguucucaagaugguggaacccuggcugcgcggcaaccaguuuuguauuaaaauccuuaauccuuacaugcccuccgucguggagacacuggaacaaaugcagcggaagcacggcgggaugcucguuagaaacccgcugucucgcaauagcacccacgagauguauuggguguccugcggaacaggcaacauugucagcgcugugaacaugaccucucggaugcugcucaauagauucacgauggcccaucgcaaaccuacauacgagcgggacguugaucugggggcgggaaccagacacguggccgucgaacccgagguggcuaaccuugacaucauuggccagcgcaucgaaaauaucaagaacgagcauaaauccaccuggcacuaugaugaagacaaucccuacaagacaugggccuaucacgggagcuacgaggugaagccuucuggauccgcuagcucuauggucaacggcguugugagacugcucacgaaacccugggaugugauuccuauggucacccaaaucgccaugacagacaccacaccguuuggccagcagcggguguucaaggagaaaguugacacccgcacacccagagcuaagcgggggaccacgcagauuauggaagugaccgccaaauggcuguggggauuucuuuccagaaauaagaagccucggaucuguacacgcgaggaguucaccagaaaaguccggagcaacgcggccauuggcgcuguguuuguugaugagaaucaauggaacuccgccaaggaagcuguggaggacgagcgcuucugggaucugguccauagagaacgggagcuccacaaacaggggaagugcgccacaugcguguauaauaugaugggaaaacgcgaaaagaagcugggcgaguuugggaaagccaagggcagcagagcgaucugguacauguggcugggagcucgguuccucgaguucgaggcccugggcuuuaugaacgaggaccauugguucucucgcgaaaauagccuuuccgggguugagggagaaggccugcacaaacucggguacauccugagagauauuucuaagauccccggaggcaacauguaugccgacgauaccgcugggugggacacgcggauuacagaggaugaccuucagaaugaggccaaaaucaccgauauuauggaaccugagcaugcucugcucgccacaagcaucuuuaagcugaccuaccagaacaaagugguccgcgugcaaagacccgcgaagaacggcacggucauggacgugaucucccggcgcgaucagagaggaucuggccagguugggaccuauggacugaauacauucaccaacauggaagugcagcucauucggcugauggagagcgaaggcaucuuucuuccguccgagcuggagacaccuaaucucgccgaaagaguccuggacuggcuugagaagcacggggcugaacgccugaaacggauggccauuucuggagacgauuguguggugaagcccaucgacgauagauucgcuaccgcccucacagcgcugaacgacaugggcaaaguucgcaaggauauuccucaaugggagcccagcaaaggguggaaugacuggcaacaggugccuuuuugcucccaccauuuccaccagcugaucaugaaggauggccgggaaaucgucgugcccuguagaaaccaagacgagcucguuggacgcgcccgggugagccagggcgcuggguggucucugagagagaccgccugccuuggaaaguccuacgcucagauguggcaacugauguauuuucaucgccgggaucucagacuggccgcuaaugccauuuguagcgcggucccgguggacugggucccuacgucucgcacaaccugguccauccacgcccaccaucaguggaugaccacagaagauaugcuuagcguguggaaccggguuuggauugaggaaaaucccuggauggaggacaaaacccacguguccucuugggaagagguccccuaccugggcaagagagaggaccaguggugcgggagccucaucggacugacagcucgggccacgugggccaccaacauucagguggcuaucaaucaaguuagacgccugauuggcaacgaaaauuaucucgauuacaugacauccaugaaacgguucaagagcgagucugacccugaaggggcccugugguga

SEQ ID NO: 18678 - RNA, 9879 nt, Artificial Sequence
  derived and/or modified CDS sequence (opt5) from DENV-1__JF937635__SS-prME
agcgugaccaugcugcucaugcugaugcccacagcccuugcuuuccaccugacgaccagaggcggggagccucauaugaucgucuccaagcacgaacggggaaaagcccuccuguuuaagacaucuaccggcguuaacaugugcacacuuauugcgauggaccugggggagcucugugaagauaccaugacauacaaaugcccgcgcaucaccgaggcugaacccgacgauguggacuguuggugcaaugccacggauaccugggugacauauggaaccuguagccagacaggcgagcauagacgggacaagcgcuccgucgcccuggcuccucacguggggcugggacucgagaccagaacggaaacauggaugucuagcgagggcgccuggaaacaaauucagcggguugaaaccugggcucugcgccaucccggcuucacagugaucgcccuuuuucuggcgcacgccauugggaccuccaucacccagaagggaaucauuuucauccuccugaugcuugucacaccuucuauggcuaugagaugcgugggcauugggaaccgggauuuuguugagggacugagcggcgccacguggguggacgucgugcucgagcacggguccugugugaccacaauggcuaagaauaaacccacccuggauaucgaacugcucaagacagaggucaccaacccugccguucugcgcaaacuuugcauugaagcgaagaucagcaauacgacaaccgacucuagauguccgacccagggagaggccacacugguggaagagcaagaugcuaacuucgugugccggcgcaccuuugucgacagaggcuggggcaauggguguggacucuucggcaaagggucccugcuuacaugcgccaaguuuaagugcgugacgaaacuggagggaaagauuguucaguacgaaaaccucaaauauagcgugaucgucaccgugcauacaggcgaucagcaccagguugggaaugagaccacagaacauggaaccaucgcuacgauuaccccccaagccccuacaucugagauccagcugaccgacuacggcgcccugacacucgacuguuccccccggaccggccuggauuucaacgaaauggugcuucugacgaugaaggagaaaagcuggcucguccacaagcagugguuucuggaccuuccucugcccuggacaucuggggcuuccaccagccaggagacauggaaucgccaagaucuccuggugaccuucaaaaccgcgcacgccaagaagcaggaagucgugguucugggaucccaggagggcgcuaugcauacagcccucacgggggccaccgaaauucaaacaucuggaaccacaaccaucuuugcuggccaccugaaaugcagacuuaagauggacaaacugacgcucaaggggacaagcuaugugauguguaccggcuccuucaaacuggagaaggaagucgccgagacccagcauggaacagugcugguucaggugaaguacgagggcaccgaugcgccgugcaaaauuccuuucagcacacaggacgaaaagggggucacgcaaaacggacggcuuaucaccgcuaaucccaucgugacagauaaagagaagccugugaacauugaaaccgagccccccuuuggcgagucuuauaucguugucggggccggagaaaaagcccucaagcuguccugguucaagaaaggcagcucuauugggaagauguuugaggcuacagccagaggcgcucgccggauggccauccugggagacaccgcgugggauuucggcagcauugggggaguguuuacguccgugggcaaacucguccaccagguguucgggaccgccuacggaguucuguuuucuggcgugagcuggacaaugaagaucgggaucggcauucuucugaccuggcucggacugaauuccagaagcacaucucuguccaugaccuguaucgcugucggcauggugacacuuuaccucgggguuauggugcaggccgacagcggaugcgucauuaacuggaaaggccgcgaacugaagugugggucuggaaucuucgugaccaacgagguucauacguggacagaacaguauaaguuucaagcugauuccccuaaacggcugagcgccgcgauuggcaaggccugggaggagggggugugcggcaucagauccgcuacccgccucgaaaauauuauguggaaacagaucucuaacgagcugaaucacauccuucuggaaaacgacaugaaguucaccgucguggugggagacgccaauggcauucucgcucaggggaaaaagaugauccggccgcagcccauggagcacaaauacagcuggaaguccuggggaaaggccaaaauuaucggcgccgauauucaaaacacaaccuuuaucaucgacgggccugauacgcccgaauguccugacgaucagagagcuuggaauauuugggaggucgaggacuauggauucggcaucuuuacaaccaacauuuggcugaagcugcgcgauucuuacacacagaugugcgaccaucggcuuaugagcgcggccaucaaagauuccaaggcuguucacgccgacaugggcuauuggauugaaagcgagaaaaaugaaaccuggaagcucgccagagcuucuuucaucgaggugaagacauguaccuggcccaaaucccauacgcuguggagcaacggggugcuggaaucugagaugaucauuccgaagaucuacggaggcccuauuucccagcacaauuaucgccccggguacuucacccaaacagccggaccuuggcaccucggcaaacuggagcuugauuuugaccugugcgaagggaccacagucgugguugaugagcauugcggaaaccggggccccagccucagaaccacgacagugaccggcaagaucauucacgaaugguguugccggucuuguacacugccuccccugcgcuucagaggggaggacggaugcugguacggcauggagauccggccggucaaagaaaaggaggaaaaucuugugagaagcaugguuuccgcggggagcggagagguggacucuuuuucccucggcauccugugugucagcauuaugaucgaagaggugaugcgcucccgguggucuagaaagaugcugaugaccgggacccucgcuguuuuccugcuucugauuaugggacagcucacauggaacgaucugauccgccugugcauuauggugggcgccaaugccagcgacagaaugggcauggggacgaccuaucuugcucugauggccacauuuaaaaugcggccuauguucgcggucggaauccucuuucgcagacugaccucccgggaggugcuccugcuuacaauuggccugucucucguggcuagcgucgaacugcccaacucccuggaggaacuuggggauggacuggccaugggcaucaugaugcucaagcugcucaccgaguuccagccccaucaacuguggacgacacuucugucucucaccuuuaucaaaaccacacugagccuggacuacgccuggaagaccacagcuauggcccuuuccauuguuagccuguucccucucugucugucuacgaccucccagaaaacaaccuggcucccggugcugcuugggagcuuuggaugcaagccccugacaauguuccugaucaccgaaaacaagauuuggggccgcaaaucuuggccuaucaaugagggcauuauggcuaucgggaucguguccauucuccugagcucucuucugaagaacgaugucccccucgccggaccucugaucgcgggcgggaugcucauugccuguuaugugaucuccggaagcuccgcugaccugagccuugagaaagccgcugaaguuucuugggagcaggaagccgagcacagcggcacgucccauaauauucugguggaaguccaggaugacgggaccaugagaaucaaggaugaggagaaagacgauacacugaccauccuccugaaggccacacuucuggcugugucuggaguuuaccccaugagcauuccugcgacccucuuugugugguauuucuggcaaaaaaagaagcagcgguccggcguccugugggacacacccucuccgccugaaguggagcgcgccguccucgaugacggcaucuacagaauucugcagcgggggcuucugggacgcagccaggugggcguugggguguuccaagacggagucuuucacacgauguggcacgugaccagaggcgcuguucugauguaucaggggaaacggcucgaacccuccugggccucugugaagaaagaucugaucagcuacggaggcggcuggagauuccagggguccuggaacacaggagaggagguccaggugauugccguggaaccuggcaagaaucccaaaaacguucaaaccaccccggggacauuuaagacgagcgagggagaagucggcgcuaucgcccuugacuucaagccugggaccucuggaucccccauugugaaucgcgagggcaaaaucgugggccuguacgggaacggagucgugacaaccagcggcacauauguuucugcgaucgcucaggccaagaccucccaggaagggccuccccccgagauugaggaugaaguguuuaaaaagcggaaucucacgaucauggaccugcauccuggaagcggcaaaacaagacgcuaccucccggccauuguccgggaggcuaucaagagaaagcugcgcacccuuauucuggcccccacccgggugguugcguccgaaauggcugaggcccugaaagggaugccuaucagauaucaaacaaccgccgugaagucugaacacacaggccgcgagaucgucgaucucaugugccaugcuaccuucacgaugcggcugcuuagccccgugagaguuccuaacuacaauaugauuaucauggacgaggcccacuuuacagaucccgcuuccauugccgcgcggggauauaucagcacccgcgugggcaugggggaagccgcugccauuuucaugacagcuaccccuccgggaucugucgaggccuuuccccaguccaacgccgugauccaggacgaagagagagauaucccugaacggagcuggaauucuggcuacgacuggauuacggauuuccccgggaaaaccgugugguuugucccuagcaucaaguccggaaacgacauugcuaauugucugcgcaaaaacggcaagagaguuauccagcucucucggaagacauucgacaccgaguaucaaaaaacaaagaacaaugauugggacuacguggugaccacagauauuagcgagaugggggcgaacuucagagccgaccgcgucaucgauccccggagaugccugaaaccggugauucugaaggacggcccugaacgcguuauccucgcuggacccaugcccgugaccgucgccuccgccgcucagcggagaggccgcaucgggcggaaucagaacaaagagggagaucaguacguguauaugggccaaccucuuaauaacgacgaagaucaugcccacuggacggaggcgaagaugcugcuggacaauauuaacacacccgaggggaucauuccugcucucuuugaaccggagagagaaaagucugccgccaucgauggagaguaccgccugagaggcgaagcucggaaaaccuucguugagcuuaugcgcagaggggaccugcccguguggcucagcuauaaggucgccuccgagggcuuucaguacagcgaucggcgcuggugcuucgacggagaaagaaauaaccaggugcuggaggaaaauauggacgucgagauuuggaccaaagaaggcgagcggaagaaacugagaccucgcuggcucgaugcgcggacauauucugacccccuugcccugagagaguuuaaggaauucgcugccgggcgccgguccgugagcggagaucugauccucgagaucggcaaacugccucagcaccuuacccugagagcucaaaacgcccucgacaaucugguuaugcugcauaacuccgaacaggggggaaaggcuuaccggcacgccauggaggaacuccccgauacaauugagacgcuuaugcugcuggcgcucaucgccgugcugaccggcggcgugacacuuuuuuuccugucugggaagggacucggcaaaaccagcauugggcugcugugugucacagcuuccucugcccuccuuuggauggcuagcguugagccgcauuggaucgccgccuccauuauccuggaauuuuuccugauggugcuccugaucccugagcccgaccgccagagaaccccucaggauaaucaacuugcuuauguggucauuggacugcucuuuaugauccugacgguggcggccaacgaaaugggccugcucgagaccacaaagcgggaccuugggauuggacacguugcugccgagaaccaccagcaugccaccaugcuggauguggaccugcgccccgcuagcgccuggacacucuacgcggucgccaccacggugaucacaccuaugaugagacacaccauugaaaauacaaccgcuaacaucucucugaccgccauugcuaaucaggccgcgauccuuaugggccuggauaaaggcuggcccaucuccaagauggacauuggggucccgcuccuggcccugggaugcuacagccaagugaacccucucacacuuacggcugccguucugaugcugguggcucauuaugccaucauuggccccgggcuccaggcuaaagccacccgggaggcgcagaagcgcacagccgcuggaaucaugaagaaucccaccgucgauggcauuguggccaucgaccuggacccuguuguguacgaugcuaaauucgaaaagcagcuugggcaaaucaugcugcucauucuguguacaucucagauccugcucaugagaaccacgugggcccuuugcgaguccauuacacuggccaccggaccgcugaccacacucugggaaggcagccccggcaaauuuuggaacaccacaaucgcggucucuauggcuaauauuuuccgggggagcuaucuggccggagcuggccuugccuucucccugaugaagucucucgggggaggccgcagagggacgggagcccagggcgagacccugggcgagaaauggaagcggcagcugaaccaacucagcaagccugaauuuaauacauacaaaagauccgggaucauggagguggaccgcagcgaagcuaaggagggacuuaaacggggcgaaaccacaaagcacgccguguccagagggaccgcgaaacugcgcugguucguugagcggaaccuggucaagcccgagggaaaggugaucgaucucggcugugggagaggaggcuggucuuauuacugcgccggccugaaaaaggugacggaagucaaaggguauaccaagggaggcccugggcaugaggaacccauuccuauggcuacauacggauggaaucuuguuaaacugcacagcggcaaggacguguuuuucaugccgcccgagaaaugugauacccuccugugcgacaucggggaauccucuccuaaccccacaauugaggagggacgcacccugcgggugcucaagauggucgaaccuuggcuuagaggcaaucaguuuuguaucaagauucugaaccccuacaugccgagcgugguugagacacuggaacagaugcagcgcaaacacggcgggaugcucgugcggaauccucuguccagaaacucuacccaugagauguauugggucagcugcggaacgggcaauaucguguccgccguuaacaugacaagccgcaugcuucugaaccgguucaccauggcucacagaaagcccaccuacgagcgcgauguggaccucggggccggaacaagacaugucgcgguggaacccgagguggccaaucuggauauuaucggccaacggaucgaaaacauuaaaaaugagcacaagucuacguggcacuaugacgaagauaacccuuacaaaaccugggcuuaucauggguccuacgaggucaagcccagcggaucugccuccagcaugguuaauggcguggugcgccugcucacaaagccuugggacgucaucccgauggugacccagauugcuaugacagacaccacacccuuuggccagcaaagaguuuucaaagagaagguggauacccggacgccuagagccaaacgggggaccacacagaucauggaagucaccgcuaaguggcuguggggauuucuuucucgcaacaaaaagcccagaauuuguacacgggaggaauucacccgcaaggugagauccaaugccgcgaucggcgccguuuuuguggacgagaaccaguggaauagcgcuaaagaagccgucgaggaugagcgguucugggaccuggugcaccgcgaaagagagcuccauaagcaggggaaaugcgcuacgugcguuuauaacaugaugggaaagcgggaaaaaaagcugggcgaguuugggaaggccaaaggcucccgcgccaucugguacauguggcuuggagcgagauuccuggaauucgaggcucucggcuuuaugaaugaggaucacugguucagccgggaaaacucucugagcgggguggagggagaaggccugcauaagcucggguacauucugcgcgacaucuccaaaauuccuggaggcaauauguaugccgaugacacagccgggugggauaccagaaucacagaggacgaucuucaaaacgaggcuaagauuaccgacaucauggaacccgagcacgcccugcucgcuacgucuaucuuuaaacugaccuaccagaauaaggucgugcggguccagcgcccggccaaaaacggcacagugauggauguuauuagcagacgggaccagagaggauccggccaaguggggaccuauggacuuaacacauucaccaauauggaaguccagcugauccgccagauggagucugaaggcauuuuucucccuagcgagcuggagacacccaaccuggcggaacgggugcucgacuggcuggagaagcacggggccgaaagacuuaagcgcauggcuaucuccggagaugacugugugguuaaaccuauugaugaccgguucgccaccgcucugacggcccucaaugauaugggcaaggugagaaaagacaucccccagugggagccuucuaagggguggaacgauuggcaacagguccccuuuugcagccaucacuuccaucagcugaucaugaaagacggccgcgaaauugugguuccgugucggaaucaggaugagcuugugggaagagcgcgcgucucccaaggcgccggguggagccugcgggagacagcuugccucggaaagucuuacgcccagauguggcagcugauguauuuucacagacgcgaccugcggcucgcugccaacgcuaucuguuccgccgugccugucgauugggugcccaccagcagaaccacauggucuauucacgcgcaucaccaauggaugaccacagaagacaugcuguccguuuggaaucggguguggaucgaggaaaaccccuggauggaggacaagacgcaugucagcuccugggaagaggugccuuaccuuggcaaaagagaggaucaguggugcgggucucugauuggacucaccgcccgcgcuacaugggccaccaauauccagguugccauuaaccaggugcggagacugaucggcaaugaaaacuaucuugacuacaugacaagcaugaagcgcuucaaaaaugaguccgauccggaaggggcucugugguga

SEQ ID NO: 18679 - RNA, 9879 nt, Artificial Sequence
  derived and/or modified CDS sequence (opt5) from DENV-1__FJ024483__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuacacgcagaccgccggaccuuggcaccugggcaaacuugagcuggacuucgaucucugcgaagggacaaccguggucguggacgagcacugcggaaaucgcggccccucucugcggacaaccacgguuacaggcaagauuauccaugaaugguguugcagaagcuguacccugccuccccuucgguuucgcggggaggauggaugcugguauggcauggagaucagaccggugaaagaaaaggaggaaaaccucguccgguccauggugagcgcggggucuggagagguugacuccuucagccugggcauucugugugcuuccaucaugauugaagaggugaugagaucucgcuggagccggaagaugcucaugacagggacccuggccgucuuucuucugcucaucaugggacaacugaccuggaaugaccugauuagacuuugcaucauggugggcgccaacgcuuccgaucgcaugggcauggggacaacguaccuggcccucauggcgaccuucaaaaugagaccuauguuugcuguuggacugcucuuccggcgccugacaucuagagaggugcuucugcucaccauuggccugagccuggucgccuccguggaacuucccaacucucuggaggaacucggggacggacuggccaugggcaucaugaugcucaagcugcuuacagaguuucagccccaccagcuguggaccacgcuccugagccugacauucaucaaaaccacccuuucccuggauuaugcuuggaagacaaccgccauggcucucagcauugugucucuguuuccucucugucuguccacaacgagccagaaaaccacauggcuuccgguccugcuggggucuuucggaugcaagccccucaccauguuucugaucacagaaaauaagauuuggggccggaaauccuggccucuuaacgagggcaucauggccauugggaucguuagcauccugcucucuucccugcucaagaaugacgugccccuggcgggaccucuuauugccggcgggaugcugaucgcuuguuacgugauuagcggauccagcgccgaucugucucucgagaaagcugccgaagucagcugggagcaagaagccgagcauuccggcaccucucacaacauccugguggaaguucaggacgaugggacgaugaagauuaaagacgaggagcgcgaugacacccuuacaauccugcucaaggcuacccugcucgcggugagcggagucuaucccauguccaucccugccacacuguucgugugguacuuuuggcagaaaaagaagcagagaucuggcguucuuugggauacccccagcccgccugaaguggagcgggcuguccuggacgauggcauuuaucgcauccugcaaagagggcuccugggacggucccaggugggcgucgggguguuccaggacggaguuuuccauacaauguggcacgugacgcgcggcgccguccuuauguaccaggggaaaagacuggaacccucuugggccagcgugaagaaagaccucauuuccuacggaggcggcuggcgguuucaagggagcuggaauaccggagaggagguucaggugaucgcugucgaaccuggcaagaaccccaaaaaugugcagacaaccccggggaccuucaagacaccugagggagaagugggcgccauugcgcuggauuuuaagcccgggacgucuggauccccuaucguuaacagagagggcaaaauugucggccucuaugggaauggaguggugaccacaagcggcaccuacgucucugcuaucgcccaagccaaggcuucccaggaagggccccugcccgagaucgaggacgaaguguucaaaaagcgcaaccuuacaauuauggaucugcacccuggaagcggcaaaacccggagauaucugccggccaucguucgcgaggcgauuaagcggaagcucagaacgcugauccuugcucccacacgcguggucgccuccgaaauggccgaggcucugaaagggaugccuauucgguaccagaccaccgccgugaagucugaacauacaggcagagagaucguugaccucaugugccacgcuaccuuuacaaugcgccugcugagccccgugcgggucccuaauuauaacaugaucauuauggaugaggcccauuucaccgaccccgcguccaucgccgcuagaggauacauuagcacgcgggugggcaugggggaagccgcugccaucuuuaugacagccaccccuccgggaucuguugaggcuuucccccaguccaaugcggugauucaagaugaagagcgcgacaucccugaaagaagcuggaacucuggcuaugauuggaucacagacuuucccgggaaaaccgucugguucgugccuagcauuaaguccggaaaugauaucgccaacugucuccggaaaaacggcaagcgcgugauucagcuuucuagaaagacguuugacaccgaguaccagaaaacaaagaauaacgacugggauuacgucguuaccacagacaucagcgagaugggggcuaauuuccgggccgauagagugauugacccccgccggugccugaaaccggugauccugaaggauggcccugaaagagucauucucgccggacccaugcccgugaccguugcuuccgccgcgcagcgccggggcagaaucgggcgcaaccaaaauaaagagggagaccaguauguguacaugggccagccucugaacaaugaugaagaccacgcucauuggacagaggccaagaugcuucuggauaacaucaauacccccgaggggauuaucccugcccucuucgaaccggagcgggaaaagucugcugccauugacggagaguauagacugcgcggcgaagcgagaaaaacguuugucgagcugaugcggcgcggggaucuccccguguggcuuagcuacaagguugccuccgagggcuuccaguauagcgacagacgguggugcuuugauggagaacgcaacaaucaagugcuggaggaaaacauggacgucgagaucuggacaaaagaaggcgagagaaagaaacugcggccuagauggcucgacgcucgcaccuacucugauccccuggcccuucgggaguucaaggaauuugcugccgggagacgcuccgugagcggagaccugauucucgagaucggcaaacugccucagcaccugacccuccgggcucagaaugcccuugauaaccuggucaugcugcacaauuccgaacaggggggaaaggcguauagacaugccauggaggaacuccccgacacaaucgagacccugaugcuucuggcucucauugccgugcugacaggcggcguuacgcuguucuuucucucugggaagggacuuggcaaaaccagcaucgggcugcugugugugacagcuuccucugcccuccuguggauggccagcguggagccgcacuggauugcugcguccaucauucuugaauucuuucugaugguccuccugaucccugagcccgaucggcaacgcaccccucaggacaaccagcuggccuacguugugaucggacuccuuuucaugauucugacaguggcugccaacgaaaugggccugcucgagaccacgaagaaagaucuggggaucggacaugucgccgcugagaaucaccaacacgccaccaugcuugacguggaucugagacccgcgagcgccuggacacucuacgcuguugccaccacagugauuaccccuaugaugcggcauacgaucgaaaacacaaccgcuaauauuucucugacagccaucgcgaaccaggccgcuauucugaugggccucgacaagggcuggcccaucuccaaaauggauaucggggucccgcuucuggcccugggaugcuauagccaggugaauccucucacccugaccgcugccguccuuaugcugguggcucacuacgccauuaucggccccgggcuccaggcgaaggccacacgcgaggcucaaaagagaacggccgcuggaauuaugaaaaaccccaccguugacggcaucguggccauugaucuggacccugucguguaugacgccaaguuugaaaaacagcuggggcagaucaugcuccuuauccuguguacaucucagauucugcucaugcggaccacaugggcgcugugcgaguccaucacccuugcuacgggaccgcugacaacccucugggaaggcagccccggcaaguucuggaauaccacaauugccguuucuauggcuaacaucuuucgcgggagcuaccuggccggagccggccuggcuuucucccucaugaaaucucuugggggaggcagacgggggaccggagcccaaggcgagacacugggcgagaaguggaagcgccagcugaaucagcucagcaaauccgaauucaacacguauaagagaagcgggauuauggagguggaucgguccgaagcgaaagagggacugaagagaggcgaaaccacaaaacaugccgucucucgcgggaccgcuaagcuucggugguuuguggagagaaaucuggugaagccugagggaaaaguuaucgaccucggcugugggcgcggaggcuggagcuacuauugcgccggccugaagaaagucacagaagugaagggguacaccaaaggaggccccgggcacgaggaaccuauccccauggcuacguacggauggaaccuggugaagcuccauuccggcaaagaugucuucuuuaugccuccggagaagugugacacccuucugugcgauauuggggaaucuagccccaauccuacaaucgaggagggacggacccugagaguucucaagaugguggaacccuggcugcgcggcaaccaguucuguauuaaaauccuuaauccuuauaugcccuccguggucgagacacuggaacaaaugcagcggaagcacggcgggaugcucgugagaaacccgcugucucgcaauagcacccacgagauguacuggguuuccugcggaacaggcaacauugugagcgccgucaacaugaccucucggaugcugcucaauagauuuacgauggcgcaucgcaaaccuacauaugagcgggacguggaucugggggccggaaccagacacguugcuguggaacccgaggucgccaaccuugacaucauuggccagcgcaucgaaaauaucaagaacgagcauaaauccaccuggcacuacgaugaagacaaucccuauaagacaugggcuuaccacgggagcuaugaggugaagccuucuggauccgccagcucuauggugaacggcgucguuagacugcucacgaaacccugggaugugauuccuauggugacccaaaucgcuaugacagacaccacaccguucggccagcagcgggucuuuaaggagaaaguggacacccgcacacccagagccaagcgggggaccacgcagauuauggaaguuaccgcgaaauggcuguggggauuccuuuccagaaauaagaagccucggaucuguacacgcgaggaauuuaccagaaaagugcggagcaacgccgcuauuggcgccgucuucguggaugagaaucaauggaacuccgcuaaggaagccguugaggacgagcgcuuuugggaucuggugcauagagaacgggagcuccacaaacaggggaagugcgccacaugcgucuacaauaugaugggaaaacgcgaaaagaagcugggcgaguucgggaaagcgaagggcagcagagcuaucugguacauguggcugggagcccgguuucucgaauucgaggcccugggcuucaugaacgaggaccauugguuuucucgcgaaaauagcuucuccgggguggagggagaaggccuucacaaacugggguauauccucagagauauuucuaagauccccggaggcaacauguacgcugacgauaccgccgggugggacacgcggauuacagaggaugaccugcagaaugaggcuaaaaucaccgauauuauggaaccugagcaugcccuucuggcgacaagcaucuuuaagcucaccuaucagaacaaaguugugcgcguccaaagacccgccaagaacggcacggugauggacgucaucucccggcgcgaucagagaggaucuggccagguggggaccuacggacugaauacauucaccaacauggaaguucagcugauucggcaaauggagagcgaaggcaucuuucucccguccgagcuggagacaccuaaucuugcugaaagagugcuggacuggcucgagaagcacggggccgaacgccugaaacggauggcuauuucuggagacgauugugucgugaagcccaucgacgauagauucgccaccgcgcuuacagcccugaacgacaugggcaaagugcgcaaggauauuccucagugggagcccagcaaaggguggaaugacuggcagcagguuccuuuuugcucccaccauuuccaccaacucaucaugaaggauggccgggaaaucgugguccccuguagaaaccaggacgagcuggugggacgcgcucggguuagccagggcgccggguggucucugagagagaccgcuugccucggaaaguccuaugcccaaauguggcagcugauguacuuucaucgccgggaucuuagacuggcugccaaugcgauuuguagcgccgugccggucgacugggugccuacgucucgcacaaccugguccauccacgcucaccaucaguggaugaccacagaagauaugcucagcgucuggaaccggguguggauugaggaaaaucccuggauggaggacaaaacccacguuuccucuugggaagaggugcccuaucugggcaagagagaggaccaguggugcgggagccuuaucggacugacagcccgggccacgugggcuaccaacauucaagucgccaucaaucaggugagacgccucauuggcaacgaaaauuaccuggauuacaugacauccaugaaacgguucaagaacgagagcgacccugaaggggcgcugugguga

SEQ ID NO: 18680 - RNA, 9879 nt, Artificial Sequence
  derived and/or modified CDS sequence (opt5) from DENV-1__EU596504__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguuucgcugugggcauggucacccucuaccugggggugaugguucaagccgacucuggaugcgugauuaacuggaaaggcagagaacugaaguguggguccggaaucuuugucacaaacgaggugcacaccuggacggaacaguauaaguuccaggcugauagcccuaaacgccucuccgccgcgauuggcaaggccugggaggaggggguuugcggcauccggucugcuacaagacuggaaaauauuauguggaaacagaucagcaacgagcuuaaucauauccugcucgaaaacgacaugaaguuuaccguggucgugggagacgccaauggcauucuggcucaagggaaaaagaugauccgcccgcagcccauggagcacaaauacuccuggaagucuuggggaaaggccaaaauuaucggcgccgauauucagaacaccacauucaucaucgacgggccugauacccccgaauguccugacaaucagcgggcuuggaacauuugggagguggaggauuauggauuuggcaucuucacgacaaauauuuggcugaagcuuagagacagcuacacccaaaugugcgaucaccgccucauguccgcggccaucaaagacagcaaggcuguccaugccgauaugggcuauuggauugaaucugagaaaaacgaaacauggaagcuggcccgggcuuccuucaucgagguuaagaccuguacauggcccaaaagccacacccuguggucuaauggggugcucgaauccgagaugaucauuccgaagaucuacggaggcccuauuagccagcauaacuauagacccggguacuuuacgcagaccgccggaccuuggcaccugggcaaacuugagcuggacuucgaucucugcgaagggacaaccguggucguggacgagcacugcggaaaucgcggccccucucugcggacaaccacgguuacaggcaagaucauucaugaaugguguugcagaagcuguacccugccuccccuucgguuucgcggggaggauggaugcugguacggcauggagaucagaccggugaaagaaaaggaggaaaaccucguccgguccauggugagcgcggggucuggagagguugacuccuucagccugggcauccugugugcuuccauuaugaucgaagaggugaugagaucucgcuggagccggaagaugcucaugacagggacccuggccgucuuucuucugcucauuaugggacaacugaccuggaaugaccugaucagacuuugcauuauggugggcgccaacgcuuccgaucgcaugggcauggggacaacguaucuggcccucauggcgaccuucaaaaugagaccuauguuugcuguuggacugcucuuccggcgccugacaucuagagaggugcuucugcucaccaucggccugagccuggucgccuccguggaacuucccaacucucuggaggaacucggggacggacuggccaugggcauuaugaugcucaagcugcuuacagaguuucagccccaccagcuguggaccacgcuccugagccugacauucaucaaaaccacccuuucccuggauuacgcuuggaagacaaccgccauggcucucagcaucgugucucuguuuccucucugucuguccacaacgagccagaaaaccacauggcuuccgguccugcuggggucuuucggaugcaagccccucaccauguuucugauuacagaaaauaagaucuggggccggaaauccuggccucuuaacgagggcauuauggccaucgggauuguuagcauccugcucucuucccugcucaagaaugacgugccccuggcgggaccucuuaucgccggcgggaugcugauugcuuguuaugugaucagcggauccagcgccgaucugucucucgagaaagcugccgaagucagcugggagcaagaagccgagcauuccggcaccucucacaacauucugguggaaguucaggacgaugggacgaugaagaucaaagacgaggagcgcgaugacacccuuacaauucugcucaaggcuacccugcucgcggugagcggagucuaccccauguccaucccugccacacuguucgugugguauuucuggcagaaaaagaagcagagaucuggcguucuuugggauacccccagcccgccugaaguggagcgggcuguccuggacgauggcaucuaccgcauucugcaaagagggcuccugggacggucccaggugggcgucgggguguuucaggacggaguuuuccauacaauguggcacgugacgcgcggcgccguccuuauguaucaggggaaaagacuggaacccucuugggccagcgugaagaaagaccucaucuccuacggaggcggcuggcgguuucaagggagcuggaauaccggagaggagguucaggugauugcugucgaaccuggcaagaaccccaaaaaugugcagacaaccccggggaccuucaagacaccugagggagaagugggcgccaucgcgcuggauuuuaagcccgggacgucuggauccccuauuguuaacagagagggcaaaaucgucggccucuacgggaauggaguggugaccacaagcggcaccuaugucucugcuauugcccaagccaaggcuucccaggaagggccccugcccgagaucgaggacgaaguguucaaaaagcgcaaccuuacaaucauggaucugcacccuggaagcggcaaaacccggagauaccugccggccauuguucgcgaggcgaucaagcggaagcucagaacgcugauucuugcucccacacgcguggucgccuccgaaauggccgaggcucugaaagggaugccuauccgguaucagaccaccgccgugaagucugaacauacaggcagagagauuguugaccucaugugccacgcuaccuuuacaaugcgccugcugagccccgugcgggucccuaauuacaacaugaucaucauggaugaggcccauuucaccgaccccgcguccauugccgcuagaggauauaucagcacgcgggugggcaugggggaagccgcugccauuuuuaugacagccaccccuccgggaucuguugaggcuuucccccaguccaaugcggugauccaagaugaagagcgcgacauuccugaaagaagcuggaacucuggcuacgauuggaucacagacuuucccgggaaaaccgucugguucgugccuagcaucaaguccggaaaugauauugccaacugucuccggaaaaacggcaagcgcgugauccagcuuucuagaaagacguucgacaccgaguaucagaaaacaaagaauaacgacugggauuacgucguuaccacagacauuagcgagaugggggcuaauuuucgggccgauagagugaucgacccccgccggugccugaaaccggugauucugaaggauggcccugaaagagucauccucgccggacccaugcccgugaccguugcuuccgccgcgcagcgccggggcagaauugggcgcaaccaaaauaaagagggagaccaguacguguauaugggccagccucugaacaaugaugaagaccacgcucauuggacagaggccaagaugcuucuggauaacaucaauacccccgaggggaucauuccugcccucuucgaaccggagcgggaaaagucugcugccaucgacggagaguacagacugcgcggcgaagcgagaaaaacguuugucgagcugaugcggcgcggggaucuccccguguggcuuagcuauaagguugccuccgagggcuuccaguacagcgacagacgguggugcuuugauggagaacgcaacaaucaagugcuggaggaaaacauggacgucgagauuuggacaaaagaaggcgagagaaagaaacugcggccuagauggcucgacgcucgcaccuauucugauccccuggcccuucgggaguucaaggaauuugcugccgggagacgcuccgugagcggagaccugauccucgagauuggcaaacugccucagcaccugacccuccgggcucagaaugcccuugauaaccuggucaugcugcacaauuccgaacaggggggaaaggcguacagacaugccauggaggaacuccccgacacaaucgagacccugaugcuucuggcucucaucgccgugcugacaggcggcguuacgcuguucuuucucucugggaagggacuuggcaaaaccagcauugggcugcugugugugacagcuuccucugcccuccuguggauggccagcguggagccgcacuggaucgcugcguccauuauccuugaauucuuucugaugguccuccugauuccugagcccgaucggcaacgcaccccucaggacaaccagcuggccuauguugugaucggacuccuuuucaugauccugacaguggcugccaacgaaaugggccugcucgagaccacgaagaaagaucuggggauuggacaugucgccgcugagaaucaccaacacgccaccaugcuugacguggaucugagacccgcgagcgccuggacacucuacgcuguugccaccacagugaucaccccuaugaugcggcauacgauugaaaacacaaccgcuaauaucucucugacagccauugcgaaccaggccgcuauccugaugggccucgacaagggcuggcccauuuccaaaauggauaucggggucccgcuucuggcccugggaugcuacagccaggugaauccucucacccugaccgcugccguccuuaugcugguggcucacuaugccaucauuggccccgggcuccaggcgaaggccacacgcgaggcucaaaagagaacggccgcuggaaucaugaaaaaccccaccguugacggcauuguggccaucgaucuggacccugucguguacgacgccaaguuugaaaaacagcuggggcagauuaugcuccuuauccuguguacaucucagauccugcucaugcggaccacaugggcgcugugcgaguccauuacccuugcuacgggaccgcugacaacccucugggaaggcagccccggcaaguucuggaauaccacaaucgccguuucuauggcuaacauuuuccgcgggagcuaucuggccggagccggccuggcuuuuucccucaugaaaucucuugggggaggcagacgggggaccggagcccaaggcgagacacugggcgagaaguggaagcgccagcugaaucagcucagcaaauccgaauucaacacguacaagagaagcgggaucauggagguggaucgguccgaagcgaaagagggacugaagagaggcgaaaccacaaaacaugccgucucucgcgggaccgcuaagcuucggugguuuguggagagaaaucuggugaagccugagggaaaaguuauugaccucggcugugggcgcggaggcuggagcuauuacugcgccggccugaagaaagucacagaagugaagggguauaccaaaggaggccccgggcacgaggaaccuauccccauggcuacguacggauggaaccuggugaagcucuacuccggcaaagaugucuucuuuaugccuccggagaagugugacacccuucugugcgauaucggggaaucuagccccaauccuacaauugaggagggacggacccugagaauccucaagaugguugaacccuggcugcgcggcaaccaguucuguauuaaaauccuuaauccuuauaugcccuccgugguggagacacuggaacaaaugcagcggaagcauggcgggaugcucgucagaaacccgcugucucgcaauagcacccacgagauguacuggguguccugcggaacaggcaacauuguuagcgccgugaacaugaccucucggaugcugcucaauagauuuacgauggcgcaccgcaaaccuacauaugagcgggacgucgaucugggggccggaaccagacauguggcuguugaacccgagguggccaaccuugacaucauuggccagcgcaucgaaaauaucaagaacgagcacaaauccaccuggcauuacgaugaagacaaucccuauaagacaugggcuuaccacgggagcuaugaggucaagccuucuggauccgccagcucuauggugaacggcguggucagacugcucacgaaacccugggauguuauuccuauggugacccaaaucgcuaugacagacaccacaccguucggccagcagcggguguuuaaggagaaagucgacacccgcacacccagagccaagcgggggaccacgcagauuauggaagugaccgcgaaauggcuguggggauuccuuuccagaaauaagaagccucggaucuguacacgcgaggaauuuaccagaaaaguucggagcaacgccgcuauuggcgccguguucgucgaugagaaucaauggaacuccgcuaaggaagccguggaggacgagcgcuuuugggaucugguucacagagaacgggagcuccauaaacaggggaagugcgccacaugcguguacaauaugaugggaaaacgcgaaaagaagcugggcgaguucgggaaagcgaagggcagcagagcuaucugguacauguggcugggagcccgguuccucgaauuugaggcccugggcuucaugaacgaggaccacugguuuucucgcgaaaauagccuuuccggggucgagggagaaggccugcauaaacucggguauauccugagagauauuucuaagauccccggaggcaacauguacgcugacgauaccgccgggugggacacgcggauuacagaggaugaccuucagaaugaggcuaaaaucaccgauauuauggaaccugagcacgcccugcucgcgacaagcaucuucaagcugaccuaucagaacaaagugguucgcgugcaaagacccgccaagaacggcacggucauggacgugaucucccggcgcgaucagagaggaucuggccaggucgggaccuacggacugaauacauuuaccaacauggaagugcagcucauucggcaaauggagagcgaaggcaucuuccugccguccgagcuugagacaccuaaucuggcugaaagaguucucgacuggcuggagaagcauggggccgaacgccuuaaacggauggcuauuucuggagacgauuguguggucaagcccaucgacgauagauuugccaccgcgcugacagcccucaacgacaugggcaaagugcgcaaggauauuccucagugggagcccagcaaaggguggaaugacuggcagcaggugccuuucugcucccaccacuuucaucaacugaucaugaaggauggccgggaaaucguugugcccuguagaaaccaggacgagcuggucggacgcgcucgggugagccagggcgccggguggucucucagagagaccgcuugccugggaaaguccuaugcccaaauguggcagcuuauguacuuccaccgccgggaucugagacucgcugccaaugcgauuuguagcgccguuccgguggacugggucccuacgucucgcacaaccugguccauccaugcucaccaccaguggaugaccacagaagauaugcugagcguguggaaccgggucuggauugaggaaaaucccuggauggaggacaaaacccauguguccucuugggaagagguucccuaucuuggcaagagagaggaccaguggugcgggagccugaucggacucacagcccgggccacgugggcuaccaacauucaaguggccaucaaucaggucagacgccugauuggcaacgaaaauuaccuggauuacaugacauccaugaaacgguuuaagaacgagagcgacccugaaggggcgcucugguga

SEQ ID NO: 18681 - RNA, 9879 nt, Artificial Sequence
  derived and/or modified CDS sequence (opt5) from DENV-1__FJ024481__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauugugucucuguucccucucugucuguccacaacgagccagaaaaccacauggcuuccgguccugcuggggucuuuuggaugcaagccccucaccauguuccugaucacagaaaauaagauuuggggccggaaauccuggccucuuaacgagggcaucauggccauugggaucguuagcauccugcucucuucccugcucaagaaugacgugccccuggcgggaccucuuauugccggcgggaugcugaucgcuuguuaugugauuagcggauccagcgccgaucugucucucgagaaagcugccgaagucagcugggagcaagaagccgagcauuccggcaccucucacaacauccugguggaaguucaggacgaugggacgaugaagauuaaagacgaggagcgcgaugacacccuuacaauccugcucaaggcuacccugcucgcggugagcggagucuaccccauguccaucccugccacacuguuugugugguauuucuggcagaaaaagaagcagagaucuggcguucuuugggauacccccagcccgccugaaguggagcgggcuguccuggacgauggcauuuaccgcauccugcaaagagggcuccugggacggucccaggugggcgucgggguguuccaggacggaguuuuucauacaauguggcacgugacgcgcggcgccguccuuauguaucaggggaaaagacuggaacccucuugggccagcgugaagaaagaccucauuuccuacggaggcggcuggcgguuccaagggagcuggaauaccggagaggagguucaggugaucgcugucgaaccuggcaagaaccccaaaaaugugcagacaaccccggggaccuuuaagacaccugagggagaagugggcgccauugcgcuggauuucaagcccgggacgucuggauccccuaucguuaacagagagggcaaaauugucggccucuacgggaauggaguggugaccacaagcggcaccuaugucucugcuaucgcccaagccaaggcuucccaggaagggccccugcccgagaucgaggacgaaguguuuaaaaagcgcaaccuuacaauuauggaucugcacccuggaagcggcaaaacccggagauaccugccggccaucguucgcgaggcgauuaagcggaagcucagaacgcugauccuugcucccacacgcguggucgccuccgaaauggccgaggcucugaaagggaugccuauucgguaucagaccaccgccgugaagucugaacauacaggcagagagaucguugaccucaugugccacgcuaccuucacaaugcgccugcugagccccgugcgggucccuaauuacaacaugaucauuauggaugaggcccauuuuaccgaccccgcguccaucgccgcuagaggauauauuagcacgcgggugggcaugggggaagccgcugccaucuucaugacagccaccccuccgggaucuguugaggcuuuuccccaguccaaugcggugauucaagaugaagagcgcgacaucccugaaagaagcuggaacucuggcuacgauuggaucacagacuuccccgggaaaaccgucugguuugugccuagcauuaaguccggaaaugauaucgccaacugucuccggaaaaacggcaagcgcgugauucagcuuucuagaaagacguucgacaccgaguaucagaaaacaaagaauaacgacugggauuacgucguuaccacagacaucagcgagaugggggcuaauuuccgggccgauagagugauugacccccgccggugccugaaaccggugauccugaaggauggcccugaaagagucauucucgccggacccaugcccgugaccguugcuuccgccgcgcagcgccggggcagaaucgggcgcaaccaaaauaaagagggagaccaguacguguauaugggccagccucugaacaaugaugaagaccacgcucauuggacagaggccaagaugcuucuggauaacaucaauacccccgaggggauuaucccugcccucuuugaaccggagcgggaaaagucugcugccauugacggagaguacagacugcgcggcgaagcgagaaaaacguucgucgagcugaugcggcgcggggaucuccccguguggcuuagcuauaagguugccuccgagggcuuucaguacagcgacagacgguggugcuucgauggagaacgcaacaaucaagugcuggaggaaaacauggacgucgagaucuggacaaaagaaggcgagagaaagaaacugcggccuagauggcucgacgcucgcaccuauucugauccccuggcccuucgggaguuuaaggaauucgcugccgggagacgcuccgugagcggagaccugauucucgagaucggcaaacugccucagcaccugacccuccgggcucagaaugcccuugauaaccuggucaugcugcacaauuccgaacaggggggaaaggcguacagacaugccauggaggaacuccccgacacaaucgagacccugaugcuucuggcucucauugccgugcugacaggcggcguuacgcuguuuuuccucucugggaagggacuuggcaaaaccagcaucgggcugcugugugugacagcuuccucugcccuccuguggauggccagcguggagccgcacuggauugcugcguccaucauucuugaauuuuuccugaugguccuccugaucccugagcccgaucggcaacgcaccccucaggacaaccagcuggccuauguugugaucggacuccuuuuuaugauucugacaguggcugccaacgaaaugggccugcucgagaccacgaagaaagaucuggggaucggacaugucgccgcugagaaucaccaacacgccaccaugcuugacguggaucugagacccgcgagcgccuggacacucuacgcuguugccaccacagugauuaccccuaugaugcggcauacgaucgaaaacacaaccgcuaauauuucucugacagccaucgcgaaccaggccgcuauucugaugggccucgacaagggcuggcccaucuccaaaauggauaucggggucccgcuucuggcccugggaugcuacagccaggugaauccucucacccugaccgcugccguccuuaugcugguggcucacuaugccauuaucggccccgggcuccaggcgaaggccacacgcgaggcucaaaagagaacggccgcuggaauuaugaaaaaccccaccguugacggcaucguggccauugaucuggacccugucguguacgacgccaaguucgaaaaacagcuggggcagaucaugcuccuuauccuguguacaucucagauucugcucaugcggaccacaugggcgcugugcgaguccaucacccuugcuacgggaccgcugacaacccucugggaaggcagccccggcaaguuuuggaauaccacaauugccguuucuauggcuaacaucuuccgcgggagcuaucuggccggagccggccuggcuuucucccucaugaaaucucuugggggaggcagacgggggaccggagcccaaggcgagacacugggcgagaaguggaagcgccagcugaaucagcucagcaaauccgaauuuaacacguacaagagaagcgggauuauggagguggaucgguccgaagcgaaagagggacugaagagaggcgaaaccacaaaacaugccgucucucgcgggaccgcuaagcuucggugguucguggagagaaaucuggugaagccugagggaaaaguuaucgaccucggcugugggcgcggaggcuggagcuauuacugcgccggccugaagaaagucacagaagugaagggguauaccaaaggaggccccgggcacgaggaaccuauccccauggcuacguacggauggaaccuggugaagcucuacuccggcaaagaugucuuuuucaugccuccggagaagugugacacccuucugugcgauauuggggaaucuagccccaauccuacaaucgaggagggacggacccugagaauucucaagaugguugaacccuggcugcgcggcaaccaguuuuguaucaaaauucuuaauccuuauaugcccuccgugguggagacacuggaacaaaugcagcggaagcauggcgggaugcucgucagaaacccgcugucucgcaauagcacccacgagauguacuggguguccugcggaacaggcaacaucguuagcgccgugaacaugaccucucggaugcugcucaauagauucacgauggcgcaccgcaaaccuacauaugagcgggacgucgaucugggggccggaaccagacauguggcuguugaacccgagguggccaaccuugacauuaucggccagcgcaucgaaaauauuaagaacgagcacaaauccaccuggcauuacgaugaagacaaucccuauaagacaugggcuuaccacgggagcuaugaggucaagccuucuggauccgccagcucuauggugaacggcguggucagacugcucacgaaacccugggauguuaucccuauggugacccaaauugcuaugacagacaccacaccguuuggccagcagcggguguucaaggagaaagucgacacccgcacacccagagccaagcgggggaccacgcagaucauggaagugaccgcgaaauggcuguggggauuucuuuccagaaauaagaagccucggauuuguacacgcgaggaauucaccagaaaaguucggagcaacgccgcuaucggcgccguguuugucgaugagaaucaauggaacuccgcuaaggaagccguggaggacgagcgcuucugggaucugguucacagagaacgggagcuccauaaacaggggaagugcgccacaugcguguacaauaugaugggaaaacgcgaaaagaagcugggcgaguuugggaaagcgaagggcagcagagcuaucugguacauguggcugggagcccgguuccucgaauucgaggcccugggcuuuaugaacgaggaccacugguucucucgcgaaaauagccuuuccggggucgagggagaaggccugcauaaacucggguauauucugagagauaucucuaagauucccggaggcaacauguacgcugacgauaccgccgggugggacacgcggaucacagaggaugaccuucagaaugaggcuaaaauuaccgauaucauggaaccugagcacgcccugcucgcgacaagcaucuuuaagcugaccuaucagaacaaagugguucgcgugcaaagacccgccaagaacggcacggucauggacgugauuucccggcgcgaucagagaggaucuggccaggucgggaccuacggacugaauacauucaccaacauggaagugcagcucauccggcaaauggagagcgaaggcauuuuucugccguccgagcuugagacaccuaaucuggcugaaagaguucucgacuggcuggagaagcauggggccgaacgccuuaaacggauggcuaucucuggagacgauuguguggucaagcccauugacgauagauucgccaccgcgcugacagcccucaacgacaugggcaaagugcgcaaggauaucccucagugggagcccagcaaaggguggaaugacuggcagcaggugccuuuuugcucccaccacuuccaucaacugaucaugaaggauggccgggaaauuguugugcccuguagaaaccaggacgagcuggucggacgcgcucgggugagccagggcgccggguggucucucagagagaccgcuugccugggaaaguccuaugcccaaauguggcagcuuauguacuuucaccgccgggaucugagacucgcugccaaugcgaucuguagcgccguuccgguggacugggucccuacgucucgcacaaccugguccauucaugcucaccaccaguggaugaccacagaagauaugcugagcguguggaaccgggucuggaucgaggaaaaucccuggauggaggacaaaacccauguguccucuugggaagagguucccuaucuuggcaagagagaggaccaguggugcgggagccugauuggacucacagcccgggccacgugggcuaccaacauccaaguggccauuaaucaggucagacgccugaucggcaacgaaaauuaccuggauuacaugacauccaugaaacgguucaagaacgagagcgacccugaaggggcgcucugguga

SEQ ID NO: 18682 - RNA, 9879 nt, Artificial Sequence
  derived and/or modified CDS sequence (opt5) from DENV-1__GQ199872__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauugugucucuguucccucucugucuguccacaacgagccagaaaaccacauggcuuccgguccugcuggggucuuuuggaugcaagccccucaccauguuccugaucacagaaaauaagauuuggggccggaaauccuggccucuuaacgagggcaucauggccauugggaucguuagcauccugcucucuucccugcucaagaaugacgugccccuggcgggaccucuuauugccggcgggaugcugaucgcuuguuaugugauuagcggauccagcgccgaucugucucucgagaaagcugccgaagucagcugggagcaagaagccgagcauuccggcaccucucacaacauccugguggaaguucaggacgaugggacgaugaagauuaaagacgaggagcgcgaugacacccuuacaauccugcucaaggcuacccugcucgcggugagcggagucuaccccauguccaucccugccacacuguuugugugguauuucuggcagaaaaagaagcagagaucuggcguucuuugggauacccccagcccgccugaaguggagcgggcuguccuggacgauggcauuuaccgcauccugcaaagagggcuccugggacggucccaggugggcgucgggguguuccaggacggaguuuuucauacaauguggcacgugacgcgcggcgccguccuuauguaucaggggaaaagacuggaacccucuugggccagcgugaagaaagaccucauuuccuacggaggcggcuggcgguuccaagggagcuggaauaccggagaggagguucaggugaucgcugucgaaccuggcaagaaccccaaaaaugugcagacaaccccggggaccuuuaagacaccugagggagaagugggcgccauugcgcuggauuucaagcccgggacgucuggauccccuaucguuaacagagagggcaaaauugucggccucuacgggaauggaguggugaccacaagcggcaccuaugucucugcuaucgcccaagccaaggcuucccaggaagggccccugcccgagaucgaggacgaaguguuuaaaaagcgcaaccuuacaauuauggaucugcacccuggaagcggcaaaacccggagauaccugccggccaucguucgcgaggcgauuaagcggaagcucagaacgcugauccuugcucccacacgcguggucgccuccgaaauggccgaggcucugaaagggaugccuauucgguaucagaccaccgccgugaagucugaacauacaggcagagagaucguugaccucaugugccacgcuaccuucacaaugcgccugcugagccccgugcgggucccuaauuacaacaugaucauuauggaugaggcccauuuuaccgaccccgcguccaucgccgcuagaggauauauuagcacgcgggugggcaugggggaagccgcugccaucuucaugacagccaccccuccgggaucuguugaggcuuuuccccaguccaaugcggugauucaagaugaagagcgcgacaucccugaaagaagcuggaacucuggcuacgauuggaucacagacuuccccgggaaaaccgucugguuugugccuagcauuaaguccggaaaugauaucgccaacugucuccggaaaaacggcaagcgcgugauucagcuuucuagaaagacguucgacaccgaguaucagaaaacaaagaauaacgacugggauuacgucguuaccacagacaucagcgagaugggggcuaauuuccgggccgauagagugauugacccccgccggugccugaaaccggugauccugaaggauggcccugaaagagucauucucgccggacccaugcccgugaccguugcuuccgccgcgcagcgccggggcagaaucgggcgcaaccaaaauaaagagggagaccaguacguguauaugggccagccucugaacaaugaugaagaccacgcucauuggacagaggccaagaugcuucuggauaacaucaauacccccgaggggauuaucccugcccucuuugaaccggagcgggaaaagucugcugccauugacggagaguacagacugcgcggcgaagcgagaaaaacguucgucgagcugaugcggcgcggggaucuccccguguggcuuagcuauaagguugccuccgagggcuuucaguacagcgacagacgguggugcuucgauggagaacgcaacaaucaagugcuggaggaaaacauggacgucgagaucuggacaaaagaaggcgagagaaagaaacugcggccuagauggcucgacgcucgcaccuauucugauccccuggcccuucgggaguuuaaggaauucgcugccgggagacgcuccgugagcggagaccugauucucgagaucggcaaacugccucagcaccugacccuccgggcucagaaugcccuugauaaccuggucaugcugcacaauuccgaacaggggggaaaggcguacagacaugccauggaggaacuccccgacacaaucgagacccugaugcuucuggcucucauugccgugcugacaggcggcguuacgcuguuuuuccucucugggaagggacuuggcaaaaccagcaucgggcugcugugugugacagcuuccucugcccuccuguggauggccagcguggagccgcacuggauugcugcguccaucauucuugaauuuuuccugaugguccuccugaucccugagcccgaucggcaacgcaccccucaggacaaccagcuggccuauguugugaucggacuccuuuuuaugauucugacaguggcugccaacgaaaugggccugcucgagaccacgaagaaagaucuggggaucggacaugucgccgcugagaaucaccaacacgccaccaugcuugacguggaucugagacccgcgagcgccuggacacucuacgcuguugccaccacagugauuaccccuaugaugcggcauacgaucgaaaacacaaccgcuaauauuucucugacagccaucgcgaaccaggccgcuauucugaugggccucgacaagggcuggcccaucuccaaaauggauaucggggucccgcuucuggcccugggaugcuacagccaggugaauccucucacccugaccgcugccguccuuaugcugguggcucacuaugccauuaucggccccgggcuccaggcgaaggccacacgcgaggcucaaaagagaacggccgcuggaauuaugaaaaaccccaccguugacggcaucguggccauugaucuggacccugucguguacgacgccaaguucgaaaaacagcuggggcagaucaugcuccuuauccuguguacaucucagauucugcucaugcggaccacaugggcgcugugcgaguccaucacccuugcuacgggaccgcugacaacccucugggaaggcagccccggcaaguuuuggaauaccacaauugccguuucuauggcuaacaucuuccgcgggagcuaucuggccggagccggccuggcuuucucccucaugaaaucucuugggggaggcagacgggggaccggagcccaaggcgagacacugggcgagaaguggaagcgccagcugaaucagcucagcaaauccgaauuuaacacguacaagagaagcgggauuauggagguggaucgguccgaagcgaaagagggacugaagagaggcgaaaccacaaaacaugccgucucucgcgggaccgcuaagcuucggugguucguggagagaaaucuggugaagccugagggaaaaguuaucgaccucggcugugggcgcggaggcuggagcuauuacugcgccggccugaagaaagucacagaagugaagggguauaccaaaggaggccccgggcacgaggaaccuauccccauggcuacguacggauggaaccuggugaagcuccauuccggcaaagaugucuuuuucaugccuccggagaagugugacacccuucugugcgauauuggggaaucuagccccaauccuacaaucgaggagggacggacccugagaguucucaagaugguggaacccuggcugcgcggcaaccaguuuuguauuaaaauccuuaauccuuacaugcccuccguggucgagacacuggaacaaaugcagcggaagcacggcgggaugcucgugagaaacccgcugucucgcaauagcacccacgagauguauuggguuuccugcggaacaggcaacauugugagcgccgucaacaugaccucucggaugcugcucaauagauucacgauggcgcaucgcaaaccuacauacgagcgggacguggaucugggggccggaaccagacacguugcuguggaacccgaggucgccaaccuugacaucauuggccagcgcaucgaaaauaucaagaacgagcauaaauccaccuggcacuaugaugaagacaaucccuacaagacaugggcuuaucacgggagcuacgaggugaagccuucuggauccgccagcucuauggugaacggcgucguuagacugcucacgaaacccugggaugugauuccuauggugacccaaaucgcuaugacagacaccacaccguuuggccagcagcgggucuucaaggagaaaguggacacccgcacacccagagccaagcgggggaccacgcagauuauggaaguuaccgcgaaauggcuguggggauuucuuuccagaaauaagaagccucggaucuguacacgcgaggaauucaccagaaaagugcggagcaacgccgcuauuggcgccgucuuuguggaugagaaucaauggaacuccgcuaaggaagccguugaggacgagcgcuucugggaucuggugcauagagaacgggagcuccacaaacaggggaagugcgccacaugcgucuauaauaugaugggaaaacgcgaaaagaagcugggcgaguuugggaaagcgaagggcagcagagcuaucugguacauguggcugggagcccgguuccucgaauucgaggcccugggcuuuaugaacgaggaccauugguucucucgcgaaaauagccuuuccgggguggagggagaaggccugcacaaacucggguacauccugagagauauuucuaagauccccggaggcaacauguaugcugacgauaccgccgggugggacacgcggauuacagaggaugaccuucagaaugaggcuaaaaucaccgauauuauggaaccugagcaugcccugcucgcgacaagcaucuuuaagcugaccuaccagaacaaaguugugcgcguccaaagacccgccaagaacggcacggugauggacgucaucucccggcgcgaucagagaggaucuggccagguggggaccuauggacugaauacauucaccaacauggaaguucagcucauucggcaaauggagagcgaaggcaucuuucugccguccgagcuugagacaccuaaucuggcugaaagagugcucgacuggcuggagaagcacggggccgaacgccuuaaacggauggcuauuucuggagacgauugugucgugaagcccaucgacgauagauucgccaccgcgcugacagcccucaacgacaugggcaaagugcgcaaggauauuccucagugggagcccagcaaaggguggaaugacuggcagcagguuccuuuuugcucccaccauuuccaccaacugaucaugaaggauggccgggaaaucgugguccccuguagaaaccaggacgagcuggugggacgcgcucggguuagccagggcgccggguggucucucagagagaccgcuugccugggaaaguccuacgcccaaauguggcagcuuauguauuuucaucgccgggaucugagacucgcugccaaugcgauuuguagcgccgugccggucgacugggugccuacgucucgcacaaccugguccauccacgcucaccaucaguggaugaccacagaagauaugcugagcgucuggaaccggguguggauugaggaaaaucccuggauggaggacaaaacccacguuuccucuugggaagaggugcccuaccuuggcaagagagaggaccaguggugcgggagccugaucggacucacagcccgggccacgugggcuaccaacauucaagucgccaucaaucaggugagacgccugauuggcaacgaaaauuaucuggaucauaugacauccaugaaacgguucaagaacgagagcgacccugaaggggcgcucugguga

SEQ ID NO: 18683 - RNA, 9879 nt, Artificial Sequence
  derived and/or modified CDS sequence (opt5) from DENV-1__FJ410290__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagagaagcggucugucgcccuggcuccucauguggggcucggacuggaaacacgcaccgagacguggaugagcuccgaaggcgccuggaaacagauucagagaguugagacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagacuuuguugagggacucuccggcgccacauggguggaugucgugcuggaacacgggagcugugugacgaccauggcuaagaauaaacccacacuggacaucgagcuccugaagaccgaagucacaucuccugccauucuucggaaacugugcaucgaggcgaagauuuccaacaccacgacagauagccgcuguccgacccagggagaagccacccucguugaggagcaggacgcuaauuucgugugcagacggacauuuguggaucgcggcuggggcaacggguguggacuguucggcaaagggucucuucugaccugcgccaaguuuaagugcgucacaaaacucgaaggaaagaucgugcaguacgagaaucugaaauauuccguuaucgugacgguccacaccggcgaccaacaucagguggggaacgaaacaaccgagcacggaacaauugcuaccaucacgccccaggccccuaccagcgaaauucagcugacagauuacggcgcccucacccuggacuguucucccagaacaggccuugacuucaaugagaugguucugcucaccaugaaggagaaauccuggcuggugcauaagcaaugguuucuugaucugccucuccccuggacgagcggggcuuccacaucucaggaaaccuggaaccggcaggaccugcuggucacauucaaaaccgcgcacgccaagaagcaagagguggucgugcucggaagccaggaaggcgcuaugcacaccgcccugacaggggccacggagauccagaccuccggaacaaccacaauuuuugcuggccaucuuaaaugccgccugaagauggauaaacucacccugaaggggacgagcuauguuauguguacaggcucuuucaaacuggaaaaggagguggccgagacccagcacggaaccguccuugugcaaguuaaguacgaaggcacagacgcgccgugcaaaaucccuuucuccacccaggaugagaagggggugacacagaauggaagacucaucacggcuaaccccauugucaccgacaaagaaaagccugugaauaucgagacagagccccccuuuggcgaaagcuauauugugguuggggccggagagaaagcccugaagcugucuugguucaagaaaggcagcuccaucgggaagauguuugaagcuaccgcccggggcgcuagacgcauggccauucucggagauacagcgugggacuucggcucuaucgggggagucuuuaccagcgugggcaaacuggugcaucaggucuucgggacggccuacggagugcuuuuuuccggcguuagcuggaccaugaagaucgggauuggcauccugcucacauggcugggacugaacucucgguccaccagccuuucuaugacauguauugcugugggcauggucacccucuaccugggggugaugguucaagccgauuccggaugcgugaucaauuggaaaggcagagagcugaagugugggagcggaauuuucgucacaaacgaagugcacaccuggacggagcaguauaaguuucaggcugacuccccuaaacgccucucugccgcgaucggcaaggccugggaggaagggguuugcggcauucggagcgcuacaagacuggagaacaucauguggaaacagaucuccaaugaacuuaaccauauucugcucgagaaugauaugaaguucaccguggucgugggagacgccaacggcauccuggcucaagggaaaaagaugauucgcccgcagcccauggaacacaaauacucuuggaagagcuggggaaaggccaaaaucauuggcgccgacauccagaauaccacauuuaucauugaugggccugacacccccgaguguccugauaaccagcgggcuuggaauaucugggagguggaagacuauggauucggcauuuuuacgacaaacaucuggcugaagcuuagagauuccuacacccaaaugugcgaccaccgccucaugagcgcggccauuaaagauucuaaggcuguccaugccgacaugggcuauuggaucgaguccgaaaaaaaugagacauggaagcuggcccgggcuagcuucaucgaaguuaagaccuguacauggcccaaaucucacacccugugguccaacggggugcucgagagcgagaugauuaucccgaagauuuacggaggcccuaucucucagcauaauuauagacccggguacuucacgcagaccgccggaccuuggcaccugggcaaacuugaacuggauuuugaccucugcgaggggacaaccguggucguggaugaacacugcggaaaccgcggccccagccugcggacaaccacgguuacaggcaagauuauccaugagugguguugcagauccuguacccugccuccccuucgguuccgcggggaggacggaugcugguacggcauggaaaucagaccggugaaagagaaggaagagaaucucguccggagcauggugucugcgggguccggagaaguugauagcuuuucccugggcauucugugugugucuaucaugauugaggaggucaugagaagccgcuggucccggaagaugcucaugacagggacccuggugguuuuccuucugcucaucaugggacaacugaccuggaaagaccugauuagacuuugcaucauggugggcgcuaacgccucugaccgcaugggcauggggacaacguaucuggcccucauggcuaccuuuaagaugagaccuauguucgccgucggacugcucuuucggcgccugacaagcagagaagugcuucugcucaccauuggccugucccugguggcgucugucgagcuucccaauagccuggaagagcucggggauggacuggcuaugggcaucaugaugcucaaacugcuuacagaauuccagccccaccagcuguggaccacgcuccugucccugacauuuaucaagaccacccuuagccuggacuacgccuggaaaacaaccgccauggcucucucuauuguuucccuguucccucucugucugagcacaacgucucagaagaccacauggcuuccggugcugcugggguccuuuggaugcaagccccucaccauguuccugaucacagagaacaaaauuuggggccggaagagcuggccucuuaacgagggcaucauggccauugggaucgugucuauccugcucuccagccugcucaaaaaugaugucccccuggcuggaccucuuauugccggcgggaugcugaucgcguguuaugugauuuccggaagcucugccgaccugagccucgaaaaggcugccgagguuuccugggaacaagaggcugaacauucuggcaccagccacaacauccugguggagguccaggaugacgggacgaugaaaauuaaggaugaggaacgcgacgauacccuuacaauccugcucaaagccacccugcucgccguguccggaguuuaccccaugucuaucccugcuacacuguuugugugguauuucuggcagaagaagaaacagagaagcggcguccuuugggacacccccuccccgccugagguggaacgggcgguccuggaugacggcauuuaccgcauccugcaaagagggcuccugggacggucucaggugggcguugggguguuccaggauggagucuuucauacaauguggcacgugacgcgcggcgccguucuuauguaucaggggaagagacuggagcccagcugggcuuccgugaaaaaggaccucauuagcuacggaggcggcuggcgguuccaagggucuuggaauaccggagaggaaguccaggugaucgccguggagccuggcaaaaaccccaagaauguucagacaaccccggggaccuuuaagacaccugaaggagaggucggcgccauugcucuggacuucaaacccgggacguccggaagcccuaucgugaacagagaaggcaagauugugggccucuacgggaauggagucgugaccacaucuggcaccuauguuuccgccaucgcgcaagcuaaagccagccaggaggggccccugcccgagaucgaagaugagguguuuaagaaacgcaaccuuacaauuauggaccugcacccuggauccggcaagacccggagauaccugccggccaucguccgcgaagcuauuaagcggaaacucagaacgcugauccuugcccccacacgcgugguugcgucugagauggcugaagcccugaaggggaugccuauucgguaucagaccaccgccgugaaaagcgagcauacaggcagagagaucgucgaucucaugugccacgcuaccuucacaaugcgccugcugucccccgugcggguuccuaauuacaacaugaucauuauggacgaagcccauuuuaccgaucccgcuagcaucgccgcgagaggauauauuucuacgcgggugggcaugggggaggccgcugccaucuucaugacagcuaccccuccgggauccgucgaagccuuuccccagagcaaugccgugauucaagacgaggaacgcgauaucccugagagaucuuggaacagcggcuacgacuggaucacagauuuccccgggaagaccgugugguuugucccuuccauuaaaucuggaaaugacaucgcuaacugucuccggaagaauggcaagcgcguuauucagcuuagcagaaaaacguucgauaccgaguaucagaagacaaaaaacaacgacugggacuacguggugaccacagauaucuccgaaaugggggcgaauuuccgggccgacagagucauugauccccgccggugccugaagccggugauccugaaagacggcccugagagaguuauucucgcuggacccaugcccgugaccgucgccucugccgcucagcgccggggcagaaucgggcgcaaccaaaauaaggaaggagaucaguacguguauaugggccagccucugaacaaugacgaggaucacgcccauuggacagaggcgaagaugcuucuggacaacaucaauacccccgaagggauuaucccugcucucuuugagccggaacgggagaaaagcgccgccauugauggagaauacagacugcgcggcgaggcuagaaagacguucguugagcugaugcggcgcggggaccuccccguguggcuuuccuauaaagucgccagcgaaggcuuucaguacucugauagacgguggugcuucgacggagagcgcaacaaucaagugcuggaagagaacauggaugucgaaaucuggacaaaggagggcgagagaaaaaagcugcggccuagauggcucgacgcgcgcaccuauuccgacccccuggcccuucgggaauuuaaagaguucgcugccgggagacgcagcguguccggagaucugauucucgaaaucggcaagcugccucagcaccugacccuccgggcucagaaugcccuugacaaccugguuaugcugcacaauucugagcaggggggaaaggcuuacagacaugccauggaagagcuccccgauacaaucgagacccugaugcuucuggcgcucauugccgugcugacaggcggcgugacgcuguuuuuccucagcgggaaaggacuuggcaagaccuccaucgggcugcugugugucacagcuucuagcgcccuccuguggauggcuuccguugaaccgcacuggauugccgccagcaucauucuugaguuuuuccugauggugcuccugaucccugaacccgaccggcaacgcaccccucaggauaaccagcuggcuuauguggucaucggacuccuuuuuaugauucugacaguggcggccaaugagaugggccugcucgagaccacgaaaaaggaccuggggaucggacauguugcugccgaaaaccaccaacacgccaccaugcuugauguggaccugagacccgcuucugccuggacacucuacgcggucgccaccacagugauuaccccuaugaugcggcauacgaucgagaacacaaccgcuaauauuucccugacagccaucgcuaaccaggccgcgauucugaugggccucgauaaaggcuggcccaucagcaagauggacaucggggucccgcuucuggcccugggaugcuacucucaggugaauccucucacccugaccgcugccguucuuaugcugguggcucacuaugccauuaucggccccgggcuccaggcuaaggccacacgcgaagcgcaaaaaagaacggccgcuggaauuaugaagaaccccaccgucgauggcaucguggccauugaccuggauccuguuguguacgacgcuaaauucgagaagcagcuggggcagaucaugcuccuuauccuguguacaucccagauucugcucaugcggaccacaugggcccugugcgaaagcaucacccuugccacgggaccgcugacaacccucugggagggcucucccggcaaauuuuggaauaccacaauugcggucagcauggcuaacaucuuccgcggguccuaucuggccggagcuggccuggccuucucucucaugaagagccuugggggaggcagacgggggaccggagcccaaggcgagacacugggcgaaaaguggaaacgccagcugaaucagcucuccaagagcgaguuuaacacguacaaaagauccgggauuauggaaguggaccgguucgaggcuaaggaaggacugaaaagaggcgagaccacaaagcaugccgugucucgcgggaccgcgaagcuucggugguuuguugagagaaaucuggucaaaccugaaggaaaggugaucgaucucggcugugggcgcggaggcuggagcuauuacugcgccggccugaaaaaggugacagaggucaaaggguauaccaagggaggccccgggcacgaagagccuauccccauggcuacguacggauggaaccugguuaaacuccauuccggcaaggacguguucuuuaugccuccggaaaagugugauacccuucugugcgacauuggggagucuagccccaauccuacaaucgaggaaggacggacccugagagugcucaaaauggucgagcccuggcugcgcggcaaccaguucuguauuaagauccuuaauccuuacaugcccuccgugguugaaacacuggagcaaaugcagcggaaacacggcgggaugcucgugagaaacccgcugucucgcaauagcacccacgagauguauugggucuccugcggaacaggcaacauugugagcgccguuaauaugaccucucggaugcugcucaacagauuuacgauggcucaucgcaagccuacauacgaacgggauguggaccugggggccggaaccagacacgucgcgguggagcccgaaguggccaaccuugauaucauuggccagcgcaucgagaauaucaaaaacgaacauaaguccaccuggcacuaugacgaggauaaucccuacaagacaugggcuuaucacgggagcuacgaggucaaaccuucuggauccgccagcucuaugguuaacggcguggugaagcugcucacgaaacccugggacgucauuccuauggugacccaaaucgcuaugacagauaccacaccguucggccagcagagaguuuuuaaggaaaaaguggacacccggacaccccgcgccaagagagggaccacgcagauuauggaggucaccgcuaaguggcuguggggauuccuuucccggaauaaaaagccuagaaucuguacacgggaagaguuuacccgcaaagugagaagcaacgccgcgauuggcgccguuuucguggacgaaaaucaauggaacuccgcuaaggaggccgucgaggaugaacgguuuugggaccuggugcaucgcgagagagaacuccacaaacaggggaagugcgcuacaugcguuuauaauaugaugggaaagcgggagaaaaagcugggcgaauucgggaaagccaagggcagccgcgccaucugguacauguggcugggagcgagauuccucgaguuugaggcucugggcuucaugaacgaagaucauugguuuucucgggagaauagccuuuccgggguggaaggagagggccugcacaaacucggguacauccugcgcgacauuucuaagauccccggaggcaacauguaugccgaugacaccgccgggugggauacgagaauuacagaggacgaucuucagaaugaagcuaaaaucaccgacauuauggagccugaacaugcccugcucgcuacaagcaucuucaagcugaccuaccagaacaaggucgugcggguccaacgccccgccaaaaauggcacggugauggauguuaucuccagacgggaccagcgcggaucuggccagguggggaccuauggacugaacacauuuaccaacauggagguccagcucauuagacaaauggaaagcgagggcaucuuccugccguccgagcuugaaacaccuaaucuggcggagcgggugcucgauuggcuggggaagcacggagccgaaagacuuaaacgcauggcuauuucuggcgacgacugugugguuaagcccaucgaugaccgguuugccaccgcucugacagcccucaacgauauggggaaagugagaaaggacauuccucagugggagcccagcaagggcuggaaugauuggcagcaggucccuuucugcucccaccauuuucaccaacugaucaugaaagacggacgcgaaaucgugguucccugucggaaccaggaugagcuggugggcagagcgcgcgucagccagggggccggauggucucuccgggagaccgcuugccugggcaaguccuacgcccaaauguggcagcuuauguauuuccauagacgcgaccugcggcucgcuacgaaugccaaauguagcgcugugccggucgauugggugccuacaucuagaaccaccugguccauucacgcccaccaucaguggaugacaaccgaagacaugcugagcguuuggaaccgcguguggaucgaggaaaaucccuggauggaggauaagacacacgucuccucuugggaagaggugcccuaccuugggaaacgggaggaccaguggugcggaagccugauuggccucacggcgagagccaccugggcuacaaacauccaaguugccauuaaucaggugcggagacugaucgggaacgaaaauuaucuggacuacaugaccuccaugcgccgguuuaagaacgagagcgauccugaaggcgcccucugguga

SEQ ID NO: 18684 - RNA, 9879 nt, Artificial Sequence
  derived and/or modified CDS sequence (opt5) from DENV-1__FJ024423__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccguggucgccuuuuuccuggcgcaugccaucgggacaucuauuacccaaaagggaaucaucuuuauucuccugaugcuugugaccccuagcauggcuaugcgcugcguuggcaucgggaacagagauuucguggagggacuguccggcgccacaugggucgacguggugcucgagcacgggagcugugucacgaccauggcuaagaauaaacccacacuggauauugaacugcucaagaccgagguuacaaacccugccauccugcggaaacuuugcauugaagcgaagaucucuaauaccacgacagacucccgcuguccgacccagggagaggccacccugguggaagagcaggaugcuaacuuugugugcagacggacauucgucgaccgcggcuggggcaauggguguggacucuuuggcaaagggagccugcuuaccugcgccaaguucaagugcgugacaaaacuggagggaaagauuguucaguacgaaaaccucaaauauucugugaucgucacggugcacaccggcgaucaacaucagguugggaaugagacaaccgaacacggaacaaucgcuauuaucaccccccaggccccuacguccgagauucagcugaccgacuacggcgcccugacacucgacuguagccccagaaccggccuggauuuuaacgaaauggugcuucugacaaugaaggagaaaucuuggcucguccauaagcaaugguuccuggaccuuccucugcccuggaccuccggggcuagcacgucccaggagacauggaaucggcaggaucuccuggugaccuuuaaaacagcgcacgccaagaagcaagaagucgugguucugggaucucaggagggcgcuaugcacaccgcccucaccggggccacagaaauccagacgagcggaaccacaaccauuuucgcuggccaucugaaaugccgccuuaagauggacaaacugacacucaaggggaccuccuaugugauguguacgggcagcuucaaacuggagaaggaagucgccgagacacagcacggaaccgugcugguucaagugaaguacgagggcaccgaugcgccgugcaaaaucccuuuuucuacacaggacgaaaagggggucacccagaacggaagacuuaucacagcuaaucccauugugacggauaaagagaagccugugaacaucgaaaccgagccccccuucggcgaguccuauauuguuaucggggccggagaaaaagcccucaagcugagcugguuuaagaaaggcucuagcauugggaagauguucgaggcuacagcccggggcgcuagacgcauggccauccugggagacaccgcgugggauuuuggcuccaucgggggagucuucacaucugugggcaaacucgugcaucaggucuuugggaccgccuacggagugcuguucagcggcguuuccuggacgaugaagauugggaucggcauucuucugaccuggcucggacugaauagccggucuacaucccugagcaugaccuguaucgcugugggcauggucacacuuuaccucggggugaugguucaagccgacucuggaugcgugauuaacuggaaaggcagagaacugaaguguggguccggaaucuuugucaccaacgaggugcacacauggaccgaacaguauaaguuccaggcugauagcccuaaacgccuguccgccgcgauuggcaaggccugggaggaggggguuugcggcauccggucugcuacgagacucgaaaauaucauguggaaacagauuagcaacgagcugaaucauauccuucuggaaaacgacaugaaguuuacaguggucgugggagacgccaauggcauucucgcucaagggaaaaagaugauccgcccgcagcccauggagcacaaauacuccuggaagucuuggggaaaggccaaaauuaucggcgccgauauccagaacaccaccuucauuaucgacgggccugauacacccgaauguccugacgaucagcgggcuuggaauauuugggagguggaggacuauggauuuggcaucuucaccacgaacauuuggcugaagcugagagauagcuacacacaaaugugcgaccaccgccuuauguccgcggccaucaaagauagcaaggcuguccaugccgacaugggcuauuggaucgaaucugagaaaaaugaaaccuggaagcucgcccgggcuuccuucauugagguuaagacauguaccuggcccaaaagccacacacuguggucuaacggggugcuggaauccgagaugaucauuccgaagaucuacggaggcccuauuagccagcauaauuauagacccggguacuuuacccagacggccggaccuuggcaccucggcaaacuggagcuugauuucgaccugugcgaagggaccacaguggucguggaugagcacugcggaaaccgcggccccucucuccggaccacaaccguuacgggcaagaucauccaugaaugguguugcagaagcuguacacugccuccccugcgguuucgcggggaggacggaugcugguacggcauggagauuagaccggugaaagaaaaggaggaaaaucuuguccgguccauggugagcgcggggucuggagagguugacuccuucagccucggcauccugugugcuuccauuaugaucgaagaggugaugagaucucgcuggagccggaagaugcugaugaccgggacacucgccgucuuucugcuucugauuaugggacaacucaccuggaacgaucugaucagacugugcauuauggugggcgccaaugcuuccgaccgcaugggcauggggaccacauaucuugcccugauggcgacguucaaaaugagaccuauguuugcuguuggacuccuguuccggcgccucaccucuagagaggugcugcuucugacaaucggccucagccuggucgccuccguggaacugcccaacucucuugaggaacugggggauggacucgccaugggcaucaugaugcugaagcuccugaccgaguuucagccccaccagcuuuggacaacccugcucagccugacguucauuaaaacaacccugucccuugacuacgcuuggaagaccacagccauggcucugagcaucgugucucucuuuccucugugucucuccaccacaagccagaaaacgaccuggcugccgguccuucuggggucuuucggaugcaagccccugacaauguuucucauuaccgaaaacaagaucuggggccggaaauccuggccucugaaugagggcauuauggccaucgggaucguuagcauucuucugucuucccuccugaagaacgaugugccccucgcgggaccucugaucgccggcgggaugcuuauugcuuguuaugugaucagcggauccagcgccgaccugucucuggagaaagcugccgaagucagcugggagcaagaagccgagcauuccggcacaucucacaauauucucguggaaguucaggaugacgggaccaugaagaucaaagaugaggagaaggacgauacgcugaccauccuucugaaagcuacacuccuggcggugagcggagucuaccccauguccauuccugccacccucuucgugugguauuucuggcagaagaagaaacagcgcucuggcguucugugggacacacccagcccgccugaaguggagagagcuguccuugaugacggcaucuaccggauucugcaacgcgggcugcucggaagaucccaggugggcgucgggguguuucaggacggaguuuuccauaccauguggcacgugacacggggcgccguccugauguaucaggggaagcgccuugaacccucuugggccagcgugaaaaaggaucugaucuccuacggaggcggcuggagauuucaagggagcuggaacacgggagaggagguucaggugauugcugucgaaccuggcaaaaaucccaagaacgugcagaccacaccggggaccuucaagaccccugagggagaagugggcgccaucgcgcucgacuuuaaacccgggacaucuggauccccuauuguuaaucgggagggcaagaucgucggccuguacgggaacggaguggugacgaccagcggcacauaugucucugcuaucgcccaagccaaagcuucccaggaagggccccuccccgagauugaggaugaaguguucaagaaaagaaaucugaccaucauggaccuucacccuggaagcggcaagacacgccgguaccugccggccauuguuagagaggcgaucaagcgcaaacugcggacccucauucuggcucccacgagaguggucgccuccgaaauggccgaggcucuuaaggggaugccuauccgcuaucagacaaccgccgugaaaucugaacauaccggccgggagaucguugaucugaugugccacgcuacauuuaccaugagacuccugagccccgugcgcgucccuaacuacaauaugauuaucauggacgaggcccauuucacagaucccgcguccauugccgcucggggauauaucagcaccagagugggcaugggggaagccgcugccauuuuuaugacggccacaccuccgggaucuguugaggcuuucccccaguccaacgcggugauccaagacgaagagcgggauaucccugaacgcagcuggaauucuggcuacgacuggauuaccgauuuucccgggaagacagucugguucgugccuagcaucaaauccggaaacgacauugccaauugucugagaaagaacggcaagcgggugauccagcucucucgcaaaaccuucgacacggaguaucagaagaccaaaaacaaugauugggacuacgucguuacaaccgauauuagcgagaugggggcuaacuuuagagccgaccgggugaucgaucccagacgcugccuuaagccggugauucugaaagacggcccugaacgggucauccuggccggacccaugcccgugacaguugcuuccgccgcgcagagacgcggccggaucgggagaaaucaaaacaaggagggagaucaguacguguauaugggccagccucucaauaacgacgaagaucacgcucauuggaccgaggccaagaugcugcuugacaauauuaacacacccgaggggaucauuccugcccuguucgaaccggagcgcgaaaaaucugcugccaucgauggagaguaccggcucagaggcgaagcgcgcaagaccuuugucgagcugaugagacggggggaccugcccguguggcucagcuauaaaguugccuccgagggcuuccaguacagcgaucgcagauggugcuuugacggagaacggaauaaccaagugcuugaggaaaauauggacgucgagauuuggacgaaggaaggcgagcgcaaaaagcugagaccucgguggcuggaugcuagaacauauucugacccccucgcccugcgcgaguucaaagaauuugcugccgggcggagauccgugagcggagaucuuauccuggagaucggcaagcucccucagcaccugacccugcgcgcucagaacgcccucgacaaucuugucaugcugcacaacuccgaacaggggggaaaggcguaccggcaugccauggaggaacugcccgauaccauugagacacucaugcugcuugcucugaucgccgugcucaccggcggcguuacacuguucuuucugucugggaaaggacucggcaagacgagcauugggcuucugugugugaccgcuuccucugcccugcucuggauggccagcguggagccgcacuggaucgcugcguccauuauccuggaauucuuucuuaugguccugcucaucccugagcccgacagacaacggacaccucaggauaaucagcuggccuauguugugauuggacugcucuucaugauccuuaccguggcugccaacgaaaugggccugcuggagacaaccaaaaaggaccucgggauuggacaugucgccgcugagaaccaccaacacgccacgaugcuggauguggaccuucgccccgcgagcgccuggacccuguacgcuguugccacaaccgugaucacaccuaugaugagacauaccauugaaaauacgacagcuaacaucucucucaccgccauugcgaaucaggccgcuauccugaugggccuggauaaaggcuggcccaucuccaagauggacauuggggucccgcuccuugcccugggaugcuacagccaggugaacccucugacacucaccgcugccguccugaugcuuguggcucacuaugccaucauuggccccgggcugcaggcgaaggccacccgggaggcucaaaaacgcacagccgcuggaaucaugaagaaucccacgguugauggcauuguggccaucgaccucgacccugucguguacgaugccaaauuugaaaagcagcuggggcagaucaugcugcucauucuuuguaccucucagauccugcugaugagaacaaccugggcgcucugcgaguccauuacacuggcuaccggaccgcuuacgacacugugggaaggcagccccggcaaauucuggaacaccaccaucgccguuucuauggcuaauauuuuccgggggagcuaucucgccggagccggccuggcuuuuucccugaugaagucucucgggggaggccgcagagggacaggagcccaaggcgagacccuuggcgagaaguggaaacggcagcugaaccagcugagcaaguccgaauucaauacauacaaacgcagcgggaucauggagguggacagauccgaagcgaaggagggacucaaacggggcgaaacgaccaagcaugccgucucuagagggacagcuaagcugcgcugguuuguggagcggaaccuugugaaaccugagggaaagguuaucgaucugggcugugggagaggaggcuggagcuauuacugcgccggccucaaaaaggucaccgaagugaaaggguauacaaagggaggccccgggcacgaggaaccuauucccauggcuaccuacggauggaaucuggugaaacugcauuccggcaaggacgucuucuuuaugccuccggagaagugugauacgcuccuuugcgacaucggggaaucuagccccaacccuaccauugaggagggacgcacacugcggguucugaaaaugguggaacccuggcucagaggcaaucaguucuguaucaagauucugaacccuuacaugcccuccguggucgagacccuugaacaaaugcagcgcaaacacggcgggaugcuggugcggaauccgcucucuagaaacagcacacacgagauguauuggguuuccugcggaaccggcaauaucgugagcgccgucaacaugacaucucgcaugcugcugaaccgguuuaccauggcgcauagaaagccuacguacgagcgcgauguggaccucggggccggaacacggcacguugcuguggaacccgaggucgccaaucuggauauuaucggccagagaaucgaaaacauuaaaaaugagcauaaguccaccuggcacuaugacgaagauaaccccuacaagaccugggcuuaucacgggagcuacgaggugaaaccuucuggauccgccagcucuauggugaauggcgucguucgccuucugacaaagcccugggacgugaucccuauggugacgcaaauugcuaugaccgacacaaccccguucggccagcagagagucuuuaaagagaagguggauacacggaccccccgcgccaaaagagggacaacccagaucauggaaguuacggcgaaguggcucuggggauuccugucccggaacaagaaaccuagaauuuguacccgggaggaauuuacacgcaaggugagaagcaaugccgcuaucggcgccgucuucguggacgagaaccaauggaauuccgcuaaagaagccguugaggaugagcgguuuugggaccuugugcaucgcgaaagagagcugcacaagcaggggaaaugcgccaccugcgucuauaacaugaugggaaagcgggaaaagaaacucggcgaguucgggaaggcgaaaggcagccgcgcuaucugguacauguggcugggagccagauuccuggaauuugaggcccucggcuucaugaaugaggaucauugguuuucucgggaaaacagccuguccgggguggagggagaaggccuucacaagcugggguacauucuccgcgacaucucuaaaauucccggaggcaauauguaugcugaugacacagccgggugggauaccagaaucacggaggacgaucugcagaacgaggcuaagauuacagacaucauggaaccugagcaugcccuucuggcgaccagcaucuucaaacucacauaccagaauaagguugugcggguccaacgccccgccaagaacggcaccgugauggaugucauuuccagacgggaccagcgcggaucuggccagguggggacguauggacugaacaccuuuacaaauauggaaguucagcugaucagacaaauggagagcgaaggcauuuuccucccguccgagcuggagaccccuaaccuugcuaaacgggugcuggacuggcucgaaaagcacggggccgagagacugaaacgcauggcuaucucuggagaugacugugucgugaagcccauugaugaccgguuugccacagcgcuuaccgcccugaaugauaugggcaaagugagaaaggacaucccucagugggaacccagcaagggguggaacgauuggcagcagguuccuuucugcucccaccauuuucaccaacucaucaugaaagacggccgcgagauugugguccccugucggaaucaggaugaacuggugggaagagcucgcguuagccagggcgccggguggucucugcgggagacagcuugccucggaaaguccuacgcccaaauguggcagcugauguauuuccauagacgcgaccuucggcuggcugccaacgcgaucuguagcgccgugccggucgauugggugccuaccucuagaacgacaugguccauucacgcucaccaucaguggaugaccaccgaggacaugcucagcgucuggaaucgcguguggaucgaagagaaccccuggauggaagacaaaacacacguuuccucuugggaggaagugcccuaccugggcaagcgggaggaucaguggugcgggagccuuauuggacugaccgccagagccacaugggcuacgaauauccaagucgccauuaaccaggugcggagacucaucggcaaugagaacuaucuggacuacaugaccuccaugaaacgcuuuaagaaugaaagcgauccugagggggcgcugugguga

SEQ ID NO: 18685 - RNA, 9879 nt, Artificial Sequence
  derived and/or modified CDS sequence (opt5) from DENV-1__FJ547089__SS-prME
agcgugaccaugcugcucaugcugcuucccaccgcucuggcuuuccaccucacgaccagaggcggggaaccucauaugaucgucuccaagcaggaacggggaaagucucugcuuuuuaagacaagcgccggcguuaacaugugcacccugauugcgauggaccucggggagcugugugaagauacaaugaccuacaagugcccccagaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagaacaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccgcccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaaacuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagaccauucaugaaugguguugcagaagcuguacacugccuccccuucgguuccgcggggaggauggaugcugguacggcauggagaucagaccggugaaagaaaaggaggaaaaccucguccgguccauggugagcgcggggucuggagagguugacuccuuuagccugggcauccugugugcuuccauuaugaucgaagaggugaugagaucucgcuggagccggaagaugcucaugaccgggacccuggccgucuuccuucugcucauuaugggacaacugacauggaaugaccugaucagacuuugcauuauggugggcgccaacgcuuccgaucgcaugggcauggggacgaccuaucuggcccucauggcgacauuuaaaaugagaccuauguucgcuguuggacugcucuuucggcgccugaccucuagagaggugcuucugcucacaaucggccugagccuggucgccuccguggaacuucccaacucucuggaggaacucggggacggacuggccaugggcauuaugaugcucaagcugcuuaccgaguuccagccccaccagcuguggacgacacuccugagccugaccuuuaucaaaaccacacuuucccuggauuacgcuuggaagaccacagccauggcucucagcaucgugucucuguucccucucugucuguccacgaccagccagaaaacaaccuggcuuccgguccugcuggggucuuuuggaugcaagccccucacaauguuccugauuaccgaaaauaagaucuggggccggaaauccuggccucuuaacgagggcauuauggccaucgggauuguuagcauccugcucucuucccugcucaagaaugacgugccccuggcgggaccucuuaucgccggcgggaugcugauugcuuguuaugugaucagcggauccagcgccgaucugucucucgagaaagcugccgaagucagcugggagcaagaagccgagcauuccggcacgucucacaacauucugguggaaguucaggacgaugggaccaugaagaucaaagacgaggagcgcgaugacacacuuaccauucugcucaaggcuacacugcucgcggugagcggagucuaccccauguccaucccugccacccuguuugugugguauuucuggcagaaaaagaagcagagaucuggcguucuuugggauacacccagcccgccugaaguggagcgggcuguccuggacgauggcaucuaccgcauucugcaaagagggcuccugggacggucccaggugggcgucgggguguuccaggacggaguuuuucauacgauguggcacgugacccgcggcgccguccuuauguaucaggggaaaagacuggaacccucuugggccagcgugaagaaagaccucaucuccuacggaggcggcuggcgguuccaagggagcuggaauacaggagaggagguucaggugauugcugucgaaccuggcaagaaccccaaaaaugugcagaccaccccggggacauuuaagacgccugagggagaagugggcgccaucgcgcuggauuucaagcccgggaccucuggauccccuauuguuaacagagagggcaaaaucgucggccucuacgggaauggaguggugacaaccagcggcacauaugucucugcuauugcccaagccaaggcuucccaggaagggccccugcccgagaucgaggacgaaguguuuaaaaagcgcaaccuuaccaucauggaucugcacccuggaagcggcaaaacgcggagauaccugccggccauuguucgcgaggcgaucaagcggaagcucagaacacugauucuugcucccacccgcguggucgccuccgaaauggccgaggcucugaaagggaugccuauccgguaucagaccacagccgugaagucugaacauaccggcagagagauuguugaccucaugugccacgcuacauucaccaugcgccugcugagccccgugcgggucccuaauuacaacaugaucaucauggaugaggcccauuuuacggaccccgcguccauugccgcuagaggauauaucagcacacgggugggcaugggggaagccgcugccauuuucaugaccgccacaccuccgggaucuguugaggcuuuuccccaguccaaugcggugauccaagaugaagaacgcgacauuccugaaagaagcuggaacucuggcuacgauuggaucaccgacuuccccgggaaaacggucugguuugugccuagcaucaaguccggaaaugauauugccaacugucuccggaaaaacggcaagcgcgugauccagcuuucuagaaagaccuucgacacagaguaucagaaaaccaagaauaacgacugggauuacgucguuacaaccgacauuagcgagaugggggcuaauuuccgggccgauagagugaucgacccccgccggugccugaaaccggugauucugaaggauggcccugaaagagucauccucgccggacccaugcccgugacaguugcuuccgccgcgcagcgccggggcagaauugggcgcaaccaaaauaaagagggagaccaguacguguauaugggccagccucugaacaaugaugaagaccacgcucauuggaccgaggccaagaugcuucuggauaacaucaauacgcccgaggggaucauuccugcccucuuugaaccggagcgggaaaagucugcugccaucgacggagaguacagacugcgcggcgaagcgagaaaaacauucgucgagcugaugcggcgcggggaucuccccguguggcuuagcuauaagguugccuccgagggcuuucaguacagcgacagacgguggugcuucgauggagaacgcaacaaucaagugcuggaggaaaacauggacgucgagauuuggaccaaagaaggcgagagaaagaaacugcggccuagauggcucgacgcucgcaccuauucugauccccuggcccuucgggaguuuaaggaguucgcugccgggagacgcuccgugagcggagaccugauccucgagauuggcaaacugccucagcaccugacacuccgggcucagaaugcccuugauaaccuggucaugcugcacaauuccgaacaagggggaaaggcguacagacaugccauggaggaacuccccgacaccaucgagacacugaugcuucuggcucucaucgccgugcugacgggcggcguuacccuguuuuuccucucugggaagggacuuggcaaaacaagcauugggcugcugugugugaccgcuuccucugcccuccuguggauggccagcguggagccgcacuggaucgcugcguccauuauccuugaauuuuuccugaugguccuccugauuccugagcccgaucggcaacgcacaccucaggacaaccagcuggccuauguugugaucggacuccuuuuuaugauccugaccguggcugccaacgaaaugggccugcucgagacgaccaagaaagaucuggggauuggacaugucgccgcugagaaucaccaacacgccacaaugcuugacguggaucugagacccgcgagcgccuggacccucuacgcuguugccacaaccgugaucacgccuaugaugcggcauacaauugaaaacaccacagcuaauaucucucugaccgccauugcgaaccaggccgcuauccugaugggccucgacaagggcuggcccauuuccaaaauggauaucggggucccgcuucuggcccugggaugcuacagccaggugaauccucucacccugacagcugccguccuuaugcugguggcucacuaugccaucauuggccccgggcuccaggcgaaggccacgcgcgaggcucaaaagagaaccgccgcuggaaucaugaaaaaccccacaguugacggcauuguggccaucgaucuggacccugucguguacgacgccaaguucgaaaaacagcuggggcagauuaugcuccuuauccuguguaccucucagauccugcucaugcggacaaccugggcgcugugcgaguccauuacgcuugcuacaggaccgcugaccacccucugggaaggcagccccggcaaguuuuggaauacaaccaucgccguuucuauggcuaacauuuuccgcgggagcuaucuggccggagccggccuggcuuucucccucaugaaaucucuugggggaggcagacgggggacaggagcccaaggcgagacgcugggcgagaaguggaagcgccagcugaaucagcucagcaaauccgaauuuaacaccuacaagagaagcgggaucauggagguggaucgguccgaagcgaaagagggacugaagagaggcgaaacaaccaaacaugccgucucucgcgggacagcuaaacuucggugguucguggagagaaaucuggugaagccugagggaaaaguuauugaccucggcugugggcgcggaggcuggagcuauuacugcgccggccugaagaaagucaccgaagugaagggguauacgaaaggagugcccgcucgggaggaaccuauccccauggccaccuacggcuggaaccuggucaagcuccacuccgggaaagauguguuuuucaugccuccggagaagugugacacacuucugugcgauaucggagaaucuagccccaauccuaccauugaggagggcagaacacugcgcguucucaagaugguggaacccuggcugcgggggaaccaguuuuguaucaaaauucuuaauccuuacaugcccuccgucguggagacccuggaacaaaugcagagaaagcauggaggcaugcucguucgcaacccgcugucucggaauagcacacacgagauguauuggguguccugcggcaccgggaacaucgucagcgcggugaacaugacgucuagaaugcugcucaaucgcuucacaauggcccaccggaaaccuaccuacgagagagacguugaucugggagcuggcacccgccauguggccgucgaacccgagguggcuaaccuugacauuaucgggcagagaauugaaaauaucaagaacgagcacaaauccacauggcauuaugaugaagacaaucccuacaagacgugggccuaucacggaagcuacgaggugaagccuucuggcuccgcuagcucuauggucaacgggguugugcggcugcucaccaaacccugggaugugaucccuauggucacacaaauugccaugaccgacacaaccccguuuggacagcagcgcguguucaaggagaaaguugacacaagaacaccccgggcgaagagaggcacgacccagaucauggaagugacagccaaauggcuguggggcuuucuuucccggaauaagaagccucgcauuuguaccagagaggaguucacacggaaaguccgcagcaacgcugccaucggggcuguguuuauugaugagaaucaauggaacuccgccaaggaagccguugaggacgagagauucugggaucuggugcaccgggaacgcgagcuccauaaacagggaaagugcgcgaccugcgucuauaauaugaugggcaaaagagaaaagaagcugggggaguuuggaaaagcuaagggcagccgggccaucugguacauguggcugggggcccgcuuccucgaguucgaggcucugggcuuuaugaacgaggaccacugguucucuagagaaaauagccuuuccggaguggagggcgaagggcugcauaaacucggauacauccugcgggauauuucuaagauccccggcgggaacauguaugccgacgauacggcuggaugggacacacgcguuaccgaggaugaccuucagaaugaggccaaaauuacagauaucauggaaccugagcacgcgcugcucgccaccagcauuuuuaagcugacguaccagaacaaaguggucagagugcaacggcccgcuaagaacggcaccgucauggacgugaucucccgcagagaucagcgggggucuggccagguuggaacauauggccugaauaccuucacaaacauggaagugcagcucaucagacaaauggagagcgaagggauuuuucugccguccgagcuugagaccccuaaucuggccgaacgcguccucgacuggcuggagaagcauggagcugaacggcuuagacgcauggccaucucuggcgacgauuguguggugaaacccauugacgaucgguucgcgacagcccugaccgcucucaacgacauggggaagguuagaaaagauaucccucagugggagcccagcaagggauggaaugacuggcaacaggugccuuuuugcucccaccacuuccaucaacugauuaugaaagauggccgcgaaaucgucgugcccugucggaaccaggacgagcugguugggagagcccgcgugagccagggcgcuggauggucucuccgggagacggccugccugggcaaguccuacgcucaaauguggcagcuuauguauuuucacagacgcgaucugcggcucgccgcgaaugccaucuguagcgcugucccgguggacugggucccuacaucuagaaccaccugguccauucaugcccaccaccaguggaugacaaccgaagauaugcugagcguguggaaccggguuuggaucgaggaaaaucccuggauggaggacaagacacauguguccucuugggaagagguccccuaccuugggaaaagagaggaccaguggugcggaagccugauuggccucacggcccgcgcuaccugggccacaaacauccaaguggcgauuaaucagguucggagacugaucgggaacgaaaauuaucuggauuacaugaccuccaugaagcgcuucaaaaacgagagcgacccugaaggagcucucugguga

SEQ ID NO: 18686 - RNA, 9879 nt, Artificial Sequence
  derived and/or modified CDS sequence (opt5) from DENV-1__FJ024484__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccguggucgccuuuuuccuggcgcaugccaucgggacaucuauuacccaaaagggaaucaucuuuauucuccugaugcuugugaccccuagcauggcuaugcgcugcguuggcaucgggaacagagauuucguggagggacuguccggcgccacaugggucgacguggugcucgagcacgggagcugugucacgaccauggcuaagaauaaacccacacuggauauugaacugcucaagaccgagguuacaaacccugccauccugcggaaacuuugcauugaagcgaagaucucuaauaccacgacagacucccgcuguccgacccagggagaggccacccugguggaagagcaggaugcuaacuuugugugcagacggacauucgucgaccgcggcuggggcaauggguguggacucuuuggcaaagggagccugcuuaccugcgccaaguucaagugcgugacaaaacuggagggaaagauuguucaguacgaaaaccucaaauauucugugaucgucacggugcacaccggcgaucaacaucagguugggaaugagacaaccgaacacggaacaaucgcuaccauuacgccccaggccccuaccuccgagauccagcugacagacuacggcgcccugacccucgacuguagccccagaacaggccuggauuuuaacgaaauggugcuucugaccaugaaggagaaaucuuggcucguccauaagcaaugguuccuggaccuuccucugcccuggacguccggggcuagcacaucccaggagaccuggaaucggcaggaucuccuggugacauuuaaaaccgcgcacgccaagaagcaagaagucgugguucugggaucucaggagggcgcuaugcacaccgcccucacaggggccacggaaauucagaccagcggaacaaccacaaucuucgcuggccaucugaaaugccgccuuaagauggacaaacugacccucaaggggacguccuaugugauguguacaggcagcuucaaacuggagaaggaagucgccgagacccagcacggaaccgugcugguucaagugaaguacgagggcacagaugcgccgugcaaaauuccuuuuucuacccaggacgaaaagggggucacacagaacggaagacuuaucacggcuaaucccaucgugaccgauaaagagaagccugugaacauugaaacagagccccccuucggcgaguccuauaucguuauuggggccggagaaaaagcccucaagcugagcugguuuaagaaaggcucuagcaucgggaagauguucgaggcuaccgcccggggcgcuagacgcauggccauucugggagacacagcgugggauuuuggcuccaucgggggagucuucaccucugugggcaaacucgugcaucaggucuuugggacggccuacggagugcuguucagcggcguuuccuggaccaugaagaucgggauuggcauccuucugacauggcucggacugaauagccggucuaccucccugagcaugacauguauugcugugggcauggucacccuuuaccucggggugaugguucaagccgacucuggaugcgugaucaacuggaaaggcagagaacugaaguguggguccggaauuuuugucacaaacgaggugcacaccuggacggaacaguauaaguuccaggcugauagcccuaaacgccuguccgccgcgaucggcaaggccugggaggaggggguuugcggcauucggucugcuacaagacucgaaaauaucauguggaaacagaucagcaacgagcugaaucauauucuucuggaaaacgacaugaaguuuaccguggucgugggagacgccaauggcauccucgcucaagggaaaaagaugauucgcccgcagcccauggagcacaaauacuccuggaagucuuggggaaaggccaaaaucauuggcgccgauauccagaacaccacauucaucauugacgggccugauacccccgaauguccugacgaucagcgggcuuggaauaucugggagguggaggacuauggauuuggcauuuucacgacaaacaucuggcugaagcugagagauagcuacacccaaaugugcgaccaccgccuuauguccgcggccauuaaagauagcaaggcuguccaugccgacaugggcuauuggaucgaaucugagaaaaaugaaacauggaagcucgcccgggcuuccuucaucgagguuaagaccuguacauggcccaaaagccacacccuguggucuaacggggugcuggaauccgagaugauuaucccgaagauuuacggaggcccuaucagccagcauaauuauagacccggguacuuuacgcagaccgccggaccuuggcaccucggcaaacuggagcuugauuucgaccugugcgaagggacaaccguggucguggaugagcacugcggaaaccgcggccccucucuccggacaaccacgguuacaggcaagauuauccaugaaugguguugcagaagcuguacccugccuccccugcgguuucgcggggaggacggaugcugguacggcauggagaucagaccggugaaagaaaaggaggaaaaucuuguccgguccauggugagcgcggggucuggagagguugacuccuucagccucggcauucugugugcuuccaucaugauugaagaggugaugagaucucgcuggagccggaagaugcugaugacagggacccucgccgucuuucugcuucugaucaugggacaacucaccuggaacgaucugauuagacugugcaucauggugggcgccaaugcuuccgaccgcaugggcauggggacaacguaucuugcccugauggcgaccuucaaaaugagaccuauguuugcuguuggacuccuguuccggcgccucacaucuagagaggugcugcuucugaccauuggccucagccuggucgccuccguggaacugcccaacucucuugaggaacugggggauggacucgccaugggcaucaugaugcugaagcuccugacagaguuucagccccaccagcuuuggaccacgcugcucagccugacauucaucaaaaccacccugucccuugacuacgcuuggaagacaaccgccauggcucugagcauugugucucucuuuccucugugucucuccacaacgagccagaaaaccacauggcugccgguccuucuggggucuuucggaugcaagccccugaccauguuucucaucacagaaaacaagauuuggggccggaaauccuggccucugaaugagggcaucauggccauugggaucguuagcauccuucugucuucccuccugaagaacgaugugccccucgcgggaccucugauugccggcgggaugcuuaucgcuuguuaugugauuagcggauccagcgccgaccugucucuggagaaagcugccgaagucagcugggagcaagaagccgagcauuccggcaccucucacaauauccucguggaaguucaggaugacgggacgaugaagauuaaagaugaggagaaggacgauacccugacaauccuucugaaagcuacccuccuggcggugagcggagucuaccccauguccaucccugccacacucuucgugugguauuucuggcagaagaagaaacagcgcucuggcguucugugggacacccccagcccgccugaaguggagagagcuguccuugaugacggcauuuaccggauccugcaacgcgggcugcucggaagaucccaggugggcgucgggguguuucaggacggaguuuuccauacaauguggcacgugacgcggggcgccguccugauguaucaggggaagcgccuugaacccucuugggccagcgugaaaaaggaucugauuuccuacggaggcggcuggagauuucaagggagcuggaacaccggagaggagguucaggugaucgcugucgaaccuggcaaaaaucccaagaacgugcagacaaccccggggaccuucaagacaccugagggagaagugggcgccauugcgcucgacuuuaaacccgggacgucuggauccccuaucguuaaucgggagggcaagauugucggccuguacgggaacggaguggugaccacaagcggcaccuaugucucugcuaucgcccaagccaaagcuucccaggaagggccccuccccgagaucgaggaugaaguguucaagaaaagaaaucugacaauuauggaccuucacccuggaagcggcaagacccgccgguaccugccggccaucguuagagaggcgauuaagcgcaaacugcggacgcucauccuggcucccacaagaguggucgccuccgaaauggccgaggcucuuaaggggaugccuauucgcuaucagaccaccgccgugaaaucugaacauacaggccgggagaucguugaucugaugugccacgcuaccuuuacaaugagacuccugagccccgugcgcgucccuaacuacaauaugaucauuauggacgaggcccauuucaccgaucccgcguccaucgccgcucggggauauauuagcacgagagugggcaugggggaagccgcugccaucuuuaugacagccaccccuccgggaucuguugaggcuuucccccaguccaacgcggugauucaagacgaagagcgggauaucccugaacgcagcuggaauucuggcuacgacuggaucacagauuuucccgggaagaccgucugguucgugccuagcauuaaauccggaaacgacaucgccaauugucugagaaagaacggcaagcgggugauucagcucucucgcaaaacguucgacaccgaguaucagaagacaaaaaacaaugauugggacuacgucguuaccacagauaucagcgagaugggggcuaacuuuagagccgcccgggugauugaccccagacgcugccuuaagccggugauccugaaagauggcccugaacgggucauucuggcuggacccaugcccgugaccguugccuccgcggcucagagacgcggccggaucgggagaaaucaaaacaaggagggagaccaguacguguauaugggccagccucucaauaacgaugaagaccacgcccauuggacagaggccaagaugcugcuugauaauaucaacacccccgaggggauuaucccugcucuguucgaaccggagcgcgaaaaaucugccgcgauugacggagaguaccggcucagaggcgaagcccgcaagacguuugucgagcugaugagacggggggaucugcccguguggcucagcuauaaaguugcuuccgagggcuuccaguacagcgaccgcagauggugcuuugauggagaacggaauaaccaagugcuugaggaaaauauggacgucgagaucuggacaaaggaaggcgagcgcaaaaagcugagaccucgguggcuggacgccagaaccuauucugauccccucgcucugcgcgaguucaaagaauuugccgcugggcggagauccgugagcggagaccuuauucuggagaucggcaagcucccucagcaccugacccugcgcgcccagaacgcgcucgauaaucuugucaugcugcacaacuccgaacaggggggaaaggccuaccggcaugcuauggaggaacugcccgacacaaucgagacccucaugcugcuugcccugauugcugugcucacaggcggcguuacgcuguucuuucugucugggaaaggacucggcaagaccagcaucgggcuucugugugugacagccuccucugcccugcucuggauggcuagcguggagccgcacuggauugcggccuccaucauucuggaauucuuucuuaugguccugcucaucccugagcccgauagacaacggaccccucaggacaaucagcuggcuuauguugugaucggacugcucuucaugauucuuacaguggccgccaacgaaaugggccugcuggagaccacgaaaaaggaucucgggaucggacaugucgcugccgagaaccaccaacacgcgaccaugcuggacguggaucuucgccccgccagcgcuuggacacuguacgccguugcuaccacagugauuaccccuaugaugagacauacgaucgaaaauacaaccgccaacauuucucucacagcgaucgccaaucaggcugccauucugaugggccuggacaaaggcuggcccaucuccaagauggauaucggggucccgcuccuugcucugggaugcuacagccaggugaacccucugacccucaccgccgcuguccugaugcuuguggcccacuaugcgauuaucggccccgggcugcaggccaaggcuacacgggaggcccaaaaacgcacggcugccggaauuaugaagaaucccaccguugacggcaucguggccauugaucucgacccugucguguacgacgcgaaauuugaaaagcagcuggggcagaucaugcugcucauccuuuguacaucucagauucugcugaugagaaccacaugggcucucugcgaguccaucacccuggccacgggaccgcuuacaacccugugggaaggcagccccggcaaauucuggaacaccacaauugcuguuucuauggccaauaucuuccgggggagcuaucucgccggagcuggccuggccuuuucccugaugaagucucucgggggaggccgcagagggaccggagcgcaaggcgagacacuuggcgagaaguggaaacggcagcugaaccagcugacgaagagcgaauucaauaccuacaaacgcuccgggauuauggagguggauagaagcgaagccaaggagggacucaaacggggcgaaacaaccaagcaugcugucuccagagggacagccaagcugcgcugguuuguggagcggaaccuugugaaaccugagggaaagguuaucgaccugggcugugggagaggaggcuggucuuauuacugcgcuggccucaaaaaggucaccgaagugaaaggguauacgaagggaggccccgggcacgaggaaccuauccccauggccaccuacggauggaaucuggugaaacugcauagcggcaaggauggguucuuuaugccuccggagaaguguggaacacuccuuugcgacauuggcgaauccucucccaacccuaccaucgaggagggccgcacacugcggguccugaaaaugguugaacccuggcucagagggaaucaguucuguauuaagauccugaacccuuacaugcccagcgugguggagacccuugaacaaaugcagcgcaaacacggaggcaugcugguccggaauccgcucuccagaaacucuacacacgagauguauugggugagcugcgggaccggaaauauuguuuccgcggugaacaugacgagccgcaugcugcugaaccgguuuacaauggcccauagaaagccuaccuacgagcgcgaugucgaccucggcgcugggacccggcacguggccguugaacccgagguggcuaaucuggauaucauuggacagagaaucgaaaacaucaaaaaugagcauaagucuacauggcacuaugacgaagauaaccccuacaagacgugggccuaucacggcuccuacgaggucaaaccuagcggcucugcuuccagcauggugaauggggugguccgccuucugaccaagcccugggacguuauuccuauggugacacaaaucgccaugaccgauacaaccccguucggacagcagagaguguuuaaagagaaggucgacacacggaccccccgcgcgaaaagaggcacgacccagauuauggaagugacagccaaguggcucuggggguuccugucucggaacaagaaaccuagaaucuguacccgggaggaauuuacacgcaagguuagauccaaugcugccauuggagcuguguucgucgacgagaaccaauggaauagcgccaaagaagccguggaggaugagcgguuuugggaccuuguucaucgcgaaagagagcugcacaagcagggcaaaugcgcgaccugcguguauaacaugauggggaagcgggaaaagaaacucggcgaguucggaaaggcuaaaggcucccgcgccaucugguacauguggcugggggccagauuccuggaauuugaggcucucggauucaugaaugaggaucauugguuuagccgggaaaacucucugagcggcgucgagggggaaggacuucacaagcugggcuacauccuccgcgacauuuccaaaauccccgggggcaauauguaugccgaugacacggcuggaugggauacaagaauuaccgaggacgaucugcagaacgaggccaagaucacagacauuauggaaccugagcaugcgcuucuggccaccucuaucuucaaacucacguaccagaauaaggugguucgggugcaacgccccgcuaagaacggcaccgucauggaugugaucagcagacgggaccagcgcggguccggacaggucggcacauaugggcugaacaccuuuacaaauauggaagugcagcugauuagacaaauggagucugaaggaaucuuccucccgagcgagcuggagaccccuaaccuugccaaacggguucuggauuggcucgaaaagcacggcgcugagagacugaaacgcauggccauuuccggggacgacuguguggucaagcccaucgaugaccgguuugcgacagcccuuaccgcucugaaugauaugggcaaagugagaaaggacauuccucagugggaacccucuaagggauggaacgauuggcagcaggugccuuucugcagccaccauuuucaccaacucaucaugaaagacggccgcgagaucguugugcccugucggaaucaggaugaacuggucgggagagcccgcgugucccagggagcuggcuggagccugcgggagacggccugccucgggaagucuuacgcucaaauguggcagcugauguauuuccauagacgcgaccuucggcuggccgcgaacgccauuuguuccgcuguuccgguggauugggucccuacaagcagaaccaccuggucuauccacgcccaccaucaguggaugacaaccgaggacaugcucuccguguggaaucgcgucuggauugaagagaaccccuggauggaagauaaaacacacgugagcuccugggaggaaguucccuaccugggaaagcgggaggaccaguggugcggcucucuuaucgggcugacggccagagcuaccugggccacaaauauucaaguggcgaucaaccagguccggagacucauuggcaaugagaacuaucuggacuacaugaccagcaugaaacgcuuuaagaaugaauccgauccugagggagcucugugguga

SEQ ID NO: 18687 - RNA, 9879 nt, Artificial Sequence
  derived and/or modified CDS sequence (opt5) from DENV-1__EU596503__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguaucggcagcuucaaacuggagaaggaaguggccgagacacagcacggaaccguccuugugcaaguuaaguacgagggcaccgaugcgccgugcaaaaucccuuucucuacacaggacgaaaagggggugacccagaacggaagacucauuacagcuaaucccaucgucacggauaaagagaagccugugaacauugaaaccgagccccccuuuggcgaguccuauaucgugguuggggccggagaaaaagcccugaagcugagcugguucaagaaaggcucuagcauugggaagauguuugaggcuacagcccggggcgcuagacgcauggccauccucggagacaccgcgugggauuucggcuccaucgggggaauguuuacaucugucggcaaacuggugcaucagguguucgggaccgccuacggaguccuuuuuagcggcguguccuggacgaugaagauugggaucggcauucugcucaccuggcugggacugaauagccggucuacaucccuuagcaugaccuguaucgcuguuggcauggugacacucuaccugggggucauggugcaagccgacucuggaugcguuauuaacuggaaaggcagagaacugaaguguggguccggaaucuucgugaccaacgagguccacacauggaccgaacaguauaaguuucaggcugauagcccuaaacgccucuccgccgcgauuggcaaggccugggaggagggggugugcggcauccggucugcuacgagacuggaaaauaucauguggaaacagauuagcaacgagcuuaaucauauccugcucgaaaacgacaugaaguucacaguuguggucggagacgccaauggcauucuggcucaagggaaaaagaugauccgcccgcagcccauggagcacaaauacuccuggaagucuuggggaaaggccaaaauuaucggcgccgauauccagaacaccaccuuuauuaucgacgggccugauacacccgaauguccugacaaucagcgggcuuggaacauuugggagguggaggauuauggauucggcaucuuuaccacgaauauuuggcugaagcuuagagacagcuacacacaaaugugcgaucaccgccucauguccgcggccaucaaagacagcaaggcugugcaugccgauaugggcuauuggaucgaaucugagaaaaacgaaaccuggaagcuggcccgggcuuccuucauugaggucaagacauguaccuggcccaaaagccacacacuguggucuaaugggguucucgaauccgagaugaucauuccgaagaucuacggaggcccuauuagccagcauaacuauagacccggguacuucacccagacggccggaccuuggcaccugggcaaacuugagcuggacuuugaucucugcgaagggaccacagugguggucgacgagcacugcggaaaucgcggccccucucugcggaccacaaccgugacgggcaagaucauccaugaaugguguugcagaagcuguacacugccuccccuucgguuccgcggggaggauggaugcugguacggcauggagauuagaccgguuaaagaaaaggaggaaaaccucgugcgguccauggucagcgcggggucuggagagguggacuccuuuagccugggcauccugugugcuuccauuaugaucgaagagguuaugagaucucgcuggagccggaagaugcucaugaccgggacacuggccguguuccuucugcucauuaccggacaacugaccuggaaugaccugaucagacuuugcauuauggucggcgccaacgcuuccgaucgcaugggcauggggacaacguaucuggcccucauggcgaccuuuaaaaugagaccuauguucgcugugggacugcucuuucggcgccugacaucuagagagguucuucugcucaccaucggccugagccugguggccuccgucgaacuucccaacucucuggaggaacucggggacggacuggccaugggcaucaugaugcucaagcugcuuacagaguuccagccccaccagcuguggaccacgcuccugagccugacauuuauuaaaaccacccuuucccuggauuacgcuuggaagacaaccgccauggcucucagcaucgugucucuguucccucucugucuguccacaacgagccagaaaaccacauggcuuccggugcugcuggggucuuuuggaugcaagccccucaccauguuccugauuacagaaaauaagaucuggggccggaaauccuggccucuuaacgagggcauuauggccaucgggaucgucagcauucugcucucuucccugcucaagaaugacguuccccuggcgggaccucuuaucgccggcgggaugcugauugcuuguuaugugaucagcggauccagcgccgaucugucucucgagaaagcugccgaagugagcugggagcaagaagccgagcauuccggcaccucucacaacauucuggucgaagugcaggacgaugggacgaugaagaucaaagacgaggagcgcgaugacacccuuacaauccugcucaaggcuacccugcucgcgguuagcggaguguaccccauguccauuccugccacacuguuugucugguauuucuggcagaaaaagaagcagagaucuggcgugcuuugggauacccccagcccgccugaaguugagcgggcugugcuggacgauggcaucuaccgcauucugcaaagagggcuccugggacggucccaggucggcgugggggucuuccaggacggaguguuucauacaauguggcacguuacgcgcggcgccgugcuuauguaucaggggaaaagacuggaacccucuugggccagcgucaagaaagaccucaucuccuacggaggcggcuggcgguuccaagggagcuggaauaccggagaggaggugcagguuauugcuguggaaccuggcaagaaccccaaaaauguccagacaaccccggggaccuuuaagacaccugagggagaagugggcgccaucgcgcuggauuucaagcccgggacgucuggauccccuauugugaacagagagggcaaaaucguuggccucuacgggaauggagucgugaccacaagcggcaccuaugugucugcuaucgcccaagccaaggcuucccaggaagggccccugcccgagauugaggacgaagucuuuaaaaagcgcaaccuuacaaucauggaucugcacccuggaagcggcaaaacccggagauaccugccggccauugugcgcgaggcgaucaagcggaagcucagaacgcugauucuugcucccacacgcguuguggccuccgaaauggccgaggcucugaaagggaugccuauccgguaucagaccaccgccgucaagucugaacauacaggcagagagaucguggaccucaugugccacgcuaccuucacaaugcgccugcugagccccguucgggugccuaauuacaacaugauuaucauggaugaggcccauuuuaccgaccccgcguccauugccgcuagaggauauaucagcacgcgggucggcaugggggaagccgcugccauuuucaugacagccaccccuccgggaucuguggaggcuuuuccccaguccaaugcgguuauccaagaugaagagcgcgacaucccugaaagaagcuggaacucuggcuacgauuggauuacagacuuccccgggaaaaccgugugguuugucccuagcaucaaguccggaaaugauauugccaacugucuccggaaaaacggcaagcgcgugauccagcuuucuagaaagacguucgacaccgaguaucagaaaacaaagaauaacgacugggauuacguggucaccacagacauuagcgagaugggggcuaauuuccgggccgauagaguuaucgacccccgccggugccugaaaccggugauucugaaggauggcccugaaagagugauccucgccggacccaugcccgucaccguggcuuccgccgcgcagcgccggggcagaaucgggcgcaaccaaaauaaagagggagaccaguacguuuauaugggccagccucugaacaaugaugaagaccacgcucauuggacagaggccaagaugcuucuggauaacauuaauacccccgaggggaucauuccugcccucuuugaaccggagcgggaaaagucugcugccaucgacggagaguacagacugcgcggcgaagcgagaaaaacguucguggagcugaugcggcgcggggaucuccccgucuggcuuagcuauaagguggccuccgagggcuuucaguacagcgacagacgguggugcuucgauggagaacgcaacaaucaaguucuggaggaaaacauggacguggagauuuggacaaaagaaggcgagagaaagaaacugcggccuagauggcucgacgcucgcaccuauucugauccccuggcccuucgggaguuuaaggaauucgcugccgggagacgcuccgucagcggagaccugauccucgagaucggcaaacugccucagcaccugacccuccgggcucagaaugcccuugauaaccuggugaugcugcacaauuccgaacaggggggaaaggcguacagacaugccauggaggaacuccccgacacaauugagacccugaugcuucuggcucucaucgccguccugacaggcggcgugacgcuguuuuuccucucugggaagggacuuggcaaaaccagcauugggcugcuguguguuacagcuuccucugcccuccuguggauggccagcguggagccgcacuggaucgcugcguccauuauccuugaauuuuuccugauggugcuccugaucccugagcccgaucggcaacgcaccccucaggacaaccagcuggccuaugucguuauuggacuccuuuuuaugauccugacaguggcugccaacgaaaugggccugcucgagaccacgaagaaagaucuggggauuggacauguggccgcugagaaucaccaacacgccaccaugcuugacgucgaucugagacccgcgagcgccuggacacucuacgcuguggccaccacaguuaucaccccuaugaugcggcauacgauugaaaacacaaccgcuaauaucucucugacagccauugcgaaccaggccgcuauccugaugggccucgacaagggcuggcccaucuccaaaauggauauuggggugccgcuucuggcccugggaugcuacagccaggucaauccucucacccugaccgcugccgugcuuaugcuggucgcucacuaugccaucauuggccccgggcuccaggcgaaggccacacgcgaggcucaaaagagaacggccgcuggaaucaugaaaaaccccaccguggacggcauuguugccaucgaucuggacccuguggucuacgacgccaaguucgaaaaacagcuggggcagaucaugcuccuuauucuguguacaucucagauccugcucaugcggaccacaugggcgcugugcgaguccauuacccuugcuacgggaccgcugacaacccucugggaaggcagccccggcaaguuuuggaauaccacaaucgccgugucuauggcuaacauuuuccgcgggagcuaucuggccggagccggccuggcuuucucccucaugaaaucucuugggggaggcagacgggggaccggagcccaaggcgagacacugggcgagaaguggaagcgccagcugaaucagcucagcaaauccgaauuuaacacguacaagagaagcgggaucauggagguugaucgguccgaagcgaaagagggacugaagagaggcgaaaccacaaaacaugccgugucucgcgggaccgcuaagcuucggugguucgucgagagaaaucuggugaagccugagggaaaagugaucgaccucggcugugggcgcggaggcuggagcuauuacugcgccggccugaagaaaguuacagaagucaagggguauaccaaaggaggccccgggcacgaggaaccuauucccauggcuacguacggauggaaccuggugaagcuccauuccggcaaagauguguuuuucaugccuccggagaagugugacacccuucugugcgauaucggggaaucuagccccaauccuacaauugaggagggacggacccugagaguccucaagaugguugaacccuggcugcgcggcaaccaguuuuguaucaaaauucuuaauccuuacaugcccuccgugguggagacacuggaacaaaugcagcggaagcacggcgggaugcucgucagaaacccgcugucucgcaauagcacccacgagauguauuggguguccugcggaacaggcaacaucguuagcgccgugaacaugaccucucggaugcugcucaauagauucacgauggcgcaucgcaaaccuacauacgagcgggacgucgaucugggggccggaaccagacacguggcuguugaacccgagguggccaaccuugacauuaucggccagcgcaucgaaaauauuaagaacgagcauaaauccaccuggcacuaugaugaagacaaucccuacaagacaugggcuuaucacgggagcuacgaggucaagccuucuggauccgccagcucuauggugaacggcguggucagacugcucacgaaacccugggauguuaucccuauggugacccaaauugcuaugacagacaccacaccguuuggccagcagcggguguucaaggagaaagucgacacccgcacacccagagccaagcgggggaccacgcagaucauggaagugaccgcgaaauggcuguggggauuucuuuccagaaauaagaagccucggauuuguacacgcgaggaauucaccagaaaaguucggagcaacgccgcuaucggcgccguguuugucgaugagaaucaauggaacuccgcuaaggaagccguggaggacgagcgcuucugggaucugguucauagagaacgggagcuccacaaacaggggaagugcgccacaugcguguauaauaugaugggaaaacgcgaaaagaagcugggcgaguuugggaaagcgaagggcagcagagcuaucugguacauguggcugggagcccgguuccucgaauucgaggcccugggcuuuaugaacgaggaccauugguucucucgcgaaaauagccuuuccggggucgagggagaaggccugcacaaacucggguacauucugagagauaucucuaagauucccggaggcaacauguaugcugacgauaccgccgggugggacacgcggaucacagaggaugaccuucagaaugaggcuaaaauuaccgauaucauggaaccugagcaugcccugcucgcgacaagcaucuuuaagcugaccuaccagaacaaagugguucgcgugcaaagacccgccaagaacggcacggucauggacgugauuucccggcgcgaucagagaggaucuggccaggucgggaccuauggacugaauacauucaccaacauggaagugcagcucauccggcaaauggagagcgaaggcauuuuucugccguccgagcuugagacaccuaaucuggcugaaagaguucucgacuggcuggagaagcacggggccgaacgccuuaaacggauggcuaucucuggagacgauuguguggucaagcccauugacgauagauucgccaccgcgcugacagcccucaacgacaugggcaaagugcgcaaggauaucccucagugggagcccagcaaaggguggaaugacuggcagcaggugccuuuuugcucccaccauuuccaccaacugaucaugaaggauggccgggaaauuguugugcccuguagaaaccaggacgagcuggucggacgcgcucgggugagccagggcgccggguggucucucagagagaccgcuugccugggaaaguccuacgcccaaauguggcagcuuauguauuuucaucgccgggaucugagacucgcugccaaugcgaucuguagcgccguuccgguggacugggucccuacgucucgcacaaccugguccauucacgcucaccaucaguggaugaccacagaagauaugcugagcguguggaaccgggucuggaucgaggaaaaucccuggauggaggacaaaacccacguguccucuugggaagagguucccuaccuuggcaagagagaggaccaguggugcgggagccugauuggacucacagcccgggccacgugggcuaccaacauccaaguggccauuaaucaggucagacgccugaucggcaacgaaaauuaucuggauuacaugacauccaugaaacgguucaagaacgagagcgacccugaaggggcgcucugguga

SEQ ID NO: 18688 - RNA, 9879 nt, Artificial Sequence
  derived and/or modified CDS sequence (opt5) from DENV-1__FJ024479__SS-prME
agcgugaccaugcugcucaugcugcuucccaccgcccuggcuuuccaccucacgaccagaggcggggaaccucacaugaucgucuccaagcaggaacggggaaagucucugcuuuuuaagacaagcgccggcguuaacaugugcacccugauugcgauggaccucggggaacugugugaagauacaaugaccuacaaaugcccgcagaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagaacaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccgcccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcuuuuucacgacaaauauuuggcugaaacuuagagacagcuacacccaaaugugcgaucaccgccucauguccgcggccaucaaagacagcaaggcuguccaugccgauaugggcuauuggauugaaucugagaaaaacgaaacauggaagcuggcccgggcuuccuucaucgagguuaagaccuguacauggcccaaaagccacacccuguggucuaauggggugcucgaauccgagaugaucauuccgaagaucuacggaggcccuauuagccagcauaacuauagacccggguacuuuacgcagaccgccggaccuuggcaccugggcaaacuugagcuggacuucgaucucugcgaagggacaaccguggucguggacgagcacugcggaaaucgcggccccucucugcggacaaccacgguuacaggcaagaucauucaugaaugguguugcagaagcuguacccugccuccccuucgguuucgcggggaggauggaugcugguacggcauggagaucagaccggugaaagaaaaggaggaaaaccucguccgguccauggugagcgcggggucuggagagguugacuccuucagccugggcauccugugugcuuccauuaugaucgaagaggugaugagaucucgcuggagccggaagaugcucaugacagggacccuggccgucuuucuucugcucauuaugggacaacugaccuggaaugaccugaucagacuuugcauuauggugggcgccaacgcuuccgaucgcaugggcauggggacaacguaucuggcccucauggcgaccuucaaaaugagaccuauguuugcuguuggacuccuguuccggcgccugacaucuagagaggugcuucugcucaccaucggccugagccuggucgccuccguggaacuucccaacucucuggaggaacucggggacggacuggccaugggcauuaugaugcucaagcugcuuacagaguuucagccccaccagcuguggaccacgcuccugagccugacauucaucaaaaccacccuuucccuggauuacgcuuggaagacagccgcuauggcccucagcaucgugucucuguuuccucucugucuguccaccacaagccagaaaacgaccuggcuuccgguccugcuggggucuuucggaugcaagccccucacaauguuucugauuaccgaaaauaagaucuggggccggaaauccuggccucuuaacgagggcauuauggcgaucgggauuguuagcauccugcucucuucccugcucaagaaugacgugccccuggccggaccucuuaucgcuggcgggaugcugauugccuguuaugugaucagcggauccagcgcugaucugucucucgagaaagccgccgaagucagcugggagcaagaagcugagcauuccggcacaucucacaacauucugguggaaguucaggacgaugggaccaugaagaucaaagacgaggagcgcgaugacacgcuuaccauucugcucaaggcgacacugcucgccgugagcggagucuaccccauguccaucccugcuacccuguucgugugguauuucuggcagaaaaagaagcagagaucuggcguucuuugggauacacccagcccgccugaaguggagcgggccguccuggacgauggcaucuaccgcauucugcaaagagggcuccugggacggucccaggugggcgucgggguguuucaggacggaguuuuccauaccauguggcacgugacacgcggcgccguccuuauguaucaggggaaaagacuggaacccucuugggcuagcgugaagaaagaccucaucuccuacggaggcggcuggcgguuucaagggagcuggaauacgggagaggagguucaggugauugccgucgaaccuggcaagaaccccaaaaaugugcagaccacaccggggaccuucaagaccccugagggagaagugggcgcgaucgcucuggauuuuaagcccgggacaucuggauccccuauuguuaacagagagggcaaaaucgucggccucuacgggaauggaguggugacgaccagcggcacauaugucucugccauugcccaagcuaaggccucccaggaagggccccugcccgagaucgaggacgaaguguucaaaaagcgcaaccuuaccaucauggaucugcacccuggaagcggcaaaacacggagauaccugccggcgauuguucgcgaggcuaucaagcggaagcucagaacccugauucuugcccccacgcgcguggucgccuccgaaauggcugaggcccugaaagggaugccuauccgguaucagacaaccgcugugaagucugaacauaccggcagagagauuguugaccucaugugccacgccacauuuaccaugcgccugcugagccccgugcgggucccuaauuacaacaugaucaucauggaugaggcgcauuucacagaccccgccuccauugcugccagaggauauaucagcacccgggugggcaugggggaagcugccgccauuuuuaugacggcuacaccuccgggaucuguugaggcguucccccaguccaaugccgugauccaagaugaagaacgcgacauuccugaaagaagcuggaacucuggcuacgauuggaucaccgacuuucccgggaaaacagucugguucgugccuagcaucaaguccggaaaugauauugcuaacugucuccggaaaaacggcaagcgcgugauccagcuuucuagaaagaccuucgacacggaguaucagaaaaccaagaauaacgacugggauuacgucguuacaaccgacauuagcgagaugggggccaauuuucgggccgcuagagugaucgauccccgccggugccugaaaccggugauucugaaggacggcccugaaagagucauccucgccggacccaugcccgugacaguugcguccgcugcccagcgccggggcagaauugggcgcaaccaaaauaaagagggagaucaguacguguauaugggccagccucugaacaaugacgaagaucacgcccauuggaccgaggcuaagaugcuucuggacaacaucacaacccccgaggggaucauuccugcccucuucgaaccggagcgggaaaagucugcggccaucgauggagagagcagacugcgcggcgaacccagaaaaacguuugucgagcugaugcggcgcggggaccucccuguguggcuuuccuacaagguugcuagcgagggcuuccaguauucugauagacgguggugcuuugacggagaacgcaauaaccaagugcuggaggaaaauauggaugucgagauuuggcccaaagaaggcgagagaaagaaacugcggccuagauggcucgacgcccgcacauacuccgacccccuggcucuuggggaguucaaggaauuuggagccggccggagaagcggguccggagcucugauccucgagauuggcaaacugccgcagcaucugccucuccgcgcccagaacggccuugauaaucuggugaugguccacaacucugaacaagggggaaaggcguaucggcaugccauggaggaacugcccgacaccaucgagacccucaugcugcuugcucugaucgccgugcucacaggcgggguuacccuguucuuucugagcggaaagggccucgggaaaacauccauuggacuucugugugugacggcuucuagcgcccugcucuggauggccuccguggagccucacuggaucgcugcgagcauuauccuggaguucuuucuuaugguccugcucauucccgagccugauagacaacggacaccccaggacaaucagcuggccuacguugugaucggccuccuguucaugauccuuacaguggcugccaacgaaaugggccugcuggagaccacaaagaaagaucucgggauuggacaugucgccgcugagaaccaccaacacgccaccaugcuggacguggaucuucgcccggcgucugccuggacgcuguaugcuguugccaccacagugaucaccccuaugaugagacauacaauugaaaauaccacggcuaacaucucccucacagccauugcgaaucaggccgcuauccugaugggccuggccaagggguggcccauuagcaaaauggacaucggagucccccuccuugcucugggcugcuacucucaggugaacccucugacccucacagccgcuguccugaugcuuguggcccacuacgcgaucauugggccgggacugcaggccaaggcuacccgggaggcccaaaagcgcaccgcugccggcaucaugaaaaaucccacaguugauggcauuguggccaucgaccucgauccugucguguaugacgcgaaguuugaaaaacagcuggggcagauuaugcugcucauccuuuggacgucccagauccugcugaugagaaccacaugggcucucggagagagcauuacccuggccacaggcccccuuaccacgcugugggaagggucuccuggaaaguucuggaacacaaccaucgcuguuagcauggccaauauuuuccggggcuccuaccucgccggggcuggacuggccuuuucucugaugaaaagccucggcggcgggcgcagaggaaccggcgcgcaaggggagacacuuggagagaaguggaagcggcagcugaaccagcuguccaaaagcgaguucaauaccuauaagcgcuccggcaucauggagguggauagaucugaagccaaagaggggcucaagcggggagaaacaacgaaacaugcugucagcagaggcaccgccaagcugcgcugguuuguggagcggaaccuugugaaucccgagggcaagguuauugaccugggguguggaagaggcgggugguccuacuauugcgcuggacucaaaaaggucacagaagugaaaggcuacaccaaagggggaccuggccacgaggaaccgauccccauggccacauauggcuggaaccuggugaaacugcauucugggaaggacgucuucuuuaucccucccgagaaaugugauacccuccuuugcgacauuggagaaagcuccccuaaucccacgaucgaggagggccgcacccugcgggggcugaagaugguugaaccguggcucagaggaaaccaguucuguauuaagauccugaauccuuacaugcccucugugguggagacacuugaacaaaugcagcgcaaacacggcgggaugcugguccggaacccccucagcagaaauuccacccacgagauggauugggugagcugcggaacaggcaacauuguuucugcggugaacaugaccucccgcaugcugcugaaucgguuuacaauggcccauagaaagccuaccuacgagcgcgacgucgaucucggcgcugggacgcggcacguggccguugaacccgagguggcuaaccuggacaucauuggacagagaaucgaaaauaucaaaaacgagcauaagagcacauggcacuaugaugaagacaauccuuacaaaaccugggccuaucacggcucuuacgaggucaagccguccgggagcgcuucuuccauggugaacggagugguccgccuucugaccaagcccugggauguuauuccuauggugacacaaaucgccaugacggacaccacacccuucggccagcagagaguguuuaaagagaaggucgauacccggacaccucgcgcgaaaagagggaccacacagauuauggaagugaccgccaaguggcucuggggcuuccugagccggaauaaaaagcccagaaucuguacgcgggaggaauuuacccgcaagguuagauccaacgcugccauuggagcuguggucguggacgagaaucaauggaacagcgccaaagaagccggcgaggacgagcggguuugggaucuuggggaccgcgaaagagagcugcauaagcagggaaaaugcgcgacauguggcuauaauaugauggggaagcgggagaagaagcucggagaguucggcaaggcuaaagggucucgcgccaucugguacauguggcugggcgccagauuucuggaguucgaggcucucggauucaugaacgaggaucacugguuuagccgggaaaauucccugucuggcguggagggggaaggacuucauaagcugggcuauauccuccgcgacauuagcaaaauccccgggggaaacauguacgccgaugacaccgcuggcugggauacaagaauuaccgaggacgaucugcagaaugaggccaagaucacggacauuauggaaccugagcacgcgcuucuggccacauccaucuucaaacucaccuaccagaacaaggucgugcggguucaacgccccgcuaaaaacgggacagugauggaugucaucucuagacgggcccagcgcggcagcggacaggugggcaccuaugggcugaauacguuuaccaacauggaaguccagcugauuagacaaauggaguccgaaggaaucuuccucccuucugagcuggagacacccaaucuugcugaacgggugcuggacuggcucgagaagcauggcgccgaaagacugaagcgcauggcgauuagcggggaugacugcguugugaaaccuaucgacgaucgguuugccaccgcucuuacagcccugaacgacaugggaaaggucagaaaagauauuccccagugggagccguccaagggcuggaaugacuggcaacagguggcuuucuggagccaccacuuucaucaacucaucaugaaagaugggcgcgaaaucgugguuccuugccggaaccaggacgagcugggcggcagagcucgcgugucucagggagcuggguggucccugcgggagaccgccugucucggaaagagcuacgcgcaaauguggcagcugauguauuuccacagacgcgaucuucggcuggccgcuaaugccauuugcucugccguccccguggacuggguucccacauccagaaccacguggagcauccaugcucaccaccaguggaugacaaccgaagauaugcucuccguguggaaccgcgucuggauugaggaaaauccuuggauggaggacaagacccaugugucuagcugggaagaggucccguaccugggcaaacgggaggaucaguggugugggucccuuaucggacugacagccagagcgaccugggcuacaaacauucaaguggccaucaaucagguucggagacucauuggcaacgaaaauuaucuggacuacaugacgagcaugaagcgcuuuaaaaacgagucugaccccgaaggcgcccugugguga

SEQ ID NO: 18689 - RNA, 9879 nt, Artificial Sequence
  derived and/or modified CDS sequence (opt5) from DENV-1__FJ182002__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaccggacaacugacauggaaugaccugauuagacuuugcaucauggugggcgccaacgcuuccgaucgcaugggcauggggacgaccuaucuggcccucauggcgacauuuaaaaugagaccuauguucgcuguuggacugcucuuucggcgccugaccucuagagaggugcuucugcucacaauuggccugagccuggucgccuccguggaacuucccaacucucuggaggaacucggggacggacuggccaugggcaucaugaugcucaagcugcuuaccgaguuccagccccaccagcuguggacgacacuccugagccugaccuuuaucaaaaccacacuuucccuggauuacgcuuggaagaccacagccauggcucucagcauugugucucuguucccucucugucuguccacgaccagccagaaaacaaccuggcuuccgguccugcuggggucuuuuggaugcaagccccucacaauguuccugaucaccgaaaauaagauuuggggccggaaauccuggccucuuaacgagggcaucauggccauugggaucguuagcauccugcucucuucccugcucaagaaugacgugccccuggcgggaccucuuauugccggcgggaugcugaucgcuuguuaugugauuagcggauccagcgccgaucugucucucgagaaagcugccgaagucagcugggagcaagaagccgagcauuccggcacgucucacaacauccugguggaaguucaggacgaugggaccaugaagauuaaagacgaggagcgcgaugacacacuuaccauccugcucaaggcuacacugcucgcggugagcggagucuaccccauguccaucccugccacccuguuugugugguauuucuggcagaaaaagaagcagagaucuggcguucuuugggauacacccagcccgccugaaguggagcgggcuguccuggacgauggcauuuaccgcauccugcaaagagggcuccugggacggucccaggugggcgucgggguguuccaggacggaguuuuucauacgauguggcacgugacccgcggcgccguccuuauguaucaggggaaaagacuggaacccucuugggccagcgugaagaaagaccucauuuccuacggaggcggcuggcgguuccaagggagcuggaauacaggagaggagguucaggugaucgcugucgaaccuggcaagaaccccaaaaaugugcagaccaccccggggacauuuaagacgccugagggagaagugggcgccauugcgcuggauuucaagcccgggaccucuggauccccuaucguuaacagagagggcaaaauugucggccucuacgggaauggaguggugacaaccagcggcacauaugucucugcuaucgcccaagccaaggcuucccaggaagggccccugcccgagaucgaggacgaaguguuuaaaaagcgcaaccuuaccauuauggaucugcacccuggaagcggcaaaacgcggagauaccugccggccaucguucgcgaggcgauuaagcggaagcucagaacacugauccuugcucccacccgcguggucgccuccgaaauggccgaggcucugaaagggaugccuauucgguaucagaccacagccgugaagucugaacauaccggcagagagaucguugaccucaugugccacgcuacauucaccaugcgccugcugagccccgugcgggucccuaauuacaacaugaucauuauggaugaggcccauuuuacggaccccgcguccaucgccgcuagaggauauauuagcacacgggugggcaugggggaagccgcugccaucuucaugaccgccacaccuccgggaucuguugaggcuuuuccccaguccaaugcggugauucaagaugaagagcgcgacaucccugaaagaagcuggaacucuggcuacgauuggaucaccgacuuccccgggaaaacggucugguuugugccuagcauuaaguccggaaaugauaucgccaacugucuccggaaaaacggcaagcgcgugauucagcuuucuagaaagaccuucgacacagaguaucagaaaaccaagaauaacgacugggauuacgucguuacaaccgacaucagcgagaugggggcuaauuuccgggccgauagagugauugacccccgccggugccugaaaccggugauccugaaggauggcccugaaagagucauucucgccggacccaugcccgugacaguugcuuccgccgcgcagcgccggggcagaaucgggcgcacccaaacgaaagagggagaccaguacguguauaugggccagccucugaacaaugaugaagaccacgcucauuggacagaggccaagaugcuucuggccaacaucaauacccccgaggggauuaucccugcucucuuugaaccggagcgggaaaagucucccgccauugauggagaguacagacugcgcggcgaagcgagaaaaaccuucgucgagcugaugcggcgcggggaccucccuguguggcuuagcuauaagguugccuccgagggcuuucaguacagcgauagacgguggugguucgacggagaacgcaacaaucaagugcuggaggaaaacauggaugucgagaucuggacaaaagaaggcgagagaaagaaacugcggcccagauggcucgacgcucgcaccuauucugacccucuggcccuuggggaguuuaaggaauucggagcuggccggagauccgggagcggagaucugauucucgagaucggcaaacugccccagcaccugacacuccgcgcccagaauggccuugacaaccuggugaugguccacaauuccgaacaggggggaaaggcuuaccggcaugccauggaggaacugccggauacgaucgagacccucaugcugcuugcgcugauugccgugcucacaggcgggguuacccuguuuuuccugucuggaaagggccucgggaaaacaagcaucggacuucugugcgugaccgcuuccucugcccugcucuggauggcuagcguggagccucacuggauugccgccuccaucauucuggaauuuuuccuuaugguccugcucauccccgagccugacagacaacggacgccccaggauaaccagcuggcuuauguugugaucggccugcucuuuaugauucuuaccguggcggccaaugaaaugggccugcuggagacaaccaagaaagaccucgggaucggacaugucgcugccgagaaccaccaacacgccacaaugcuggauguggaccuucgcccugcuagcgccuggacccuguacgcgguugccacgacagugauuacccccaugaugagacauacaaucgaaaacaccaccgcuaauauuucucucacagccaucgcuaaccaggccgcgauucugaugggccuggauaagggguggccgaucuccaaaauggacaucggagucccucuccuugcccugggcuguuacagccaggugaauccccugacgcucaccgcugccguccugaugcuuguggcucacuaugccauuaucgggcccggacugcaggcuaaggccacacgggaggcgcaaaagcgcaccgccgcuggcauuaugaaaaacccuacaguugauggcaucguggccauugaccucgauccggucguguacgacgcuaaguucgaaaaacagcuggggcagaucaugcugcucauccuuugcaccucucagauucugcugaugagaacgacaugggcccucugugaguccaucacccuggccaccggaccccuuacaacccugugggaaggcagcccugggaaguuuuggaauacaacgauugcgguuucuauggcuaacaucuuccggggaagcuaucucgccggcgcugggcuggccuucucccugaugaaaucucucggaggcggccgcagagggaccggagcccaaggcgagacacuuggggagaaguggaagcggcagcugaaucagcugagcaaauccgaauuuaacaccuacaagcgcagcggaauuauggagguggacagauccgaagcuaaagagggccucaagcggggggaaacaaccaaacaugccgucucuagaggaacggcgaagcugcgcugguucguggagcggaaucuugugaagcccgagggcaaaguuaucgaucugggcugcgggagaggaggcuggagcuauuacugugccgggcucaagaaagucaccgaagugaagggauauacaaaaggcgggccuggacacgaggaacccaucccuauggcuaccuacggcuggaaccuggugaagcugcauuccggcaaagacgucuuuuucaugccgcccgagaagugcgauacacuccuuugugacauuggggaaucuagcccuaaucccaccaucgaggagggacgcacacugcggguucugaagaugguggaaccuuggcucagaggcaaccaguuuugcauuaaaauccugaaucccuacaugccguccguggucgagacccuugaacaaaugcagcgcaagcacgggggaaugcuggugcggaacccucucucuagaaauagcacgcacgagauguauuggguuuccuguggcacagggaacauugugagcgccgucaauaugaccucucgcaugcugcugaaccgguucaccauggcucauagaaaacccacauacgagcgcgauguggaccucggagccggcacgcggcacguugcgguggaacccgaggucgccaaccuggauaucauuggccagagaaucgaaaauaucaagaacgagcauaaauccaccuggcacuaugacgaagauaauccuuacaagacaugggcuuaucacgggagcuacgaggugaagcccucuggauccgccagcucuauggugaacggcgucguucgccuucugaccaaaccuugggacgugauuccgauggugacacaaaucgcuaugaccgauacaacccccuuugggcagcagagagucuucaaggagaaaguggacacgcggaccccucgcgccaagagaggaacaacccagauuauggaaguuacagcuaaauggcucuggggcuuucugucccggaauaagaagcccagaaucugcacccgggaggaauucacgcgcaaagugagaagcaacgccgcgauuggggccgucuuuguggacgagaaucaauggaacuccgcuaaggaagccggcgaggaugagcggguuugggaccuuguggaucgcgaaagagagcugcauaaacagggaaaguggggcacagggggauauaauaugaugggcaaacgggaaaagaagcucggggaguucggaaaagcuaagggcagccgcgggaucugguacauguggcugggcgccagauuucuggaauucgaggcccucggauucaugaacgaggaccacugguuuucucgggaaaauagccuguccggcgucgagggggaaggacuucauaaacugggcuacauccuccgcgauauuucuaagaucccugggggaaacauguaugcggacgauaccgcuggcugggacacaagaauuaccgaggaugaccugcagaaugaggccaaaaucacggauauuauggaacccgagcacgcccuucuggcuaccagcaucuucaagcucacauaccagaacaaagugguucgggugcaacgcccggccaagaaugggaccgucauggacgugaucuccagacgggaucagcgcggcucuggacaggucggcacauaugggcugaacaccuuuacaaacauggaagugcagcugauuagacaaauggagagcgaaggaaucuuccucccuuccgagcuggagacccccaaucuugcugaacggguucuggacuggcucgagaagcauggcgccgaaagacugaaacgcaugccuauuucuggggacgauuguguggucaagcccaucgacgaucgguuugcgacggcccuuacagcucugaacgacaugggaaaagugagaaaggauauuccucagugggagcccagcaaaggcuggaaugacuggcagcaggugccguucuggucccaccacuuucaucaacucaucaugaaggaugggcgcgaaaucguugugccuugccggaaccaggacgagcuggucggcagagcccgcgugagccagggagcuggcuggucucugcgggagaccgccuggcucgggaaguccuacgcgcaaaugggacagcugauguauuuccacagacgcgaucuucggcuggccgcuaaugccauuuggagcgcuggccccggggacuggguucccaccucuagaacaaccugguccauccaugcccaccaccaguggaugacaacggaagauaugcucagcguguggaaccgcgucuggauugaggaaaauccuuggauggaggacaaaacccauguguccucuugggaagaggucccguaccugggaaagcgggaggaccaguggugcggcagccuuaucggccugacagcuagagccaccugggcgacaaacauucaaguggccaucaaucagguucggagacucauugggaacgaaaauuaucuggauuacaugaccuccaugaaacgcuuuaagaacgagagcgaccccgaaggagcucugugguga

SEQ ID NO: 18690 - RNA, 9879 nt, Artificial Sequence
  derived and/or modified CDS sequence (opt5) from DENV-1__FJ024482__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuuccucacccaggacgaaaagggggugacacagaacggaagacugaucacggcuaaucccauugucaccgauaaagagaagccugugaacaucgaaacagagccccccuuuggcgagucuuauauugugguuggggccggagaaaaagcccugaagcucuccugguucaagaaaggcagcucuaucgggaagauguuugaggcuaccgcccggggcgcuagacgcauggccauucugggagacacagcgugggauuucggcagcaucgggggagucuuuaccuccgugggcaaacuugugcaucaggucuucgggacggccuacggagugcuguuuucuggcguuagcuggaccaugaagaucgggauuggcauccuccugacauggcugggacuuaauucccggagcaccucucucuccaugacauguauugcugugggcauggucacccuguaccugggggugaugguucaagccgacagcggaugcgugaucaacuggaaaggcagagaacucaagugugggucuggaauuuucgucacaaacgaggugcacaccuggacggaacaguauaaguuucaggcugauuccccuaaacgccugagcgccgcgaucggcaaggccugggaggaggggguuugcggcauucgguccgcuacaagacuugaaaauaucauguggaaacagaucucuaacgagcugaaucauauucuccuggaaaacgacaugaaguucaccguggucgugggagacgccaauggcauccuggcucaagggaaaaagaugauucgcccgcagcccauggagcacaaauacagcuggaaguccuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcuuaagcucagagacucuuacacccaaaugugcgaucaccgccugaugagcgcggccauuaaagacuccaaggcuguccaugccgauaugggcuauuggaucgaaagcgagaaaaacgaaacauggaagcuggcccgggcuucuuucaucgagguuaagaccuguacauggcccaaaucccacacccucuggagcaauggggugcuggaaucugagaugauuaucccgaagauuuacggaggcccuaucucccagcauaacuauagacccggguacuucacgcagaccgccggaccuuggcaccuuggcaaacuggagcucgacuuugaucugugcgaagggacaaccguggucguggacgagcacugcggaaaucgcggccccagccugcggacaaccacgguuacaggcaagauuauccaugaaugguguugcagaucuuguacccuuccuccccuccgguuccgcggggaggauggaugcugguacggcauggagaucagaccggugaaagaaaaggaggaaaaccugguccggagcaugguguccgcggggagcggagagguugacucuuuuucccugggcauucucugugcuagcaucaugauugaagaggugaugagaucccgcuggucucggaagaugcugaugacagggacccuugccgucuuccugcuccugaucaugggacaacugaccuggaaugaccuuauuagacugugcaucauggugggcgccaacgcuagcgaucgcaugggcauggggacaacguaucucgcccugauggcgaccuuuaaaaugagaccuauguucgcuguuggacuccuguuucggcgccuuacauccagagaggugcugcuccugaccauuggccugucucuugucgccagcguggaacugcccaacucccucgaggaacugggggacggacucgccaugggcaucaugaugcugaagcuucugacagaguuccagccccaccagcucuggaccacgcugcugucucuuacauuuaucaaaaccacccugagccucgauuacgcuuggaagacaaccgccauggcucuguccauugugagccucuucccucugugucuuucuacaacgucccagaaaaccacauggcugccgguccugcucgggagcuuuggaugcaagccccugaccauguuccuuaucacagaaaauaagauuuggggccggaaaucuuggccucugaacgagggcaucauggccauugggaucguuuccauccuccugagcucucuccugaagaaugacgugccccuugcgggaccucugauugccggcgggaugcugaucgcuuguuaugugauuuccggaagcuccgccgaucucagccuggagaaagcugccgaagucucuugggagcaagaagccgagcauagcggcaccucccacaacauccuuguggaaguucaggacgaugggacgaugaagauuaaagacgaggagcgcgaugacacccugacaauccuccugaaggcuacccuccuggcggugucuggagucuaccccaugagcaucccugccacacuuuuugugugguauuucuggcagaaaaagaagcagagauccggcguucugugggauacccccucuccgccugaaguggagcgggcuguccuggacgauggcauuuaccgcauccuccaaagagggcugcuuggacggagccaggugggcgucgggguguuccaggacggaguuuuucauacaauguggcacgugacgcgcggcgccguccugauguaucaggggaaaagacucgaacccuccugggccucugugaagaaagaccugauuagcuacggaggcggcuggcgguuccaaggguccuggaauaccggagaggagguucaggugaucgcugucgaaccuggcaagaaccccaaaaaugugcagacaaccccggggaccuuuaagacaccugagggagaagugggcgccauugcgcucgauuucaagcccgggacgagcggaucuccuaucguuaacagagagggcaaaauugucggccuguacgggaauggaguggugaccacauccggcaccuaugucagcgcuaucgcccaagccaaggcuucucaggaagggccccuucccgagaucgaggacgaaguguuuaaaaagcgcaaccugacaauuauggaucugcacccuggauccggcaaaacccggagauaccucccggccaucguucgcgaggcgauuaagcggaagcugagaacgcuuauccuggcucccacacgcguggucgccagcgaaauggccgaggcucucaaagggaugccuauucgguaucagaccaccgccgugaaguccgaacauacaggcagagagaucguugaccugaugugccacgcuaccuucacaaugcgccugcucucucccgugcgggucccuaauuacaacaugaucauuauggaugaggcccauuuuaccgaccccgcgagcaucgccgcuagaggauauauuuccacgcgggugggcaugggggaagccgcugccaucuucaugacagccaccccuccgggaagcguugaggcuuuuccccagucuaaugcggugauucaagaugaagagcgcgacaucccugaaagauccuggaacagcggcuacgauuggaucacagacuuccccgggaaaaccgucugguuugugccuucuauuaagagcggaaaugauaucgccaacugucuucggaaaaacggcaagcgcgugauucagcuguccagaaagacguucgacaccgaguaucagaaaacaaagaauaacgacugggauuacgucguuaccacagacaucucugagaugggggcuaauuuccgggccgauagagugauugacccccgccggugccugaaaccggugauccucaaggauggcccugaaagagucauucuggccggacccaugcccgugaccguugcuagcgccgcgcagcgccggggcagaaucgggcgcaaccaaaauaaagagggagaccaguacguguauaugggccagccucuuaacaaugaugaagaccacgcucauuggacagaggccaagaugcugcucgauaacaucaauacccccgaggggauuaucccugcccuguuugaaccggagcgggaaaaguccgcugccauugacggagaguacagacugcgcggcgaagcgagaaaaacguucgucgagcucaugcggcgcggggaucuucccguguggcugucuuauaagguugccagcgagggcuuucaguacuccgacagacgguggugcuucgauggagaacgcaacaaucaagugcuggaggaaaacauggacgucgagaucuggccuaaagaaggcgagagaaagaaacuccggcccagauggcuggacgcucgcacauauagcgauccucuugcccugcgggaguuuaaggaauucgcugccgggagacgcucuguguccggagaccucauucuggagaucggcaaacugccccagcaccucacccuucgggcucagaaugcccuggauaaccuggucauggugcacaauagcgaacaggggggaaaggcguacagacaugccauggaggaacucccggacaccaucgagacacugaugcuucuggcucucauugccguucugaccggcggcgugacacuguuuuuccucuccgggaagggacuuggcaaaacgucuaucgggcugcugugugugaccgcuagcuccgcccuccuguggauggccucugucgagccucacuggauugcugcgagcaucauucuugaauuuuuccugaugguucuccugauccccgagccugaucggcaacgcacaccccaggacaaccagcuggccuauguggugaucggacuccuuuuucugauucugaccgucgcugccaacgaaaugggccuccuggagacaaccaagaaagaucuugggaucggacauguggccgcugagaaucaccaacacgccacgaugcuggacguugaucucagaccugcguccgccuggacccuguacgcuguggccacaaccgucauuacacccaugaugcggcauaccaucgaaaacacgacagcuaauauuagccugaccgccaucgcgaaccaggccgcuauucucaugggccuugacaagggcuggccgaucucuaaaauggauaucggggugccucugcuggcccucggaugcuacucccaggucaauccccugacacuuaccgcugccgugcugaugcucguugcucacuaugccauuaucggccccgggcugcaggcgaaggccacccgcgaggcucaaaagagaacagccgcuggaauuaugaaaaacccuacgguggacggcaucgucgccauugaucuggacccggugguuuacgacaccaaguucgaaaaacagcucgggcagaucaugcuucugauccuguguacaagccagauucuccugaugcggaccacaugggcccuuugcgagucuaucacccuggcgacgggaccccucacaacccugugggaaggcuccccuggcaaguuuuggaauaccacaauugcugugagcauggccaacaucuuccgcgggucuuaucuggcuggagccggccucgccuucagccuuaugaaaucccuggggggaggcagacgggggaccggagcucaaggcgagacacugggcgagaaguggaagcgccagcucaaucagcugucuaaaagcgaauuuaacacguacaagagauccgggauuauggaggucgaucggagcgaagccaaagagggacuuaagagaggcgaaaccacaaaacaugcggugucccgcgggaccgccaagcugcggugguucguggagagaaaucucguuaagcccgagggaaaagucaucgaccugggcugugggcgcggaggcuggucuuauuacugcgcuggccugaagaaagugacagaagugaagggguauaccaaaggaggcccugggcacgaggaacccaucccuauggccacguacggauggaaccucgucaagcuucauagcggcaaagauguuuuuuucaugccgcccgagaagugugacacccugcugugcgauauuggggaauccucuccuaaucccacaaucgaggagggacggacccucagagugcugaagaugguggaaccuuggcuucgcggcaaccaguuuuguauuaaaauccugaaucccuacaugccgagcgucguggagacacucgaacaaaugcagcggaagcacggcgggaugcugguuagaaacccucugucccgcaauucuacccacgagauguauugggugagcugcggaacaggcaacauugucuccgcugugaacaugaccagccggaugcuccugaauagauucacgauggcccaucgcaaacccacauacgagcgggacguugaucuuggggcgggaaccagacacguggccgucgaacccgagguggcuaaccuggacaucauuggccagcgcaucgaaaauaucaagaacgagcauaaaucuaccuggcacuaugaugaagacaauccuuacaagacaugggccuaucacggguccuacgaggugaagcccagcggaucugcuuccagcauggucaacggcguugugagacuccugacgaaaccuugggaugugauuccgauggucacccaaaucgccaugacagacaccacacccuuuggccagcagcggguguucaaggagaaaguugacacccgcacaccuagagcuaagcgggggaccacgcagauuauggaagugaccgccaaauggcuuuggggauuucugucuagaaauaagaagccccggaucuguacacgcgaggaauucaccagaaaaguccgguccaacgcggccauuggcgcuguguuuguugaugagaaucaauggaacagcgccaaggaagcuguggaggacgagcgcuucugggaucucguccauagagaacgggagcugcacaaacaggggaagugcgccacaugcguguauaauaugaugggaaaacgcgaaaagaagcugggcgaguuugggaaagccaagggcuccagagcgaucugguacauguggcucggagcucgguuccuggaauucgaggcccuuggcuuuaugaacgaggaccauugguucagccgcgaaaauucuuuuagcgggguugagggagaaggccugcacaaacucggguacauccugagagauauuuccaagaucccuggaggcaacauguaugccgacgauaccgcugggugggacacgcggauuacagaggaugaccuucagaaugaggccaaaaucaccgauauuauggaacccgagcaugcucugcucgccacaucuaucuucaagcugaccuaccagaacaaagugguccgcgugcaaagaccggcgaagaacggcacggucauggacgugaucagccggcgcgcccagagaggauccggccagguugggaccuauggacugaauacauuuaccaacauggaagugcagcucauucggcaaauggagucugaaggcaucuuccugccuagcgagcuugagacacccaaucuggcugaaagaguccucgauuggcuggagaagcacggggccgaacgccuuaaacggauggcuauuuccggagacgacuguguggugaagccuaucgaugacagauuugccaccgcgcugacagcccucaacgcuaugggcaaaguucgcaaggauauuccccagugggagccuucuaaaggguggaaugacuggcagcaggugcccuucugcagccaccauuuucaccaacugaucaugaaggauggccgggaaaucgucgugccguguagaaaccaggacgagcugguuggacgcgcccgggugucccagggcgcuggguggagccucagagagaccgccugccugggaaagucuuacgcucaaauguggcagcuuauguauuuccaucgccgggaucugagacucgccgcgaaugccauuuguuccgcugucccuguggacuggguccccacgagccgcacaaccuggucuauccacgcccaccaucaguggaugaccacagaagauaugcuguccguguggaaccggguuuggauugaggaaaaucccuggauggaggacaaaacccacgugagcuccugggaagaggucccuuaccuuggcaagagagaggaucaguggugcgggucucugaucggacucacagcccgggcuacgugggccaccaacauucaaguggcgaucaaucagguuagacgccugauuggcaacgaaaauuaucuggacuacaugacaagcaugaaacgguuuaagaacgaguccgacccggaaggggcucucugguga

SEQ ID NO: 18691 - RNA, 9879 nt, Artificial Sequence
  derived and/or modified CDS sequence (opt5) from DENV-1__EU596501__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauugugucucugcucccucugugucuuuccacaacgagccagaaaaccacauggcugccgguccugcucgggucuuucggaugcaagccccugaccauguuucuuaucacagaaaauaagauuuggggccggaaauccuggccucugaacgagggcaucauggccauugggaucguuagcauccuccugucuucccuccugaagaaugacgugccccuugcgggaccucugauugccggcgggaugcugaucgcuuguuaugugauuagcggauccagcgccgaucucucucuggagaaagcugccgaagucagcugggagcaagaagccgagcauuccggcaccucucacaacauccuuguggaaguucaggacgaugggacgaugaagauuaaagacgaggagcgcgaugacacccugacaauccuccugaaggcuacccuccuggcggugagcggagucuaccccauguccaucccugccacacuuuucgugugguauuuuuggcagaaaaagaagcagagaucuggcguucugugggauacccccagcccgccugaaguggagcgggcuguccuggacgauggcauuuaccgcaucaugcaaagagggcuccugggacggucccaggugggcgucgggguguuccaggacggaguuuuccauacaauguggcacgugacgcgcggcgccguccuuauguaucaggggaaaagacuggaacccucuugggccagcgugaagaaagaccucauuuccuacggaggcggcuggcgguuucaagggagcuggaauaccggagaggagguucaggugaucgcugucgaaccuggcaagaaccccaaaaaugugcagacaaccccggggaccuucaagacacuggagggagaagugggcgccauugcgcucgauuuuaagccugggacgucuggaucccccaucguuaacagagagggcaaaauugucggccuguacgggaauggaguggugaccacaagcggcaccuaugucucugcuaucgcccaagccaaggcuucccaggaagggccucuucccgagaucgaggacgaaguguucaaaaagcgcaaccugacaauuauggaucugcaccccggaagcggcaaaacccggagauaccucccugccaucguucgcgaggcgauuaagcggaagcugagaacgcuuauccuggcuccgacacgcguggucgccuccgaaauggccgaggcucucaaagggaugcccauucgguaucagaccaccgccgugaagucugaacauacaggcagagagaucguugaccugaugugccacgcuaccuuuacaaugcgccugcucagcccugugcggguccccaauuacaacaugaucauuauggaugaggcccauuucaccgacccugcguccaucgccgcuagaggauauauuagcacgcgggugggcaugggggaagccgcugccaucuuuaugacagccacccccccuggaucuguugaggcuuucccgcaguccaaugcggugauucaagaugaagagcgcgacauccccgaaagaagcuggaacucuggcuacgauuggaucacagacuuuccugggaaaaccgucugguucgugcccagcauuaaguccggaaaugauaucgccaacugucuucggaaaaacggcaagcgcgugauucagcugucuagaaagacguuugacaccgaguaucagaaaacaaagaauaacgacugggauuacgucguuaccacagacaucagcgagaugggggcuaauuuccgggccgauagagugauugacccucgccggugccugaaacccgugauccucaaggauggcccggaaagagucauucuggccggaccuaugcccgugaccguugcuuccgccgcgcagcgccggggcagaaucgggcgcaaccaaaauaaagagggagaccaguacguguauaugggccagccccuuaacaaugaugaagaccacgcucauuggacagaggccaagaugcugcucgauaacaucaauaccccugaggggauuauccccgcccuguucgaaccugagcgggaaaagucugcugccauugacggagaguacagacugcgcggcgaagcgagaaaaacguuugucgagcucaugcggcgcggggaucuuccgguguggcugagcuauaagguugccuccgagggcuuccaguacagcgacagacgguggugcuuugauggagaacgcaacaaucaagugcuggaggaaaacauggacgucgagaucuggacaaaagaaggcgagagaaagaaacuccggcccagauggcuggacgcucgcaccuauucugauccucuugcccugcgggaguucaaggaauuugcugccgggagacgcuccgugagcggagaccucauucuggagaucggcaaacugccccagcaccucacccuucgggcucagaaugcccuggauaaccuggucaugcuccacaauuccgaacaggggggaaaggcguacagacaugccauggaggaacugccugacacaaucgagacccuuaugcugcucgcucugauugccgugcugacaggcggcguuacgcucuucuuucuuucugggaagggacugggcaaaaccagcaucgggcugcucugugugacagcuuccucugcccugcuuuggauggccagcguggagccccacuggauugcugcguccaucauucuggaauucuuucucaugguccugcugaucccggagccugaucggcaacgcaccccccaggacaaccagcucgccuauguugugaucggacuucuguucaugauucugacaguggcugccaacgaaaugggccuccuggagaccacgaagaaagaucuugggaucggacaugucgccgcugagaaucaccaacacgccaccaugcuggacguggaucucagaccugcgagcgccuggacacuguacgcuguugccaccacagugauuacccccaugaugcggcauacgaucgaaaacacaaccgcuaauauuucucugacagccaucgcgaaccaggccgcuauucucaugggccuugacaagggcuggccuaucuccaaaauggauaucggggucccccugcuggcccucggaugcuacagccaggugaauccgcugacccuuaccgcugccguccugaugcucguggcucacuaugccauuaucggcccugggcugcaggcgaaggccacacgcgaggcucaaaagagaacggccgcuggaauuaugaaaaaccccaccguugacggcaucguggccauugaucuggaccccgucguguacgacgccaaguuugaaaaacagcucgggcagaucaugcuucugauccuguguacaucucagauucuccugaugcggaccacaugggcgcuuugcgaguccaucacccuggcuacgggaccucucacaacccugugggaaggcagcccgggcaaguucuggaauaccacaauugccguuucuauggcuaacaucuuucgcgggagcuaucuggccggagccggccucgcuuucucccuuaugaaaucucuggggggaggcagacgggggaccggagcccaaggcgagacacugggcgagaaguggaagcgccagcucaaucagcugagcaaauccgaauucaacacguacaagagaagcgggauuauggagguggaucgguccgaagcgaaagagggacuuaagagaggcgaaaccacaaaacaugccgucucucgcgggaccgcuaagcugcggugguuuguggagagaaaucucgugaagcccgagggaaaaguuaucgaccugggcugugggcgcggaggcuggagcuauuacugcgccggccugaagaaagucacagaagugaagggguauaccaaaggaggcccugggcacgaggaacccaucccuauggcuacguacggauggaaccucgugaagcuucauuccggcaaagaugucuucuuuaugcccccugagaagugugacacccugcugugcgauauuggggaaucuagcccgaaucccacaaucgaggagggacggacccucagaguucugaagaugguggaaccuuggcuucgcggcaaccaguucuguauuaaaauccugaaucccuacaugccuuccguggucgagacacucgaacaaaugcagcggaagcacggcgggaugcuggugagaaacccccugucucgcaauagcucccacgagauguauuggguuagcugcggaaccggcaacauugugucugccgucaacaugacaucccggaugcuccugaauagauuuaccauggcgcaucgcaaaccgacguacgagcgggacguggaucuuggggccggaacaagacacguugcuguggaaccugaggucgccaaccuggacaucauuggccagcgcaucgaaaauaucaagaacgagcauaaaagcaccuggcacuaugaugaagacaaucccuacaagaccugggcuuaucacgggucuuacgaggugaagcccuccggaagcgccucuuccauggugaacggcgucguuagacuccugacaaaaccuugggaugugauucccauggugacgcaaaucgcuaugaccgacacaaccccuuucggccagcagcgggucuuuaaggagaaaguggacacacgcaccccgagagccaagcgggggacaacccagauuauggaaguuacggcgaaauggcuuuggggauuccugagcagaaauaagaagccccggaucuguacccgcgaggaauuuacaagaaaagugcgguccaacgccgcuauuggcgccgucuucguggaugagaaucaauggaacagcgcuaaggaagccguugaggacgagcgcuuuugggaucucgugcauagagaacgggagcugcacaaacaggggaagugcgccaccugcgucuauaauaugaugggaaaacgcgaaaagaagcugggcgaguucgggaaagcgaagggcucuagagcuaucugguacauguggcucggagcccgguuucuggaauucgaggcccuuggcuucaugaacgaggaccauugguuuagccgcgaaaauucccugucugggguggagggagaaggccuccacaaacugggguacauccuuagagauauuagcaagaucccuggaggcaacauguaugcugacgauacagccgggugggacacccggauuacggaggaugaccugcagaaugaggcuaaaaucacagauauuauggaacccgagcaugcccuccuggcgaccuccaucuucaagcugacauaccagaacaaaguugugcgcguccaaagaccugccaagaacggcaccgugauggacgucaucucucggcgcgaucagagaggaagcggccagguggggacguauggacucaauaccuuuacaaacauggaaguucagcugauucggcaaauggaguccgaaggcaucuuccuucccucugagcuggagaccccgaaucucgcugaaagagugcuggacuggcuugagaagcacggggccgaacgccugaaacggauggcuauuagcggagacgauugugucgugaagccuaucgacgauagauuugccacagcgcucaccgcccugaacgacaugggcaaagugcgcaaggauauuccccagugggagccuuccaaaggguggaaugacuggcagcagguucccuucugcagccaccauuuucaccaacugaucaugaaggauggccgggaaaucguggucccuuguagaaaccaggacgagcucgugggacgcgcucggguuucucagggcgccggguggucccugagagagacagcuugccuuggaaagagcuacgcccaaauguggcagcugauguauuuccaucgccgggaucucagacuggcugccaaugcgauuuguucugccgugcccgucgacugggugccgaccucccgcacgacauggagcauccacgcucaccaucaguggaugaccaccgaagauaugcuuuccgucuggaaccggguguggauugaggaaaauccuuggauggaggacaaaacacacguuucuagcugggaagaggugcccuaccugggcaagagagaggaccaguggugcgggucccucaucggacugaccgcccgggccacaugggcuacgaacauucaagucgccaucaaucaggugagacgccugauuggcaacgaaaauuaucucgauuacaugaccagcaugaaacgguuuaagaacgagucugaccccgaaggggcgcugugguga

SEQ ID NO: 18692 - RNA, 9879 nt, Artificial Sequence
  derived and/or modified CDS sequence (opt5) from DENV-1__FJ898437__SS-prME
agcgugaccaugcugcucaugcugcuucccacagcucuggcuuuccaccucacgaccagaggcggggaaccucauaugaucgucuccaagcaggaacggggaaagucucugcuuuuuaagacaagcgccggcguuaacaugugcacccugauugcgauggaccucggggagcugugugaagauacaaugaccuacaagugcccccagaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagaacaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccgcccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaaacuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauugugucucuguucccucucugucuguccacaacgagccagaaaaccacauggcuuccgguccugcuggggucuuuuggaugcaagccccucaccauguuccugaucacagaaaauaagauuuggggccggaaauccuggccucuuaacgagggcaucauggccauugggaucguuagcauccugcucucuucccugcucaagaaugacgugccccuggcgggaccucuuauugccggcgggaugcugaucgcuuguuaugugauuagcggauccagcgccgaucugucucucgagaaagcugccgaagucagcugggagcaagaagccgagcauuccggcaccucucacaacauccugguggaaguucaggacgaugggacgaugaagauuaaagacgaggagcgcgaugacacccuuacaauccugcucaaggcuacccugcucgcggugagcggagucuaccccauguccaucccugccacacuguuugugugguauuucuggcagaaaaagaagcagagaucuggcguucuuugggauacccccagcccgccugaaguggagcgggcuguccuggacgauggcauuuaccgcauccugcaaagagggcuccugggacggucccaggugggcgucgggguguuccaggacggaguuuuucauacaauguggcacgugacgcgcggcgccguccuuauguaucaggggaaaagacuggaacccucuugggccagcgugaagaaagaccucauuuccuacggaggcggcuggcgguuccaagggagcuggaauaccggagaggagguucaggugaucgcugucgaaccuggcaagaaccccaaaaaugugcagacaaccccggggaccuuuaagacaccugagggagaagugggcgccauugcgcuggauuucaagcccgggacgucuggauccccuaucguuaacagagagggcaaaauugucggccucuacgggaauggaguggugaccacaagcggcaccuaugucucugcuaucgcccaagccaaggcuucccaggaagggccccugcccgagaucgaggacgaaguguuuaaaaagcgcaaccuuacaauuauggaucugcacccuggaagcggcaaaacccggagauaccugccggccaucguucgcgaggcgauuaagcggaagcucagaacgcugauccuugcucccacacgcguggucgccuccgaaauggccgaggcucugaaagggaugccuauucgguaucagaccaccgccgugaagucugaacauacaggcagagagaucguugaccucaugugccacgcuaccuucacaaugcgccugcugagccccgugcgggucccuaauuacaacaugaucauuauggaugaggcccauuuuaccgaccccgcguccaucgccgcuagaggauauauuagcacgcgggugggcaugggggaagccgcugccaucuucaugacagccaccccuccgggaucuguugaggcuuuuccccaguccaaugcggugauucaagaugaagaacgcgacaucccugaaagaagcuggaacucuggcuacgauuggaucacagacuuccccgggaaaaccgucugguuugugccuagcauuaaguccggaaaugauaucgccaacugucuccggaaaaacggcaagcgcgugauucagcuuucuagaaagacguucgacaccgaguaucagaaaacaaagaauaacgacugggauuacgucguuaccacagacaucagcgagaugggggcuaauuuccgggccgauagagugauugacccccgccggugccugaaaccggugauccugaaggauggcccugaaagagucauucucgccggacccaugcccgugaccguugcuuccgccgcgcagcgccggggcagaaucgggcgcaaccaaaauaaagagggagaccaguacguguauaugggccagccucugaacaaugaugaagaccacgcucauuggacagaggccaagaugcuucuggauaacaucaauacccccgaggggauuaucccugcccucuuugaaccggagcgggaaaagucugcugccauugacggagaguacagacugcgcggcgaagcgagaaaaacguucgucgagcugaugcggcgcggggaucuccccguguggcuuagcuauaagguugccuccgagggcuuucaguacagcgacagacgguggugcuucgauggagaacgcaacaaucaagugcuggaggaaaacauggacgucgagaucuggacaaaagaaggcgagagaaagaaacugcggccuagauggcucgacgcucgcaccuauucugauccccuggcccuucgggaguuuaaggaguucgcugccgggagacgcuccgugagcggagaccugauucucgagaucggcaaacugccucagcaccugacccuccgggcucagaaugcccuugauaaccuggucaugcugcacaauuccgaacaagggggaaaggcguacagacaugccauggaggaacuccccgacacaaucgagacccugaugcuucuggcucucauugccgugcugacaggcggcguuacgcuguuuuuccucucugggaagggacuuggcaaaaccagcaucgggcugcugugugugacagcuuccucugcccuccuguggauggccagcguggagccgcacuggauugcugcguccaucauucuugaauuuuuccugaugguccuccugaucccugagcccgaucggcaacgcaccccucaggacaaccagcuggccuauguugugaucggacuccuuuuuaugauucugacaguggcugccaacgaaaugggccugcucgagaccacgaagaaagaucuggggaucggacaugucgccgcugagaaucaccaacacgugaccaugcuugacguugaucugagacccgccagcgcguggacacucuacgccguggcuaccacagucauuaccccuaugaugcggcauacgaucgaaaacacaaccgccaauauuucucugacagcuaucgccaaccaggcggccauucugaugggccucgacaagggcuggcccaucuccaaaauggauaucggggugccgcuucuggcucugggaugcuacagccaggucaauccucucacccugaccgccgcugugcuuaugcugguugcccacuaugcuauuaucggccccgggcuccaggccaaggcgacacgcgaggcccaaaagagaacggcugccggaauuaugaaaaaccccaccguggacggcaucgucgcuauugaucuggacccugugguuuacgacgccaaguucgaaaaacagcuggggcagaucaugcuccuuauccuguguacaucucagauucugcucaugcggaccacaugggcccugugcgaguccaucacccuugcgacgggaccgcugacaacccucugggaaggcagccccggcaaguuuuggaauaccacaauugcugugucuauggccaacaucuuccgcgggagcuaucuggcuggagccggccuggccuucucccucaugaaaucucuugggggaggcagacgggggaccggagcucaaggcgagacacugggcgagaaguggaagcgccagcugaaucagcucagcaaauccgaauuuaacacguacaagagaagcgggauuauggaggucgaucgguccgaagccaaagagggacugaagagaggcgaaaccacaaaacaugcggugucucgcgggaccgccaaacuucggugguucguggagagaaaucugguuaagccugagggaaaagucaucgaccucggcugugggcgcggaggcuggagcuauuacugcgcuggccugaagaaagugacagaagugaagggguauaccaaaggaggccccgggcacgaggaaccuauccccauggccacguacggauggaaccuggucaagcuccauuccggcaaagauguguuuuucaugccuccggagaagugugacacccuucugugcgauauuggggaaucuagccccaauccuacaaucgaggagggacggacccugagaguucucaagaugguggaacccuggcugcgcggcaaccaguuuuguauuaaaauccuuaauccuuacaugcccuccgucguggagacacuggaacaaaugcagcggaagcacggcgggaugcucguuagaaacccgcugucucgcaauagcacccacgagauguauuggguguccugcggaacaggcaacauugucagcgcugugaacaugaccucucggaugcugcucaauagauucacgauggcccaucgcaaaccuacauacgagcgggacguugaucugggggcgggaaccagacacguggccgucgaacccgagguggcuaaccuugacaucauuggccagcgcaucgaaaauaucaagaacgagcauaaauccaccuggcacuaugaugaagacaaucccuacaagacaugggccuaucacgggagcuacgaggugaagccuucuggauccgcuagcucuauggucaacggcguugugagacugcucacgaaacccugggaugugauuccuauggucacccaaaucgccaugacagacaccacaccguuuggccagcagcggguguucaaggagaaaguugacacccgcacacccagagcuaagcgggggaccacgcagauuauggaagugaccgccaaauggcuguggggauuucuuuccagaaauaagaagccucggaucuguacacgcgaggaguucaccagaaaaguccggagcaacgcggccauuggcgcuguguuuaucgaugagaaucaauggaacuccgccaaggaagcuguugaggacgagcgcuucugggaucuggugcauagagaacgggagcuccacaaacaggggaagugcgccacaugcgucuauaauaugaugggaaaacgcgaaaagaagcugggcgaguuugggaaagccaagggcagcagagcgaucugguacauguggcugggagcucgguuccucgaguucgaggcccugggcuuuaugaacgaggaccauugguucucucgcgaaaauagccuuuccgggguggagggagaaggccugcacaaacucggguacauucugagagauaucucuaagauucccggaggcaacauguaugccgacgauaccgcugggugggacacgcggguuacagaggaugaccuucagaaugaggccaaaaucaccgauauuauggaaccugagcaugcucugcucgccacaagcaucuuuaagcugaccuaccagaacaaagugguccgcgugcaaagacccgcgaagaacggcacggucauggacgugaucucccggcgcgaucagagaggaucuggccagguugggaccuauggacugaauacauucaccaacauggaagugcagcucauucggcaaauggagagcgaaggcaucuuucugccguccgagcuugagacaccuaaucuggccgaaagaguccucgacuggcuggagaagcacggggcugaacgccuucggagaauggccauuucuggagacgauuguguggugaaacccaucgacgaucgcuucgcuaccgcccugacagcgcucaacgacaugggcaagguucggaaagauauuccucagugggagcccagcaagggguggaaugacuggcaacaggugccuuuuugcucccaccauuuccaccaacugaucaugaaagauggcagagaaaucgucgugcccugucgcaaccaggacgagcugguuggacgggccagagugagccagggcgcuggguggucucuccgcgagaccgccugccugggaaaguccuacgcucaaauguggcagcuuauguauuuucaucggagagaucugcgccucgccgcuaaugccauuuguagcgcggucccgguggacugggucccuacgucucggacaaccugguccauccacgcccaccaucaguggaugaccacagaagauaugcugagcguguggaacagaguuuggauugaggaaaaucccuggauggaggacaagacccacguguccucuugggaagagguccccuaccuuggcaaacgggaggaccaguggugcgggagccugaucggacucacagcuagagccacgugggccaccaacauucaaguggcuaucaaucagguucgccggcugauuggcaacgaaaauuaucuggauuacaugacauccaugaagagauucaaaaacgagagcgacccugaaggggcccucugguga

SEQ ID NO: 18693 - RNA, 9879 nt, Artificial Sequence
  derived and/or modified CDS sequence (opt5) from DENV-1__FJ024480__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccugauggccuccgucgaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauugugucucuguucccucucugucuguccacaacgagccagaaaaccacauggcuuccggugcugcuggggucuuuuggaugcaagccccucaccauguuccugaucacagaaaauaagauuuggggccggaaauccuggccucuuaacgagggcaucauggccauugggaucgucagcauccugcucucuucccugcucaagaaugacguuccccuggcgggaccucuuauugccggcgggaugcugaucgcuuguuaugugauuagcggauccagcgccgaucugucucucgagaaagcugccgaagugagcugggagcaagaagccgagcauuccggcaccucucacaacauccuggucgaagugcaggacgaugggacgaugaagauuaaagacgaggagcgcgaugacacccuuacaauccugcucaaggcuacccugcucgcgguuagcggaguguaccccauguccaucccugccacacuguuugucugguauuucuggcagaaaaagaagcagagaucuggcgugcuuugggauacccccagcccgccugaaguugagcgggcugugcuggacgauggcauuuaccgcauccugcaaagagggcuccugggacggucccaggucggcgugggggucuuccaggacggaguguuucauacaauguggcacguuacgcgcggcgccgugcuuauguaucaggggaaaagacuggaacccucuugggccagcgucaagaaagaccucauuuccuacggaggcggcuggcgguuccaagggagcuggaauaccggagaggaggugcagguuaucgcuguggaaccuggcaagaaccccaaaaauguccagacaaccccggggaccuuuaagacaccugagggagaagugggcgccauugcgcuggauuucaagcccgggacgucuggauccccuaucgugaacagagagggcaaaauuguuggccucuacgggaauggagucgugaccacaagcggcaccuaugugucugcuaucgcccaagccaaggcuucccaggaagggccccugcccgagaucgaggacgaagucuuuaaaaagcgcaaccuuacaauuauggaucugcacccuggaagcggcaaaacccggagauaccugccggccaucgugcgcgaggcgauuaagcggaagcucagaacgcugauccuugcucccacacgcguuguggccuccgaaauggccgaggcucugaaagggaugccuauucgguaucagaccaccgccgucaagucugaacauacaggcagagagaucguggaccucaugugccacgcuaccuucacaaugcgccugcugagccccguucgggugccuaauuacaacaugaucauuauggaugaggcccauuuuaccgaccccgcguccaucgccgcuagaggauauauuagcacgcgggucggcaugggggaagccgcugccaucuucaugacagccaccccuccgggaucuguggaggcuuuuccccaguccaaugcgguuauucaagaugaagagcgcgacaucccugaaagaagcuggaacucuggcuacgauuggaucacagacuuccccgggaaaaccgugugguuugucccuagcauuaaguccggaaaugauaucgccaacugucuccggaaaaacggcaagcgcgugauucagcuuucuagaaagacguucgacaccgaguaucagaaaacaaagaauaacgacugggauuacguggucaccacagacaucagcgagaugggggcuaauuuccgggccgauagaguuauugacccccgccggugccugaaaccggugauccugaaggauggcccugaaagagugauucucgccggacccaugcccgucaccguggcuuccgccgcgcagcgccggggcagaaucgggcgcaaccaaaauaaagagggagaccaguacguuuauaugggccagccucugaacaaugaugaagaccacgcucauuggacagaggccaagaugcuucuggauaacaucaauacccccgaggggauuaucccugcccucuuugaaccggagcgggaaaagucugcugccauugacggagaguacagacugcgcggcgaagcgagaaaaacguucguggagcugaugcggcgcggggaucuccccgucuggcuuagcuauaagguggccuccgagggcuuucaguacagcgacagacgguggugcuucgauggagaacgcaacaaucaaguucuggaggaaaacauggacguggagaucuggacaaaagaaggcgagagaaagaaacugcggccuagauggcucgacgcucgcaccuauucugauccccuggcccuucgggaguuuaaggaauucgcugccgggagacgcuccgucagcggagaccugauucucgagaucggcaaacugccucagcaccugacccuccgggcucagaaugcccuugauaaccuggugaugcugcacaauuccgaacaggggggaaaggcguacagacaugccauggaggaacuccccgacacaaucgagacccugaugcuucuggcucucauugccguccugacaggcggcgugacgcuguuuuuccucucugggaagggacuuggcaaaaccagcaucgggcugcuguguguuacagcuuccucugcccuccuguggauggccagcguggagccgcacuggauugcugcguccaucauucuugaauuuuuccugauggugcuccugaucccugagcccgaucggcaacgcaccccucaggacaaccagcuggccuaugucguuaucggacuccuuuuuaugauucugacaguggcugccaacgaaaugggccugcucgagaccacgaagaaagaucuggggaucggacauguggccgcugagaaucaccaacacgccaccaugcuugacgucgaucugagacccgcgagcgccuggacacucuacgcuguggccaccacaguuauuaccccuaugaugcggcauacgaucgaaaacacaaccgcuaauauuucucugacagccaucgcgaaccaggccgcuauucugaugggccucgacaagggcuggcccaucuccaaaauggauaucggggugccgcuucuggcccugggaugcuacagccaggucaauccucucacccugaccgcugccgugcuuaugcuggucgcucacuaugccauuaucggccccgggcuccaggcgaaggccacacgcgaggcucaaaagagaacggccgcuggaauuaugaaaaaccccaccguggacggcaucguugccauugaucuggacccuguggucuacgacgccaaguucgaaaaacagcuggggcagaucaugcuccuuauccuguguacaucucagauucugcucaugcggaccacaugggcgcugugcgaguccaucacccuugcuacgggaccgcugacaacccucugggaaggcagccccggcaaguuuuggaauaccacaauugccgugucuauggcuaacaucuuccgcgggagcuaucuggccggagccggccuggcuuucucccucaugaaaucucuugggggaggcagacgggggaccggagcccaaggcgagacacugggcgagaaguggaagcgccagcugaaucagcucagcaaauccgaauuuaacacguacaagagaagcgggauuauggagguugaucgguccgaagcgaaagagggacugaagagaggcgaaaccacaaaacaugccgugucucgcgggaccgcuaagcuucggugguucgucgagagaaaucuggugaagccugagggaaaagugaucgaccucggcugugggcgcggaggcuggagcuauuacugcgccggccugaagaaaguuacagaagucaagggguauaccaaaggaggccccgggcacgaggaaccuauccccauggcuacguacggauggaaccuggugaagcuccauuccggcaaagauguguuuuucaugccuccggagaagugugacacccuucugugcgauauuggggaaucuagccccaauccuacaaucgaggagggacggacccugagaguccucaagaugguugaacccuggcugcgcggcaaccaguuuuguauuaaaauccuuaauccuuacaugcccuccgugguggagacacuggaacaaaugcagcggaagcacggcgggaugcucgucagaaacccgcugucucgcaauagcacccacgagauguauuggguguccugcggaacaggcaacauuguuagcgccgugaacaugaccucucggaugcugcucaauagauucacgauggcgcaucgcaaaccuacauacgagcgggacgucgaucugggggccggaaccagacacguggcuguugaacccgagguggccaaccuugacaucauuggccagcgcaucgaaaauaucaagaacgagcauaaauccaccuggcacuaugaugaagacaaucccuacaagacaugggcuuaucacgggagcuacgaggucaagccuucuggauccgccagcucuauggugaacggcguggucaaacugcucacgaagcccugggauguuauuccuauggugacccaaaucgcuaugacagacaccacaccguuuggccagcagagaguguucaaagagaaggucgacacccggacaccccgcgccaaaagagggaccacgcagauuauggaagugaccgcgaaguggcuguggggauuucuuucccggaauaagaaaccuagaaucuguacacgggaggaauucacccgcaagguuagaagcaacgccgcuauuggcgccguguuugucgaugagaaucaauggaacuccgcuaaagaagccguggaggacgagcgguucugggaucugguucaucgcgaaagagagcuccacaagcaggggaaaugcgccacaugcguguauaauaugaugggaaagcgggaaaagaaacugggcgaguuugggaaggcgaaaggcagccgcgcuaucugguacauguggcugggagccagauuccucgaauucgaggcccugggcuuuaugaacgaggaccauugguucucucgggaaaauagccuuuccggggucgagggagaaggccugcacaagcucggguacauccugcgcgauauuucuaaaauccccggaggcaacauguaugcugacgauaccgccgggugggacacgagaauuacagaggaugaccuucagaaugaggcuaagaucaccgauauuauggaaccugagcaugcccugcucgcgacaagcaucuuuaaacugaccuaccagaacaaggugguucgggugcaacgccccgccaagaacggcacggucauggacgugaucuccagacgggaucagcgcggaucuggccaggucgggaccuauggacugaauacauucaccaacauggaagugcagcucauuagacaaauggagagcgaaggcaucuuucugccguccgagcuugagacaccuaaucuggcugaacggguucucgacuggcuggagaaacacggggccgaaagacuuaagcgcauggcuauuucuggagacgauuguguggucaaacccaucgacgaucgguucgccaccgcgcugacagcccucaacgacaugggcaaggugagaaaagauauuccucagugggagcccagcaagggguggaaugacuggcagcaggugccuuuuugcucccaccauuuccaccaacugaucaugaaggauggccgcgaaaucguugugcccugucggaaccaggacgagcuggucggaagagcucgcgugagccagggcgccggguggucucuccgggagaccgcuugccugggaaaauccuacgcccaaauguggcagcuuauguauuuucauagacgcgaucugcggcucgcugccaaugcgauuuguagcgccguuccgguggacugggucccuacgucuagaacaaccugguccauccacgcucaccaucaguggaugaccacagaagauaugcugagcguguggaaccgcgucuggauugaggaaaaucccuggauggaggacaagacccacguguccucuugggaagagguucccuaccuuggcaaacgggaggaccaguggugcgggagccugaucggacucacagccagagccacgugggcuaccaacauucaaguggccaucaaucagguccggagacugauuggcaacgaaaauuaucuggauuacaugacauccaugaagcgcuucaaaaacgagagcgacccugaaggggcgcucugguga

SEQ ID NO: 18694 - RNA, 9879 nt, Artificial Sequence
  derived and/or modified CDS sequence (opt5) from DENV-1__FJ873814__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccguggucgccuuuuuccuggcgcaugccaucgggacaucuauuacccaaaagggaaucaucuuuauucuccugaugcuugugaccccuagcauggcuaugcgcugcguuggcaucgggaacagagauuucguggagggacuguccggcgccacaugggucgacguggugcucgagcacgggagcugugucacgaccauggcuaagaauaaacccacacuggauauugaacugcucaagaccgagguuacaaacccugccauccugcggaaacuuugcauugaagcgaagaucucuaauaccacgacagacucccgcuguccgacccagggagaggccacccugguggaagagcaggaugcuaacuuugugugcagacggacauucgucgaccgcggcuggggcaauggguguggacucuuuggcaaagggagccugcuuaccugcgccaaguucaagugcgugacaaaacuggagggaaagauuguucaguacgaaaaccucaaauauucugugaucgucacggugcacaccggcgaucaacaucagguugggaaugagacaaccgaacacggaacaaucgcuauuaucaccccccaggccccuacguccgagauucagcugaccgacuacggcgcccugacacucgacuguagccccagaaccggccuggauuuuaacgaaauggugcuucugacaaugaaggagaaaucuuggcucguccauaagcaaugguuccuggaccuuccucugcccuggaccuccggggcuagcacgucccaggagacauggaaucggcaggaucuccuggugaccuuuaaaacagcgcacgccaagaagcaagaagucgugguucugggaucucaggagggcgcuaugcacaccgcccucaccggggccacagaaauccagacgagcggaaccacaaccauuuucgcuggccaucugaaaugccgccuuaagauggacaaacugacacucaaggggaccuccuaugugauguguacgggcagcuucaaacuggagaaggaagucgccgagacacagcacggaaccgugcugguucaagugaaguacgagggcaccgaugcgccgugcaaaaucccuuuuucuacacaggacgaaaagggggucacccagaacggaagacuuaucacagcuaaucccauugugacggauaaagagaagccugugaacaucgaaaccgagccccccuucggcgaguccuauauuguuaucggggccggagaaaaagcccucaagcugagcugguuuaagaaaggcucuagcauugggaagauguucgaggcuacagcccggggcgcuagacgcauggccauccugggagacaccgcgugggauuuuggcuccaucgggggagucuucacaucugugggcaaacucgugcaucaggucuuugggaccgccuacggagugcuguucagcggcguuuccuggacgaugaagauugggaucggcauucuucugaccuggcucggacugaauagccggucuacaucccugagcaugaccuguaucgcugugggcauggucacacuuuaccucggggugaugguucaagccgacucuggaugcgugauuaacuggaaaggcagagaacugaaguguggguccggaaucuuugucaccaacgaggugcacacauggaccgaacaguauaaguuccaggcugauagcccuaaacgccuguccgccgcgauuggcaaggccugggaggaggggguuugcggcauccggucugcuacgagacucgaaaauaucauguggaaacagauuagcaacgagcugaaucauauccuucuggaaaacgacaugaaguuuacaguggucgugggagacgccaauggcauucucgcucaagggaaaaagaugauccgcccgcagcccauggagcacaaauacuccuggaagucuuggggaaaggccaaaauuaucggcgccgauauccagaacaccaccuucauuaucgacgggccugauacacccgaauguccugacgaucagcgggcuuggaauauuugggagguggaggacuauggauuuggcaucuucaccacgaacauuuggcugaagcugagagauagcuacacacaaaugugcgaccaccgccuuauguccgcggccaucaaagauagcaaggcuguccaugccgacaugggcuauuggaucgaaucugagaaaaaugaaaccuggaagcucgcccgggcuuccuucauugagguuaagacauguaccuggcccaaaagccacacacuguggucuaacggggugcuggaauccgagaugaucauuccgaagaucuacggaggcccuauuagccagcauaauuauagacccggguacuuuacccagacggccggaccuuggcaccucggcaaacuggagcuugauuucgaccugugcgaagggaccacaguggucguggaugagcacugcggaaaccgcggccccucucuccggaccacaaccguuacgggcaagaucauccaugaaugguguugcagaagcuguacacugccuccccugcgguuucgcggggaggacggaugcugguacggcauggagauuagaccggugaaagaaaaggaggaaaaucuuguccgguccauggugagcgcggggucuggagagguugacuccuucagccucggcauccugugugcuuccauuaugaucgaagaggugaugagaucucgcuggagccggaagaugcugaugaccgggacacucgccgucuuucugcuucugauuaugggacaacucaccuggaacgaucugaucagacugugcauuauggugggcgccaaugcuuccgaccgcaugggcauggggaccacauaucuugcccugauggcgacguucaaaaugagaccuauguuugcuguuggacuccuguuccggcgccucaccucuagagaggugcugcuucugacaaucggccucagccuggucgccuccguggaacugcccaacucucuugaggaacugggggauggacucgccaugggcaucaugaugcugaagcuccugaccgaguuucagccccaccagcuuuggacaacccugcucagccugacguucauuaaaacaacccugucccuugacuacgcuuggaagaccacagccauggcucugagcaucgugucucucuuuccucugugucucuccaccacaagccagaaaacgaccuggcugccgguccuucuggggucuuucggaugcaagccccugacaauguuucucauuaccgaaaacaagaucuggggccggaaauccuggccucugaaugagggcauuauggccaucgggaucguuagcauucuucugucuucccuccugaagaacgaugugccccucgcgggaccucugaucgccggcgggaugcuuauugcuuguuaugugaucagcggauccagcgccgaccugucucuggagaaagcugccgaagucagcugggagcaagaagccgagcauuccggcacaucucacaauauucucguggaaguucaggaugacgggaccaugaagaucaaagaugaggagaaggacgauacgcugaccauccuucugaaagcuacacuccuggcggugagcggagucuaccccauguccauuccugccacccucuucgugugguauuucuggcagaagaagaaacagcgcucuggcguucugugggacacacccagcccgccugaaguggagagagcuguccuugaugacggcaucuaccggauucugcaacgcgggcugcucggaagaucccaggugggcgucgggguguuucaggacggaguuuuccauaccauguggcacgugacacggggcgccguccugauguaucaggggaagcgccuugaacccucuugggccagcgugaaaaaggaucugaucuccuacggaggcggcuggagauuucaagggagcuggaacacgggagaggagguucaggugauugcugucgaaccuggcaaaaaucccaagaacgugcagaccacaccggggaccuucaagaccccugagggagaagugggcgccaucgcgcucgacuuuaaacccgggacaucuggauccccuauuguuaaucgggagggcaagaucgucggccuguacgggaacggaguggugacgaccagcggcacauaugucucugcuaucgcccaagccaaagcuucccaggaagggccccuccccgagauugaggaugaaguguucaagaaaagaaaucugaccaucauggaccuucacccuggaagcggcaagacacgccgguaccugccggccauuguuagagaggcgaucaagcgcaaacugcggacccucauucuggcucccacgagaguggucgccuccgaaauggccgaggcucuuaaggggaugccuauccgcuaucagacaaccgccgugaaaucugaacauaccggccgggagaucguugaucugaugugccacgcuacauuuaccaugagacuccugagccccgugcgcgucccuaacuacaauaugauuaucauggacgaggcccauuucacagaucccgcguccauugccgcucggggauauaucagcaccagagugggcaugggggaagccgcugccauuuuuaugacggccacaccuccgggaucuguugaggcuuucccccaguccaacgcggugauccaagacgaagagcgggauaucccugaacgcagcuggaauucuggcuacgacuggauuaccgauuuucccgggaagacagucugguucgugccuagcaucaaauccggaaacgacauugccaauugucugagaaagaacggcaagcgggugauccagcucucucgcaaaaccuucgacacggaguaucagaagaccaaaaacaaugauugggacuacgucguuacaaccgauauuagcgagaugggggcuaacuuuagagccgaccgggugaucgaucccagacgcugccuuaagccggugauucugaaagacggcccugaacgggucauccuggccggacccaugcccgugacaguugcuuccgccgcgcagagacgcggccggaucgggagaaaucaaaacaaggagggagaucaguacguguauaugggccagccucucaauaacgacgaagaucacgcucauuggaccgaggccaagaugcugcuugacaauauuaacacacccgaggggaucauuccugcccuguucgaaccggagcgcgaaaaaucugcugccaucgauggagaguaccggcucagaggcgaagcgcgcaagaccuuugucgagcugaugagacggggggaccugcccguguggcucagcuauaaaguugccuccgagggcuuccaguacagcgaucgcagauggugcuuugacggagaacggaauaaccaagugcuugaggaaaauauggacgucgagauuuggacgaaggaaggcgagcgcaaaaagcugagaccucgguggcuggaugcuagaacauauucugacccccucgcccugcgcgaguucaaagaauuugcugccgggcggagauccgugagcggagaucuuauccuggagaucggcaagcucccucagcaccugacccugcgcgcucagaacgcccucgacaaucuugucaugcugcacaacuccgaacaggggggaaaggcguaccggcaugccauggaggaacugcccgauaccauugagacacucaugcugcuugcucugaucgccgugcucaccggcggcguuacacuguucuuucugucugggaaaggacucggcaagacgagcauugggcuucugugugugaccgcuuccucugcccugcucuggauggccagcguggagccgcacuggaucgcugcguccauuauccuggaauucuuucuuaugguccugcucaucccugagcccgacagacaacggacaccucaggauaaucagcuggccuauguugugauuggacugcucuucaugauccuuaccguggcugccaacgaaaugggccugcuggagacaaccaaaaaggaccucgggauuggacaugucgccgcugagaaccaccaacacgccacgaugcuggauguggaccuucgccccgcgagcgccuggacccuguacgcuguugccacaaccgugaucacaccuaugaugagacauaccauugaaaauacgacagcuaacaucucucucaccgccauugcgaaucaggccgcuauccugaugggccuggauaaaggcuggcccaucuccaagauggacauuggggucccgcuccuugcccugggaugcuacagccaggugaacccucugacacucaccgcugccguccugaugcuuguggcucacuaugccaucauuggccccgggcugcaggcgaaggccacccgggaggcucaaaaacgcacagccgcuggaaucaugaagaaucccacgguugauggcauuguggccaucgaccucgacccugucguguacgaugccaaauuugaaaagcagcuggggcagaucaugcugcucauucuuuguaccucucagauccugcugaugagaacaaccugggcgcucugcgaguccauuacacuggcuaccggaccgcuuacgacacugugggaaggcagccccggcaaauucuggaacaccaccaucgccguuucuauggcuaauauuuuccgggggagcuaucucgccggagccggccuggcuuuuucccugaugaagucucucgggggaggccgcagagggacaggagcccaaggcgagacccuuggcgagaaguggaaacggcagcugaaccagcugagcaaguccgaauucaauacauacaaacgcagcgggaucauggagguggacagauccgaagcgaaggagggacucaaacggggcgaaacgaccaagcaugccgucucuagagggacagcuaagcugcgcugguuuguggagcggaaccuugugaaaccugagggaaagguuaucgaucugggcugugggagaggaggcuggagcuauuacugcgccggccucaaaaaggucaccgaagugaaaggguauacaaagggaggccccgggcacgaggaauccauuccuauggcuaccuacgccuggaaucuggugaaacugcauucuggaaaggacgucuucuuuaugcccccugagaagugugauacgcuccuuugcgacaucggcgaaagcuccccgaaccccaccauugaggaggggcgcacacugcggguucugaaaaugguggaaccuuggcucagaggaaaucaguucuguaucaagauucugaaccccuacaugccuucuguggucgagacccuugaacaaaugcagcgcaaacacggcggcaugcuggugcggaauccccucagcagaaacuccacacacgagauguauuggguuagcugcgggaccggaaauaucgugucugcggucaacaugacaucccgcaugcugcugaaccgguuuaccauggcccauagaaagccgacguacgagcgcgauguggaccucggcgcugggacacggcacguugccguggaaccugaggucgcuaaucuggauauuaucggacagagaaucgaaaacauuaaaaaugagcauaagagcaccuggcacuaugacgaagauaaccccuacaagaccugggccuaucacggcucuuacgaggugaaacccuccgggagcgcuucuuccauggugaauggagucguucgccuucugacaaagccuugggacgugauccccauggugacgcaaauugccaugaccgacacaaccccuuucggccagcagagagucuuuaaagagaagguggauacacggaccccgcgcgcgaaaagaggcacaacccagaucauggaaguuacggccaaguggcucuggggguuccugagccggaacaagaaacccagaauuuguacccgggaggaauuuacacgcaaggugagauccaaugcugccaucggagcugucuucguggacgagaaccaauggaauagcgccaaagaagccguugaggaugagcgguuuugggaccuugugcaucgcgaaagagagcugcacaagcagggcaaaugcgcgaccugcgucuauaacaugauggggaagcgggaaaagaaacucggagaguucggcaaggcuaaagggucucgcgccaucugguacauguggcugggcgccagauuccuggaauuugaggcucucggauucaugaaugaggaucauugguuuagccgggaaaacucccugucuggcguggagggggaaggacuucacaagcugggcuacauucuccgcgacaucagcaaaauuccugggggaaauauguaugccgaugacacagcuggcugggauaccagaaucacggaggacgaucugcagaacgaggccaagauuacagacaucauggaacccgagcaugcgcuucuggccaccuccaucuucaaacucacauaccagaauaagguugugcggguccaacgcccugcuaagaacgggaccgugauggaugucauuucuagacgggaccagcgcggcagcggacaggugggcacguaugggcugaacaccuuuacaaauauggaaguucagcugaucagacaaauggaguccgaaggaauuuuccuccccucugagcuggagaccccgaaccuugccaaacgggugcuggacuggcucgaaaagcacggcgcugagagacugaaacgcauggccaucagcggggaugacugugucgugaagccuauugaugaccgguuugcgacagcccuuaccgcucugaaugauaugggaaaagugagaaaggacaucccccagugggaaccuuccaagggcuggaacgauuggcagcagguucccuucugcagccaccauuuucaccaacucaucaugaaagacgggcgcgagauuguggucccuugucggaaucaggaugaacuggugggcagagcccgcguuucucagggagcuggcuggucccugcgggagacagccugccucgggaagagcuacgcucaaauguggcagcugauguauuuccauagacgcgaccuucggcuggccgcgaacgccaucuguucugcugugcccgucgauugggugccgaccuccagaacgacauggagcauucacgcccaccaucaguggaugaccaccgaggacaugcucuccgucuggaaucgcguguggaucgaagagaacccuuggauggaagacaaaacacacguuucuagcugggaggaagugcccuaccugggaaagcgggaggaucaguggugcggcucccuuauugggcugaccgccagagcuacaugggccacgaauauccaagucgcgauuaaccaggugcggagacucaucggaaaugagaacuaucuggacuacaugaccagcaugaaacgcuuuaagaaugaaucugaucccgagggcgcucugugguga

SEQ ID NO: 18695 - RNA, 9879 nt, Artificial Sequence
  derived and/or modified CDS sequence (opt5) from DENV-1__JN819403__SS-prME
agcgugaccaugcugcucaugcugcuucccacagcccuggcuuuccaccucacgaccagaggcggggagccucauaugaucgucuccaagcaggaacggggaaagucucugcuuuuuaagacaagcgccggcguuaacaugugcacccugauugcgauggaccucggggagcugugugaagauacaaugaccuacaagugcccccagaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagaacaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccgcccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaaacuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauugugucucuguucccucucugucuguccacaacgagccagaaaaccacauggcuuccgguccugcuggggucuuuuggaugcaagccccucaccauguuccugaucacagaaaauaagauuuggggccggaaauccuggccucuuaacgagggcaucauggccauugggaucguuagcauccugcucucuucccugcucaagaaugacgugccccuggcgggaccucuuauugccggcgggaugcugaucgcuuguuaugugauuagcggauccagcgccgaucugucucucgagaaagcugccgaagucagcugggagcaagaagccgagcauuccggcaccucucacaacauccugguggaaguucaggacgaugggacgaugaagauuaaagacgaggagcgcgaugacacccuuacaauccugcucaaggcuacccugcucgcggugagcggagucuaccccauguccaucccugccacacuguuugugugguauuucuggcagaaaaagaagcagagaucuggcguucuuugggauacccccagcccgccugaaguggagcgggcuguccuggacgauggcauuuaccgcauccugcaaagagggcuccugggacggucccaggugggcgucgggguguuccaggacggaguuuuucauacaauguggcacgugacgcgcggcgccguccuuauguaucaggggaaaagacuggaacccucuugggccagcgugaagaaagaccucauuuccuacggaggcggcuggcgguuccaagggagcuggaauaccggagaggagguucaggugaucgcugucgaaccuggcaagaaccccaaaaaugugcagacaaccccggggaccuuuaagacaccugagggagaagugggcgccauugcgcuggauuucaagcccgggacgucuggauccccuaucguuaacagagagggcaaaauugucggccucuacgggaauggaguggugaccacaagcggcaccuaugucucugcuaucgcccaagccaaggcuucccaggaagggccccugcccgagaucgaggacgaaguguuuaaaaagcgcaaccuuacaauuauggaucugcacccuggaagcggcaaaacccggagauaccugccggccaucguucgcgaggcgauuaagcggaagcucagaacgcugauccuugcucccacacgcguggucgccuccgaaauggccgaggcucugaaagggaugccuauucgguaucagaccaccgccgugaagucugaacauacaggcagagagaucguugaccucaugugccacgcuaccuucacaaugcgccugcugagccccgugcgggucccuaauuacaacaugaucauuauggaugaggcccauuuuaccgaccccgcguccaucgccgcuagaggauauauuagcacgcgggugggcaugggggaagccgcugccaucuucaugacagccaccccuccgggaucuguugaggcuuuuccccaguccaaugcggugauucaagaugaggaacgcgacaucccugaaagaagcuggaacucuggcuacgauuggaucacagacuuccccgggaaaaccgucugguuugugccuagcauuaaguccggaaaugauaucgccaacugucuccggaaaaacggcaagcgcgugauucagcuuucuagaaagacguucgacaccgaguaucagaaaacaaagaauaacgacugggauuacgucguuaccacagacaucagcgagaugggggcuaauuuccgggccgauagagugauugacccccgccggugccugaaaccggugauccugaaggauggcccugaaagagucauucucgccggacccaugcccgugaccguugcuuccgccgcgcagcgccggggcagaaucgggcgcaaccaaaauaaagagggagaccaguacguguauaugggccagccucugaacaaugaugaagaccacgcucauuggacagaggccaagaugcuucuggauaacaucaauacccccgaggggauuaucccugcccucuuugaaccggagcgggaaaagucugcugccauugacggagaguacagacugcgcggcgaagcgagaaaaacguucgucgagcugaugcggcgcggggaucuccccguguggcuuagcuauaagguugccuccgagggcuuucaguacagcgacagacgguggugcuucgauggagaacgcaacaaucaagugcuggaggaaaacauggacgucgagaucuggacaaaagaaggcgagagaaagaaacugcggccuagauggcucgacgcucgcaccuauucugauccccuggcccuucgggaguuuaaggaguucgcugccgggagacgcuccgugagcggagaccugauucucgagaucggcaaacugccucagcaccugacccuccgggcucagaaugcccuugauaaccuggucaugcugcacaauuccgaacaaggcgggaaggcguacagacaugccauggaggaacuccccgacacaaucgagacccugaugcuucuggcucucauugccgugcugacagggggcguuacgcuguuuuuccucucugggaagggacuuggcaaaaccagcaucgggcugcugugugugacagcuuccucugcccuccuguggauggccagcguggagccgcacuggauugcugcguccaucauucuugaauuuuuccugaugguccuccugaucccugagcccgaucggcaacgcaccccucaggacaaccagcuggccuauguugugaucggacuccuuuuuaugauucugacaguggcugccaacgaaaugggccugcucgagaccacgaagaaagaucuggggaucggacaugucgccgcugagaaucaccaacacgccaccaugcuugacguggaucugagacccgcgagcgccuggacacucuacgcuguugccaccacagugauuaccccuaugaugcggcauacgaucgaaaacacaaccgcuaauauuucucugacagccaucgcgaaccaggccgcuauucugaugggccucgacaagggcuggcccaucuccaaaauggauaucggggucccgcuucuggcccugggaugcuacagccaggugaauccucucacccugaccgcugccguccuuaugcugguggcucacuaugccauuaucggccccgggcuccaggcgaaggccacacgcgaggcucaaaagagaacggccgcuggaauuaugaaaaaccccaccguugacggcaucguggccauugaucuggacccugucguguacgacacaaaguucgaaaaacagcuggggcagaucaugcuccuuauccuguguaccucucagauucugcucaugcggacaaccugggcccugugcgaguccaucacgcuugcgacaggaccgcugaccacccucugggaaggcagccccggcaaguuuuggaauacaaccauugcuguuucuauggccaacaucuuccgcgggagcuaucuggcuggagccggccuggccuucucccucaugaaaucucuugggggaggcagacgggggacaggagcucaaggcgagacgcugggcgagaaguggaagcgccagcugaaucagcucagcaaauccgaauuuaacaccuacaagagaagcgggauuauggagguggaucgguccgaagccaaagagggacugaagagaggcgaaacaaccaaacaugcggucucucgcgggacagccaaacuucggugguucguggagagaaaucuggugaagccugagggaaaaguuaucgaccucggcugugggcgcggaggcuggagcuauuacugcgcuggccugaagaaagucaccgaagugaagggguauacgaaaggaggccccgggcacgagggaccuauccccauggccaccuacggcuggaaccuggugaagcuccauuccgggaaagaugucuuuuucaugccuccggaaaagugugacacacuucugugcgauauuggagagucuagccccaauccuaccaucgaagagggccggacacugagaguucucaagaugguggagcccuggcugcgcggcaaccaguuuuguauuaaaauccuuaauccuuacaugcccuccguggucgaaacccuggagcaaaugcagcggaaguaugggggaaugcucgugagaaacccgcugucucgcaauagcacacacgaaauguacuggguuuccugcggcaccgggaacauugugagcgcugucaacaugacgucucggaugcugcucaauagauucacaauggcccaccgcaaaccuaccuaugagcgggacguggaucugggagcgggcaccagacauguugccguggagcccgaagucgcuaaccuugacaucauugggcagcgcaucgagaauaucaagaacgaacacaaauccacauggcauuacgaugaggacaaucccuauaagacgugggccuaccacggaagcuaugaagugaagccuucuggcuccgcuagcucuauggugaacggcgucguuagacugcucaccaaacccugggaugugauuccuauggugacacaaaucgccaugaccgacacaaccccguuugggcagcagcgggucuucaaggagaaaguggacacacgcacccccagagcuaagcggggaacgacccagauuauggagguuacagccaaauggcuguggggcuuucuuuccagaaauaagaagccucggaucuguacccgcgaagaguucacaagaaaagugcggagcaacgcggccauuggggcugucuuuguggaugaaaaucaauggaacuccgccaaggaggcuguugaagacgagcgcuucugggaucuggugcacagagagcgggaacuccauaaacagggaaagugcgcuaccugcgucuacaauaugaugggcaaacgcgagaagaagcugggggaauuuggcaaagccaagggaagcagagcgaucugguacauguggcugggcgcucgguuccucgaguucgaagcccugggguuuaugaacgaggaccacugguucucucgcgagaauagccuuuccggaguggaaggcgaggggcugcauaaacucggauauauccugagagauauuucuaagauccccggcgggaacauguacgccgacgauacggcuggcugggacacacggauuaccgaagaugaccuucagaaugaggccaaaaucacagauauuauggagccugaacacgcucugcucgccaccagcaucuuuaagcugacguaucagaacaaaguugugcgcguccaaagacccgcgaagaacggaaccgugauggacgucaucucccggcgcgaucagagaggcucuggacaggugggaacauacggccugaauaccuucacaaacauggagguucagcucauucggcaaauggaaagcgaggggaucuuucugccguccgaacuugagaccccuaaucuggccgagagagugcucgacuggcuggaaaagcauggagcugagcgccuuaaacggauggccauuucuggcgacgauugugucgugaagcccaucgacgauagauucgcuacagcccugaccgcgcucaacgacauggggaaagugcgcaaggauauuccucagugggaacccagcaaaggcuggaaugacuggcagcagguuccuuuuugcucccaccacuuccaucaacugaucaugaaggauggacgggagaucgugguccccuguagaaaccaggacgaacuggugggccgcgcccggguuagccagggggcuggauggucucucagagagacggccugccugggcaaguccuaugcucaaauguggcagcuuauguacuuucaccgccgggaucugagacucgccgcuaaugccauuuguagcgcggugccggucgacugggugccuacaucucgcaccaccugguccauccaugcccaccaccaguggaugacaaccgaggauaugcugagcgucuggaaccggguguggauugaagagaaucccuggauggaagacaaaacacauguuuccucuugggaggaagugcccuaucuugggaagagagaggaccaguggugcggaagccugaucggccucacggcucgggccaccugggccacaaacauucaagucgcuaucaaucaggugagacgccugauugggaacgagaauuaccuggauuacaugaccuccaugaaacgguucaagaacgaaagcgacccugagggcgcccucugguga

SEQ ID NO: 18696 - RNA, 9879 nt, Artificial Sequence
  derived and/or modified CDS sequence (opt5) from DENV-1__KF973453__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauuaucucucuguucccucucugucuguccacaacgagccagaaaaccacauggcuuccggugcugcuggggucuuuuggaugcaagccccucaccauguuccugauuacagaaaauaagaucuggggccggaaauccuggccucuuaacgagggcauuauggccaucgggaucgucagcauucugcucucuucccugcucaagaaugacguuccccuggcgggaccucuuaucgccggcgggaugcugauugcuuguuaugugaucagcggauccagcgccgaucugucucucgagaaagcugccgaagugagcugggagcaagaagccgagcauuccggcaccucucacaacauucuggucgaagugcaggacgaugggacgaugaagaucaaagacgaggagcgcgaugacacccuuacaauccugcucaaggcuacccugcucgcgguuagcggaguguaccccauguccauuccugccacacuguuugucugguauuucuggcagaaaaagaagcagagaucuggcgugcuuugggauacccccagcccgccugaaguugagcgggcugugcuggacgauggcaucuaccgcauucugcaaagagggcuccugggacggucccaggucggcgugggggucuuccaggacggaguguuucauacaauguggcacguuacgcgcggcgccgugcuuauguaucaggggaaaagacuggaacccucuugggccagcgucaagaaagaccucaucuccuacggaggcggcuggcgguuccaagggagcuggaauaccggagaggaggugcagguuauugcuguggaaccuggcaagaaccccaaaaauguccagacaaccccggggaccuuuaagacaccugagggagaagugggcgccaucgcgcuggauuucaagcccgggacgucuggauccccuauugugaacagagagggcaaaaucguuggccucuacgggaauggagucgugaccacaagcggcaccuaugugucugcuaucgcccaagccaaggcuucccaggaagggccccugcccgagauugaggacgaagucuuuaaaaagcgcaaccuuacaaucauggaucugcacccuggaagcggcaaaacccggagauaccugccggccauugugcgcgaggcgaucaagcggaagcucagaacgcugauucuugcucccacacgcguuguggccuccgaaauggccgaggcucugaaagggaugccuauccgguaucagaccaccgccgucaagucugaacauacaggcagagagaucguggaccucaugugccacgcuaccuucacaaugcgccugcugagccccguucgggugccuaauuacaacaugauuaucauggaugaggcccauuuuaccgaccccgcguccauugccgcuagaggauauaucagcacgcgggucggcaugggggaagccgcugccauuuucaugacagccaccccuccgggaucuguggaggcuuuuccccaguccaaugcgguuauccaagaugaagagcgcgacaucccugaaagaagcuggaacucuggcuacgauuggauuacagacuuccccgggaaaaccgugugguuugucccuagcaucaaguccggaaaugauauugccaacugucuccggaaaaacggcaagcgcgugauccagcuuucuagaaagacguucgacaccgaguaucagaaaacaaagaauaacgacugggauuacguggucaccacagacauuagcgagaugggggcuaauuuccgggccgauagaguuaucgacccccgccggugccugaaaccggugauucugaaggauggcccugaaagagugauccucgccggacccaugcccgucaccguggcuuccgccgcgcagcgccggggcagaaucgggcgcaaccaaaauaaagagggagaccaguacguuuauaugggccagccucugaacaaugaugaagaccacgcucauuggacagaggccaagaugcuucuggauaacauuaauacccccgaggggaucauuccugcccucuuugaaccggagcgggaaaagucugcugccaucgacggagaguacagacugcgcggcgaagcgagaaaaacguucguggagcugaugcggcgcggggaucuccccgucuggcuuagcuauaagguggccuccgagggcuuucaguacagcgacagacgguggugcuucgauggagaacgcaacaaucaaguucuggaggaaaacauggacguggagauuuggacaaaagaaggcgagagaaagaaacugcggccuagauggcucgacgcucgcaccuauucugauccccuggcccuucgggaguuuaaggaauucgcugccgggagacgcuccgucagcggagaccugauccucgagaucggcaaacugccucagcaccugacccuccgggcucagaaugcccuugauaaccuggugaugcugcacaauuccgaacaggggggaaaggcguacagacaugccauggaggaacuccccgacacaauugagacccugaugcuucuggcucucaucgccguccugacaggcggcgugacgcuguuuuuccucucugggaagggacuuggcaaaaccagcauugggcugcuguguguuacagcuuccucugcccuccuguggauggccagcguggagccgcacuggaucgcugcguccauuauccuugaauuuuuccugauggugcuccugaucccugagcccgaucggcaacgcaccccucaggacaaccagcuggccuaugucguuauuggacuccuuuuuaugauccugacaguggcugccaacgaaaugggccugcucgagaccacgaagaaagaucuggggauuggacauguggccgcugagaaucaccaacacgccaccaugcuugacgucgaucugagacccgcgagcgccuggacacucuacgcuguggccaccacaguuaucaccccuaugaugcggcauacgauugaaaacacaaccgcuaauaucucucugacagccauugcgaaccaggccgcuauccugaugggccucgacaagggcuggcccaucuccaaaauggauauuggggugccgcuucuggcccugggaugcuacagccaggucaauccucucacccugaccgcugccgugcuuaugcuggucgcucacuaugccaucauuggccccgggcuccaggcgaaggccacacgcgaggcucaaaagagaacggccgcuggaaucaugaaaaaccccaccguggacggcauuguugccaucgaucuggacccuguggucuacgacacaaaguucgaaaaacagcuggggcagaucaugcuccuuauucuguguaccucucagauccugcucaugcggacaaccugggcccugugcgaguccauuacgcuugcgacaggaccgcugaccacccucugggaaggcagccccggcaaguuuuggaauacaaccaucgcugugucuauggccaacauuuuccgcgggagcuaucuggcuggagccggccuggccuucucccucaugaaaucucuugggggaggcagacgggggacaggagcucaaggcgagacgcugggcgagaaguggaagcgccagcugaaucagcucagcaaauccgaauuuaacaucuacaagagaagcgggaucauggagguugaucgguccgaagccaaagagggacugaagagaggcgaaaccacaaaacaugcggugucucgcgggaccgccaagcuucggugguucgucgagagaaaucuggugaagccugagggaaaagugauugaccucggcugugggcgcggaggcuggagcuauuacugcgcuggccugaagaaaguuacagaagucaagggguauaccaaaggaggccccgggcacgaggaaccuauccccauggccacguacggauggaaccuggugaagcuccauuccggcaaagauguguuuuucaugccuccggagaagugugacacccuucugugcgauauuggggaaucuagccccaauccuacaaucgaggagggacggacccugagaguccucaagaugguugaacccuggcugcgcggcaaccaguuuuguauuaaaauccuuaauccuuacaugcccuccgugguggagacacuggaacaaaugcagcggaaguauggcgggaugcucgucagaaacccgcugucucgcaauagcacccacgagauguacuggguguccugcggaacaggcaacauuguuagcgcugugaacaugaccucucggaugcugcucaauagauucacgauggcccaccgcaaaccuacauaugagcgggacgucgaucugggggcgggaaccagacauguggccguugaacccgagguggcuaaccuugacaucaucggccagcgcauugaaaauaucaagaacgagcacaaauccaccuggcauuacgaugaagacaaucccuauaagacaugggccuaccacgggagcuaugaggucaagccuucuggauccgcuagcucuauggugaacggcguggucagacugcucacgaaacccugggauguuauuccuauggugacccaaaucgccaugacagacaccacaccguuuggccagcagcggguguucaaggagaaagucgacacccgcacacccagagcuaagcgggggaccacgcagauuauggaagugaccgccaaauggcuguggggauuucuuuccagaaauaagaagccucggaucuguacacgcgaggaauucaccagaaaaguucggagcaacgcggccaucggcgcuguguuugucgaugagaaucaauggaacuccgccaaggaagcuguggaggacgagcgcuucugggaucugguucacagagaacgggagcuccauaaacaggggaagugcgccacaugcguguacaauaugaugggaaaacgcgaaaagaagcugggcgaguuugggaaagccaagggcagcagagcgauuugguacauguggcugggagcucgguuccucgaauucgaggcccugggcuuuaugaacgaggaccacugguucucucgcgaaaauagccuuuccggggucgagggagaaggccugcauaaacucggguauauccugagagauauuucuaagauccccggaggcaacauguacgccgacgauaccgcugggugggacacgcggauuacagaggaugaccuucagaaugaggccaaaaucaccgauaucauggaaccugagcacgcucugcucgccacaagcauuuuuaagcugaccuaucagaacaaagugguucgcgugcaaagacccgcgaagaacggcacggucauggacgugaucucccggcgcgaucagagaggaucuggccaggucgggaccuacggacugaauacauucaccaacauggaagugcagcucauucggcaaauggagagcgaaggcaucuuucugccguccgagcuugagacaccuaaucuggccgaaagaguucucgacuggcuggagaagcauggggcugaacgccuuaaacggauggccauuucuggagacgauuguguggucaagcccaucgacgauagauucgcuaccgcccugacagcgcucaacgacaugggcaaagugcgcaaggauaucccucagugggagcccagcaaaggguggaaugacuggcagcaggugccuuuuugcucccaccacuuccaucaacugauuaugaaggauggccgggaaaucguugugcccuguagaaaccaggacgagcuggucggacgcgcccgggugagccagggcgcuggguggucucucagagagaccgccugccugggaaaguccuaugcucaaauguggcagcuuauguacuuucaccgccgggaucugagacucgccgcuaaugccauuuguagcgcgguuccgguggacugggucccuacgucucgcacaaccugguccauccaugcccaccaccaguggaugaccacagaagauaugcugagcguguggaaccgggucuggauugaggaaaaucccuggauggaggacaaaacccauguguccucuugggaagagguucccuaucuuggcaagagagaggaccaguggugcgggagccugaucggacucacagcucgggccacgugggccaccaacauucaaguggcuaucaaucaggucagacgccugaucggcaacgaaaauuaccuggauuacaugacauccaugaaacgguucaagaacgagagcgacccugaaggggcccucugguga

SEQ ID NO: 18697 - RNA, 9879 nt, Artificial Sequence
  derived and/or modified CDS sequence (opt5) from DENV-1__KF973454__SS-prME
agcgugaccaugcugcucaugcugcuucccacagcccuggcuuuccaccucacgaccagaggcggggagccucauaugaucgucuccaagcacgaacggggaaaaucucugcuuuuuaagacaagcaccggcguuaacaugugcacacugauugccauggaccucggggagcugugugaagauaccaugacauacaaaugcccgcgcaucaccgaggcggaacccgacgauguggacuguuggugcaaugcuacggauaccugggugacauauggaaccuguucccagacaggcgagcauagacgggacaagcgcucugucgcccuggccccucacguggggcucggacuggagaccagaacggaaacauggaugagcuccgagggcgcuuggaaacaaauucagcggguugaaaccugggcccuucgccaucccggcuucacagugaucgcucuguuucucgcccacgcgauugggaccucuaucacccagaagggaaucauuuucauccugcuuaugcuggucacaccuagcauggccaugagaugcgugggcauugggaaccgggauuuuguugagggacucuccggcgcuacguggguggacgucgugcuggagcacgggagcugugugaccacaauggccaagaauaaacccacccuggauaucgaacuccugaagacagaggucaccaacccugcuguucuucgcaaacugugcauugaagccaagaucucuaauacgacaaccgacuccagauguccgacccagggagaggcgacacucguggaagagcaagaugccaacuucgugugccggcgcacccuggucgacagaggcuggggcaauggguguggacuuuuuggcaaagggagccugcucacaugcgcuaaguucaagugcgugacgaaacuggagggaaagauuguucaguacgaaaaccugaaauauucugugaucgucaccgugcauacaggcgaucagcaccagguugggaaugagaccacagaacauggaaccaucgccacgauuaccccccaagcuccuacauccgagauccagcucaccgacuacggcgcccuggcccuugacuguagcccccggacaggccuggauuuuaacgaaauggugcuccugaccaugaaggagaaaucuuggcuuguccacaagcagugguuccuggaccucccucugcccuggacguccggggcuagcacaucccaggagaccuggaaucgccaagaucugcucgugacauuuaaaaccgcgcacgccaagaagcaggaagucgugguucugggaucucaggagggcgcuaugcauaccgcccuuacaggggccacggaaauucaaaccagcggaacaaccacaaucuucgcuggccaccugaaaugcagacucaagauggacaaacugacccugaaggggacguccuaugugauguguacaggcagcuuuaaacuugagaaggaagucgccgagacccagcauggaaccgugcucguucaggugaaguacgagggcacagaugcgccgugcaaaauuccuuucucuacccaggacgaaaagggggucacacaaaacggacggcugaucacggcuaaucccaucgugaccgauaaagagaagccugugaacauugaaacagagccccccuucggcgaguccuauaucguugucggggccggagaaaaagcccugaagcucagcugguuuaagaaaggcucuagcauugggaagauguucgaggcuaccgccagaggcgcucgccggauggccauccugggagacacagcgugggauuuuggcuccauugggggaguguucaccucugugggcaaacuuguccaccagguguuugggacggccuacggaguucuguucagcggcguguccuggaccaugaagaucgggaucggcauucuccugacauggcugggacuuaauagcagaucuaccucccucagcaugacauguaucgcugucggcauggugacccuguaccuggggguuauggugcaggccgacucuggaugcgucauuaacuggaaaggccgcgaacucaaguguggguccggaaucuuugugacaaacgagguucauaccuggacggaacaguauaaguuccaagcugauagcccuaaacggcuguccgccgcgauuggcaaggccugggaggagggggugugcggcaucagaucugcuacacgccuugaaaauauuauguggaaacagaucagcaacgagcugaaucacauccuccuggaaaacgacaugaaguuuaccgucguggugggagacgccaauggcauucuggcucaggggaaaaagaugauccggccgcagcccauggagcacaaauacuccuggaagucuuggggaaaggccaaaauuaucggcgccgauauucaaaacaccacauucaucaucgacgggccugauacccccgaauguccugacgaucagagagcuuggaauauuugggaggucgaggacuauggauuuggcaucuucacgacaaacauuuggcuuaagcuccgcgauagcuacacccagaugugcgaccaucggcugauguccgcggccaucaaagauagcaaggcuguucacgccgacaugggcuauuggauugaaucugagaaaaaugaaacauggaagcuggccagagcuuccuuuaucgaggugaagaccuguacauggcccaaaagccauacccucuggucuaacggggugcuggaauccgagaugaucauuccgaagaucuacggaggcccuauuagccagcacaauuaucgccccggguacuucacgcaaaccgccggaccuuggcaccuuggcaaacuggagcucgauuucgaccugugcgaagggacaaccgucgugguugaugagcauugcggaaaccggggccccucucugagaacaaccacggugacaggcaagaucauucacgaaugguguugccggagcuguacccuuccuccccuccgcuuuagaggggaggacggaugcugguacggcauggagauccggccggucaaagaaaaggaggaaaaucuggugagauccaugguuagcgcggggucuggagagguggacuccuucagccugggcauccucugugucuccauuaugaucgaagaggugaugcgcucucgguggagcagaaagaugcugaugacagggacccuugcuguuuuucugcuccugauuaugggacagcugaccuggaacgaucuuauccgccugugcauuauggugggcgccaaugccuccgacagaaugggcauggggacaacguaucucgcucugauggccaccuucaaacuccggccuauguuugcggucggaauccuguuccgcagacuuacaucucgggaggugcugcuccugaccauuggccugagccuuguggcuuccgucgaacugcccaacucucucgaggaacugggggauggacucgccaugggcaucaugaugcugaagcuucugacagaguuucagccccaucaacucuggaccacgcugcugagccuuacauucaucaaaaccacccugucccucgacuacgccuggaagacaaccgcuauggcccugagcauuguuucucucuuuccuaucugucuguccacaacgagccagaaaaccacauggcuuccggugcugcuggggucuuucggaugcaagccccucaccauguaucugauuacagaaaacaagaucuggggccgcaaauccuggccuauuaaugagggcaucauggcuaucgggauugugagcauccuucugucuucccuccugaagaacgaugucccccucgccggaccucugauugcgggcgggaugcuuaucgccuguuacgugauuagcggauccagcgcugaccugucucuggagaaagccgcugaaguuagcugggagcaggaagccgagcacuccggcaccucucauaauauccucguggaaguccaggaugacgggacgaugagaaucaaggaugaggagaaagacgauacccugacaauucuucugaaggccacccuccuggcugugagcggaguuuaucccauguccaucccugcgacacucuuugugugguacuucuggcaaaaaaagaagcagcggucuggcguccugugggacacccccagcccgccugaaguggagcgcgccguccuugaugacggcauuuauagaauccugcagcgggggcugcucggacgcucccaggugggcguugggguguuucaagacggagucuuccacacaauguggcacgugacgagaggcgcuguucugauguaccaggggaaacggcuugaacccucuugggccagcgugaagaaagaucugauuuccuacggaggcggcuggagauuccaggggagcuggaacaccggagaggagguccaggugaucgccguggaaccuggcaagaaucccaaaaacguucaaacaaccccggggaccuuuaagacaccugagggagaagucggcgcuauugcccucgacuucaagcccgggacgucuggauccccuaucgugaaucgcgagggcaaaaucgugggccuguaugggaacggagucgugaccacaagcggcaccuacguuucugcgauugcucaggccaaggccucccaggaagggccccuccccgagaucgaggaugaaguguuuaaaaagcggaaucugacaauuauggaccuucauccuggaagcggcaaaaccagacgcuaucugccggcuaucguccgggaggccauuaagagaaagcugcgcacgcucauccuggcgcccacacgggugguugcuuccgaaauggccgaggcccuuaaagggaugccuaucagauaccaaaccaccgcugugaagucugaacacacaggccgcgagauugucgaucugaugugccaugccaccuucacaaugcggcuccugagccccgugagaguuccuaacuauaauaugaucauuauggacgaggcucacuuuaccgaucccgccuccaucgcggcccggggauacauuagcacgcgcgugggcaugggggaagcugccgcuaucuucaugacagccaccccuccgggaucugucgaggccuuuccccaguccaacgcugugauccaggacgaagagagagauauuccugaacggagcuggaauucuggcuaugacuggaucacagauuuccccgggaaaaccgugugguuugucccuagcauuaaguccggaaacgacaucgcgaauugucugcgcaaaaacggcaagagaguuauucagcucucucggaagacguucgacaccgaguaccaaaaaacaaagaacaaugauugggacuacguggugaccacagauaucagcgagaugggggccaacuuuagagcugaccgcgucauugauccccggagaugccuuaaaccggugauccugaaggacggcccugaacgcguuauccuggccggacccaugcccgugaccgucgccuccgcugcccagcggagaggccgcauugggcggaaucagaacaaagagggagaucaguauguguacaugggccaaccucucaauaacgacgaagaucaugcgcacuggacagaggcuaagaugcugcuugacaauaucaacacccccgaggggauuaucccugcccuguucgaaccggagagagaaaagucugccgcuauugauggagaguaucgccucagaggcgaagcccggaaaacguucguugagcugaugcgcagaggggaccugcccguguggcucagcuacaaggucgcguccgagggcuuucaguauagcgaucggcgcuggugcuucgacggagaaagaaauaaccaggugcuugaggaaaauauggacgucgagaucuggacaaaagaaggcgagcggaagaaacugagaccucgcuggcuggaugcccggaccuacucugacccccucgcucugagagaguuuaaggaauucgccgcugggcgccgguccgugagcggagaucuuauccuggagauuggcaaacucccucagcaccugacccugagagcccaauccgcucucgacaaccuuguuaugcugcauaauucugaacaggggggaaaggccuaucggcacgcgauggaggaacugcccgauacaaucgagacccucaugcugcuugcccugauugcugugcucacaggcggcgugaugcuguuuuuccugagcgggaagggacucggcaaaacguccaucgggcuucugugugucaccgccucuagcgcucugcucuggauggccuccguugagccgcauuggauugccgcuagcaucauccuggaauuuuuccuuauggugcugcucauuccugagcccgaccgccagagaacaccucaggauaaccaacuggcguacguggucaucggacugcucuuuaugauucuuaccguggccgcuaaugaaaugggccugcuggagacaaccaagcgggaccucgggaucggacacguugccgccgagaaccaccagcaugcuacgaugcuggauguggaccuucgccccgccucugcguggacccuguacgccgucgcuacaaccgugauuacaccuaugaugagacacaccaucgaaaacacgacagccaauauuucccucaccgcuaucgccaaccaggcggccauccugaugggccuggauaaaggcuggcccauuagcaagauggacaucggggucccgcuccuugcucugggaugcuauucucaagugaauccucugacacucaccgccgcuguucugaugcuuguggcccauuacgcuauuaucggccccgggcugcaggccaaagcgacccgggaggcccagaagcgcacagcugccggaauuaugaagaaccccacggucgauggcaucguggcuaucgaccucgacccuguuguguaugaugccaaauucgaaaagcagcuggggcaaauuaugcugcucauccuuuguaccucccagauucugcugaugagaacaaccugggcccucugcgagagcaucacacuggcgaccggaccgcuuacgacacugugggaaggcucucccggcaaauuuuggaauaccaccauugcugucagcauggccaacaucuuccggggguccuaccucgcuggagccggccuggccuuuucucugaugaagagccucgggggaggccgcagagggacaggagcucagggcgagacccuuggcgagaaauggaagcggcagcugaaucaacuguccaagccugaauucaacacauauaaaagaagcgggaucauggagguggaccgcuccgaagccaaggagggacucaaacggggcgaaacgaccaagcacgcggugucuagagggacagccaaacugcgcugguucguugagcggaaucuugucaagcccgagggaaaggugauugaucugggcugugggagaggaggcuggagcuacuauugcgcuggccucaaaaaggugaccgaagucaaaggguacacaaagggaggcccugggcaugaggaacccaucccuauggccaccuacggauggaaccugguuaaacugcacuccggcaaggacguguuuuucaugccgcccgagaaaugugauacgcuccuuugcgacauuggggaaucuagcccuaaucccaccaucgaggagggacgcacacugcgggugcugaagauggucgaaccuuggcucagaggcaaccaguuuuguauuaagauccugaaucccuauaugccguccgugguugagacccuugaacagaugcagcgcaaacacggcgggaugcuggugcggaacccucucucuagaaauagcacacaugagauguacugggucuccugcggaaccggcaacauugugagcgcuguuaauaugacaucucgcaugcugcugaaccgguucaccauggcccacagaaagcccacguaugagcgcgauguggaccucggggcgggaacaagacaugucaccguggaacccgagguggccaaccuggauaucaucggccaacggauugaaaauaucaaaaacgagcacaaguccaccuggcacuacgacgaagauaauccuuauaaaacaugggcuuaccaugggagcuaugaggucaagcccucuggauccgccagcucuaugguuaacggcguggugcgccuucugacgaagccuugggacgucauuccgauggugacccagaucgcuaugacagacaccacacccuuuggccagcaaagaguuuucaaagagaagguggauacccggacaccuagagccaaacgggggaccacgcagauuauggaagucaccgcuaaguggcucuggggauuucugucccgcaauaaaaagcccagaaucuguacacgggaggaauucacccgcaaggugagaagcaacgccgcgaucggcgccguuuuuguggacgagaaucaguggaacuccgcuaaagaagccgucgaggaugagcgguucugggaccuugugcaccgcgaaagagagcugcauaagcaggggaaaugcgcuacaugcguuuacaauaugaugggaaagcgggaaaaaaagcucggcgaguuugggaaggccaaaggcagccgcgccauuugguacauguggcugggagcgagauuccuggaauuugaggcucucggcuucaugaacgaggaucacugguucucucgggaaaauagccuguccgggguggagggagaaggccuucauaagcugggguauauccuccgcgacauuucuaaaaucccuggaggcaacauguacgccgaugacaccgccgggugggauacgagaauuacagaggacgaucugcaaaaugaggcuaagaucaccgacaucauggaacccgagcacgcccuucuggcuacaagcauuuuuaaacucaccuaucagaacaaggucgugcggguccagcgcccggccaaaaauggcacggugauggauguuaucuccagacgggaccagagaggaucuggccaaguggggaccuacggacugaacacauucaccaacauggaaguccagcugauucgccagauggagagcgaaggcaucuuucucccuuccgagcuggagacacccaaucuugcggaacgggugcuggacuggcucgagaagcacggggccgaaagacugaagcgcauggcuauuucuggagaugacugugugguuaaaccuaucgaugaccgguucgccaccgcucuuacagcccugaacgauaugggcaaggugagaaaagacaucccccagugggagccuagcaagggguggaaugauuggcaacagguccccuuuugcucccaucacuuccaucagcucauuaugaaagacggccgcgaaaucgugguuccgugucggaaccaggaugagcuggugggaagagcgcgcgucagccaaggcgccggguggucucugcgggagaccgcuugccucggaaaguccuaugcccagauguggcagcugauguacuuucacagacgcgaccuucggcuggcugccaaugcuauuuguagcgccgugccugucgauugggugcccacgucuagaacaaccugguccauccacgcgcaucaccaauggaugaccacagaagacaugcucagcguuuggaaccggguguggauugaggaaaaucccuggauggaggacaagacccaugucuccucuugggaagaggugccuuaucugggcaaaagagaggaucaguggugcgggagccuuaucggacugacagcccgcgcuacgugggccaccaacauucagguugccaucaaucaggugcggagacucaucggcaacgaaaauuaccuggacuacaugacauccaugaagcgcuucaaaaacgagagcgauccggaagggguccugugguga

SEQ ID NO: 18698 - RNA, 9879 nt, Artificial Sequence
  derived and/or modified CDS sequence (opt5) from DENV-1__KF973455__SS-prME
agcgugaccaugcugcucaugcugcuucccacagcccuggcuuuccaccucacgaccagaggcggggagccucauaugaucgucuccaagcacgaacggggaaaaucucugcuuuuuaagacaagcaccggcguuaacaugugcacacugauugccauggaccucggggagcugugugaagauaccaugacauacaaaugcccgcgcaucaccgaggcggaacccgacgauguggacuguuggugcaaugcuacggauaccugggugacauauggaaccuguucccagacaggcgagcauagacgggacaagcgcucugucgcccuggccccucacguggggcucggacuggagaccagaacggaaacauggaugagcuccgagggcgcuuggaaacaaauucagcggguugaaaccugggcccuucgccaucccggcuucacagugaucgcucuguuucucgcccacgcgauugggaccucuaucacccagaagggaaucauuuucauccugcuuaugcuggucacaccuagcauggccaugagaugcgugggcauugggaaccgggauuuuguugagggacucuccggcgcuacguggguggacgucgugcuggagcacgggagcugugugaccacaauggccaagaauaaacccacccuggauaucgaacuccugaagacagaggucaccaacccugcuguucuucgcaaacugugcauugaagccaagaucucuaauacgacaaccgacuccagauguccgacccagggagaggcgacacucguggaagagcaagaugccaacuucgugugccggcgcacccuggucgacagaggcuggggcaauggguguggacuuuuuggcaaagggagccugcucacaugcgcuaaguucaagugcgugacgaaacuggagggaaagauuguucaguacgaaaaccugaaauauucugugaucgucaccgugcauacaggcgaucagcaccagguugggaaugagaccacagaacauggaaccaucgccacgauuaccccccaagcuccuacauccgagauccagcucaccgacuacggcgcccuggcccuugacuguagcccccggacaggccuggauuuuaacgaaauggugcuccugaccaugaaggagaaaucuuggcuuguccacaagcagugguuccuggaccucccucugcccuggacguccggggcuagcacaucccaggagaccuggaaucgccaagaucugcucgugacauuuaaaaccgcgcacgccaagaagcaggaagucgugguucugggaucucaggagggcgcuaugcauaccgcccuuacaggggccacggaaauucaaaccagcggaacaaccacaaucuucgcuggccaccugaaaugcagacucaagauggacaaacugacccugaaggggacguccuaugugauguguacaggcagcuuuaaacuugagaaggaagucgccgagacccagcauggaaccgugcucguucaggugaaguacgagggcacagaugcgccgugcaaaauuccuuucucuacccaggacgaaaagggggucacacaaaacggacggcugaucacggcuaaucccaucgugaccgauaaagagaagccugugaacauugaaacagagccccccuucggcgaguccuauaucguugucggggccggagaaaaagcccugaagcucagcugguuuaagaaaggcucuagcauugggaagauguucgaggcuaccgccagaggcgcucgccggauggccauccugggagacacagcgugggauuuuggcuccauugggggaguguucaccucugugggcaaacuuguccaccagguguuugggacggccuacggaguucuguucagcggcguguccuggaccaugaagaucgggaucggcauucuccugacauggcugggacuuaauagcagaucuaccucccucagcaugacauguaucgcugucggcauggugacccuguaccuggggguuauggugcaggccgacucuggaugcgucauuaacuggaaaggccgcgaacucaaguguggguccggaaucuuugugacaaacgagguucauaccuggacggaacaguauaaguuccaagcugauagcccuaaacggcuguccgccgcgauuggcaaggccugggaggagggggugugcggcaucagaucugcuacacgccuugaaaauauuauguggaaacagaucagcaacgagcugaaucacauccuccuggaaaacgacaugaaguuuaccgucguggugggagacgccaauggcauucuggcucaggggaaaaagaugauccggccgcagcccauggagcacaaauacuccuggaagucuuggggaaaggccaaaauuaucggcgccgauauucaaaacaccacauucaucaucgacgggccugauacccccgaauguccugacgaucagagagcuuggaauauuugggaggucgaggacuauggauuuggcaucuucacgacaaacauuuggcuuaagcuccgcgauagcuacacccagaugugcgaccaucggcugauguccgcggccaucaaagauagcaaggcuguucacgccgacaugggcuauuggauugaaucugagaaaaaugaaacauggaagcuggccagagcuuccuuuaucgaggugaagaccuguacauggcccaaaagccauacccucuggucuaacggggugcuggaauccgagaugaucauuccgaagaucuacggaggcccuauuagccagcacaauuaucgccccggguacuucacgcaaaccgccggaccuuggcaccuuggcaaacuggagcucgauuucgaccugugcgaagggacaaccgucgugguugaugagcauugcggaaaccggggccccucucugagaacaaccacggugacaggcaagaucauucacgaaugguguugccggagcuguacccuuccuccccuccgcuuuagaggggaggacggaugcugguacggcauggagauccggccggucaaagaaaaggaggaaaaucuggugagauccaugguuagcgcggggucuggagagguggacuccuucagccugggcauccucugugucuccauuaugaucgaagaggugaugcgcucucgguggagcagaaagaugcugaugacagggacccuugcuguuuuucugcuccugauuaugggacagcugaccuggaacgaucuuauccgccugugcauuauggugggcgccaaugccuccgacagaaugggcauggggacaacguaucucgcucugauggccaccuucaaacuccggccuauguuugcggucggaauccuguuccgcagacuuacaucucgggaggugcugcuccugaccauuggccugagccuuguggcuuccgucgaacugcccaacucucucgaggaacugggggauggacucgccaugggcaucaugaugcugaagcuucugacagaguuucagccccaucaacucuggaccacgcugcugagccuuacauucaucaaaaccacccugucccucgacuacgccuggaagacaaccgcuauggcccugagcauuguuucucucuuuccuaucugucuguccacaacgagccagaaaaccacauggcuuccggugcugcuggggucuuucggaugcaagccccucaccauguaucugauuacagaaaacaagaucuggggccgcaaauccuggccuauuaaugagggcaucauggcuaucgggauugugagcauccuucugucuucccuccugaagaacgaugucccccucgccggaccucugauugcgggcgggaugcuuaucgccuguuacgugauuagcggauccagcgcugaccugucucuggagaaagccgcugaaguuagcugggagcaggaagccgagcacuccggcaccucucauaauauccucguggaaguccaggaugacgggacgaugagaaucaaggaugaggagaaagacgauacccugacaauucuucugaaggccacccuccuggcugugagcggaguuuaucccauguccaucccugcgacacucuuugugugguacuucuggcaaaaaaagaagcagcggucuggcguccugugggacacccccagcccgccugaaguggagcgcgccguccuugaugacggcauuuauagaauccugcagcgggggcugcucggacgcucccaggugggcguugggguguuucaagacggagucuuccacacaauguggcacgugacgagaggcgcuguucugauguaccaggggaaacggcuugaacccucuugggccagcgugaagaaagaucugauuuccuacggaggcggcuggagauuccaggggagcuggaacaccggagaggagguccaggugaucgccguggaaccuggcaagaaucccaaaaacguucaaacaaccccggggaccuuuaagacaccugagggagaagucggcgcuauugcccucgacuucaagcccgggacgucuggauccccuaucgugaaucgcgagggcaaaaucgugggccuguaugggaacggagucgugaccacaagcggcaccuacguuucugcgauugcucaggccaaggccucccaggaagggccccuccccgagaucgaggaugaaguguuuaaaaagcggaaucugacaauuauggaccuucauccuggaagcggcaaaaccagacgcuaucugccggcuaucguccgggaggccauuaagagaaagcugcgcacgcucauccuggcgcccacacgggugguugcuuccgaaauggccgaggcccuuaaagggaugccuaucagauaccaaaccaccgcugugaagucugaacacacaggccgcgagauugucgaucugaugugccaugccaccuucacaaugcggcuccugagccccgugagaguuccuaacuauaauaugaucauuauggacgaggcucacuuuaccgaucccgccuccaucgcggcccggggauacauuagcacgcgcgugggcaugggggaagcugccgcuaucuucaugacagccaccccuccgggaucugucgaggccuuuccccaguccaacgcugugauccaggacgaagagagagauauuccugaacggagcuggaauucuggcuaugacuggaucacagauuuccccgggaaaaccgugugguuugucccuagcauuaaguccggaaacgacaucgcgaauugucugcgcaaaaacggcaagagaguuauucagcucucucggaagacguucgacaccgaguaccaaaaaacaaagaacaaugauugggacuacguggugaccacagauaucagcgagaugggggccaacuuuagagcugaccgcgucauugauccccggagaugccuuaaaccggugauccugaaggacggcccugaacgcguuauccuggccggacccaugcccgugaccgucgccuccgcugcccagcggagaggccgcauugggcggaaucagaacaaagagggagaucaguauguguacaugggccaaccucucaauaacgacgaagaucaugcgcacuggacagaggcuaagaugcugcuugacaauaucaacacccccgaggggauuaucccugcccuguucgaaccggagagagaaaagucugccgcuauugauggagaguaucgccucagaggcgaagcccggaaaacguucguugagcugaugcgcagaggggaccugcccguguggcucagcuacaaggucgcguccgagggcuuucaguauagcgaucggcgcuggugcuucgacggagaaagaaauaaccaggugcuugaggaaaauauggacgucgagaucuggacaaaagaaggcgagcggaagaaacugagaccucgcuggcuggaugcccggaccuacucugacccccucgcucugagagaguuuaaggaauucgccgcugggcgccgguccgugagcggagaucuuauccuggagauuggcaaacucccucagcaccugacccugagagcccaaaacgcucucgacaaucuuguuaugcugcauaacuccgaacaggggggaaaggccuaucggcacgcgauggaggaacugcccgauacaaucgagacccucaugcugcuugcccugauugcugugcucacaggcggcgugaugcuguuuuuccugucugggaagggacucggcaaaacgagcaucgggcuucugugugucaccgccuccucugcucugcucuggauggccagcguugagccgcauuggauugccgcuuccaucauccuggaauuuuuccuuauggugcugcucauuccugagcccgaccgccagagaacaccucaggauaaucaacuggcguacguggucaucggacugcucuuuaugauucuuaccguggccgcuaacgaaaugggccugcuggagacaaccaagcgggaccucgggaucggacacguugccgccgagaaccaccagcaugcuacgaugcuggauguggaccuucaccccgccagcgcguggacccuguacgccgucgcuacaaccgugauuacaccuaugaugcgccauaccaucgaaaauacgacagccaacauuucucucaccgcuaucgccaaucaggcggccauccugaugggccuggauaaaggcuggcccauuuccaagauggacaucggggucccgcuccuugcucugggaugcuauagccaagugaacccucugacacucaccgccgcuguucugaugcuuguggcccacuacgcuauuaucggccccgggcugcaggccaaagcgaccagagaggcccagaagcggacagcugccggaauuaugaagaaucccacggucgauggcaucguggcuaucgaccucgacccuguuguguaugaugccaaauucgaaaagcagcuggggcaaauuaugcugcucauccuuuguaccucucagauucugcugaugcgcacaaccugggcccucugcgaguccaucacacuggcgaccggaccgcuuacgacacugugggaaggcagccccggcaaauuuuggaacaccaccauugcugucucuauggccaauaucuucagagggagcuaccucgcuggagccggccuggccuuuucccugaugaagucucucgggggaggccggcgcgggacaggagcucagggcgagacccuuggcgagaaauggaagagacagcugaaccaacugagcaagccugaauucaauacauauaaacgguccgggaucauggagguggacagaagcgaagccaaggagggacucaaacgcggcgaaacgaccaagcaugcggugucccgggggacagccaaacugagaugguucguugagcgcaaccuugucaagcccgagggaaaggugauugaucugggcugugggcggggaggcuggucuuacuauugcgcuggccucaaaaaggugaccgaagucaaaggguacacaaagggaggcccugggcacgaggaacccaucccuauggccaccuacggauggaaucugguuaaacugcacagcggcaaggacguguuuuucaugccgcccgagaaaugugauacgcuccuuugcgacauuggggaauccucuccuaaccccaccaucgaggagggaagaacacugcgcgugcugaagauggucgaaccuuggcuccggggcaaucaguuuuguauuaagauccugaaccccuauaugccgagcgugguugagacccuugaacagaugcagagaaaacauggcgggaugcuggugcgcaauccucucucccggaacucuacacacgagauguacugggucagcugcggaaccggcaauauuguguccgcuguuaacaugacaagcagaaugcugcugaaccgcuucaccauggcccaucggaagcccacguaugagagagauguggaccucggggcgggaacacgccacgucaccguggaacccgagguggccaaucuggauaucaucggccaaagaauugaaaacaucaaaaaugagcacaagucuaccuggcauuacgacgaagauaacccuuauaaaacaugggcuuaccacggguccuaugaggucaagcccagcggaucugccuccagcaugguuaauggcguggugcggcuucugacgaagccuugggacgucauuccgauggugacccagaucgcuaugacagacaccacacccuuuggccagcaacgcguuuucaaagagaagguggauaccagaacaccucgggccaaaagagggaccacgcagauuauggaagucaccgcuaaguggcucuggggauuucugucucggaacaaaaagccccgcaucuguacaagagaggaauucacccggaaggugcgcuccaaugccgcgaucggcgccguuuuuguggacgagaaccaguggaauagcgcuaaagaagccgucgaggaugagagauucugggaccuugugcaucgggaacgcgagcugcacaagcaggggaaaugcgcuacaugcguuuacaacaugaugggaaagagagaaaaaaagcucggcgaguuugggaaggccaaaggcucccgggccauuugguacauguggcugggagcgcgcuuccuggaauuugaggcucucggcuucaugaaugaggaucauugguucagcagagaaaacucucugagcgggguggagggagaaggccuucacaagcugggguauauccuccgggacauuuccaaaaucccuggaggcaauauguacgccgaugacaccgccgggugggauacgcgcauuacagaggacgaucugcaaaacgaggcuaagaucaccgacaucauggaacccgagcacgcccuucuggcuacaucuauuuuuaaacucaccuaucagaauaaggucgugagaguccagcggccggccaaaaacggcacggugauggauguuaucagccgcagagaccagcggggauccggccaaguggggaccuacggacugaacacauucaccaauauggaaguccagcugauuagacagauggagucugaaggcaucuuucucccuagcgagcuggagacacccaaccuugcggaacgcgugcuggacuggcucgagaagcauggggccgaacggcugaagagaauggcuauuuccggagaugacugugugguuaaaccuaucgaugaccgcuucgccaccgcucuuacagcccugaaugauaugggcaaggugcggaaagacaucccccagugggagccuucuaagggguggaacgauuggcaacagguccccuuuugcagccaccauuuccaccagcucauuaugaaagacggcagagaaaucgugguuccgugucgcaaucaggaugagcuggugggacgggcgagagucucccaaggcgccggguggagccugcgcgagaccgcuugccucggaaagucuuaugcccagauguggcagcugauguacuuucaccggagagaccuucgccuggcugccaacgcuauuuguuccgccgugccugucgauugggugcccacgagccggacaaccuggucuauccaugcgcaccaucaauggaugaccacagaagacaugcucuccguuuggaauagaguguggauugaggaaaaccccuggauggaggacaagacccacgucagcuccugggaagaggugccuuaucugggcaaacgggaggaucaguggugcgggucucuuaucggacugacagccagagcuacgugggccaccaauauucagguugccaucaaccaggugcgccggcucaucggcaaugaaaacuaccuggacuacaugacaagcaugaagagauucaaaaaugaguccgauccggaaggggcucugugguga

SEQ ID NO: 18699 - RNA, 9879 nt, Artificial Sequence
  derived and/or modified CDS sequence (opt5) from DENV-1__KF973456__SS-prME
agcgugaccaugcugcucaugcugcuucccacagcccuggcuuuccaccucacgaccagaggcggggagccucauaugaucgucuccaagcacgaacggggaaaaucucugcuuuuuaagacaagcaccggcguuaacaugugcacacugauugccauggaccucggggagcugugugaagauaccaugacauacaaaugcccgcgcaucaccgaggcggaacccgacgauguggacuguuggugcaaugcuacggauaccugggugacauauggaaccuguucccagacaggcgagcauagacgggacaagcgcucugucgcccuggccccucacguggggcucggacuggagaccagaacggaaacauggaugagcuccgagggcgcuuggaaacaaauucagcggguugaaaccugggcccuucgccaucccggcuucacagugaucgcucuguuucucgcccacgcgauugggaccucuaucacccagaagggaaucauuuucauccugcuuaugcuggucacaccuagcauggccaugagaugcgugggcauugggaaccgggauuuuguugagggacucuccggcgcuacguggguggacgucgugcuggagcacgggagcugugugaccacaauggccaagaauaaacccacccuggauaucgaacuccugaagacagaggucaccaacccugcuguucuucgcaaacugugcauugaagccaagaucucuaauacgacaaccgacuccagauguccgacccagggagaggcgacacucguggaagagcaagaugccaacuucgugugccggcgcacccuggucgacagaggcuggggcaauggguguggacuuuuuggcaaagggagccugcucacaugcgcuaaguucaagugcgugacgaaacuggagggaaagauuguucaguacgaaaaccugaaauauucugugaucgucaccgugcauacaggcgaucagcaccagguugggaaugagaccacagaacauggaaccaucgccacgauuaccccccaagcuccuacauccgagauccagcucaccgacuacggcgcccuggcccuugacuguagcccccggacaggccuggauuuuaacgaaauggugcuccugaccaugaaggagaaaucuuggcuuguccacaagcagugguuccuggaccucccucugcccuggacguccggggcuagcacaucccaggagaccuggaaucgccaagaucugcucgugacauuuaaaaccgcgcacgccaagaagcaggaagucgugguucugggaucucaggagggcgcuaugcauaccgcccuuacaggggccacggaaauucaaaccagcggaacaaccacaaucuucgcuggccaccugaaaugcagacucaagauggacaaacugacccugaaggggacguccuaugugauguguacaggcagcuuuaaacuugagaaggaagucgccgagacccagcauggaaccgugcucguucaggugaaguacgagggcacagaugcgccgugcaaaauuccuuucucuacccaggacgaaaagggggucacacaaaacggacggcugaucacggcuaaucccaucgugaccgauaaagagaagccugugaacauugaaacagagccccccuucggcgaguccuauaucguugucggggccggagaaaaagcccugaagcucagcugguuuaagaaaggcucuagcauugggaagauguucgaggcuaccgccagaggcgcucgccggauggccauccugggagacacagcgugggauuuuggcuccauugggggaguguucaccucugugggcaaacuuguccaccagguguuugggacggccuacggaguucuguucagcggcguguccuggaccaugaagaucgggaucggcauucuccugacauggcugggacuuaauagcagaucuaccucccucagcaugacauguaucgcugucggcauggugacccuguaccuggggguuauggugcaggccgacucuggaugcgucauuaacuggaaaggccgcgaacucaaguguggguccggaaucuuugugacaaacgagguucauaccuggacggaacaguauaaguuccaagcugauagcccuaaacggcuguccgccgcgauuggcaaggccugggaggagggggugugcggcaucagaucugcuacacgccuugaaaauauuauguggaaacagaucagcaacgagcugaaucacauccuccuggaaaacgacaugaaguuuaccgucguggugggagacgccaauggcauucuggcucaggggaaaaagaugauccggccgcagcccauggagcacaaauacuccuggaagucuuggggaaaggccaaaauuaucggcgccgauauucaaaacaccacauucaucaucgacgggccugauacccccgaauguccugacgaucagagagcuuggaauauuugggaggucgaggacuauggauuuggcaucuucacgacaaacauuuggcuuaagcuccgcgauagcuacacccagaugugcgaccaucggcugauguccgcggccaucaaagauagcaaggcuguucacgccgacaugggcuauuggauugaaucugagaaaaaugaaacauggaagcuggccagagcuuccuuuaucgaggugaagaccuguacauggcccaaaagccauacccucuggucuaacggggugcuggaauccgagaugaucauuccgaagaucuacggaggcccuauuagccagcacaauuaucgccccggguacuucacgcaaaccgccggaccuuggcaccuuggcaaacuggagcucgauuucgaccugugcgaagggacaaccgucgugguugaugagcauugcggaaaccggggccccucucugagaacaaccacggugacaggcaagaucauucacgaaugguguugccggagcuguacccuuccuccccuccgcuuuagaggggaggacggaugcugguacggcauggagauccggccggucaaagaaaaggaggaaaaucuggugagauccaugguuagcgcggggucuggagagguggacuccuucagccugggcauccucugugucuccauuaugaucgaagaggugaugcgcucucgguggagcagaaagaugcugaugacagggacccuugcuguuuuucugcuccugauuaugggacagcugaccuggaacgaucuuauccgccugugcauuauggugggcgccaaugccuccgacagaaugggcauggggacaacguaucucgcucugauggccaccuucaaacuccggccuauguuugcggucggaauccuguuccgcagacuuacaucucgggaggugcugcuccugaccauuggccugagccuuguggcuuccgucgaacugcccaacucucucgaggaacugggggauggacucgccaugggcaucaugaugcugaagcuucugacagaguuucagccccaucaacucuggaccacgcugcugagccuuacauucaucaaaaccacccugucccucgacuacgccuggaagacaaccgcuauggcccugagcauuguuucucucuuuccuaucugucuguccacaacgagccagaaaaccacauggcuuccggugcugcuggggucuuucggaugcaagccccucaccauguaucugauuacagaaaacaagaucuggggccgcaaauccuggccuauuaaugagggcaucauggcuaucgggauugugagcauccuucugucuucccuccugaagaacgaugucccccucgccggaccucugauugcgggcgggaugcuuaucgccuguuacgugauuagcggauccagcgcugaccugucucuggagaaagccgcugaaguuagcugggagcaggaagccgagcacuccggcaccucucauaauauccucguggaaguccaggaugacgggacgaugagaaucaaggaugaggagaaagacgauacccugacaauucuucugaaggccacccuccuggcugugagcggaguuuaucccauguccaucccugcgacacucuuugugugguacuucuggcaaaaaaagaagcagcggucuggcguccugugggacacccccagcccgccugaaguggagcgcgccguccuugaugacggcauuuauagaauccugcagcgggggcugcucggacgcucccaggugggcguugggguguuucaagacggagucuuccacacaauguggcacgugacgagaggcgcuguucugauguaccaggggaaacggcuugaacccucuugggccagcgugaagaaagaucugauuuccuacggaggcggcuggagauuccaggggagcuggaacaccggagaggagguccaggugaucgccguggaaccuggcaagaaucccaaaaacguucaaacaaccccggggaccuuuaagacaccugagggagaagucggcgcuauugcccucgacuucaagcccgggacgucuggauccccuaucgugaaucgcgagggcaaaaucgugggccuguaugggaacggagucgugaccacaagcggcaccuacguuucugcgauugcucaggccaaggccucccaggaagggccccuccccgagaucgaggaugaaguguuuaaaaagcggaaucugacaauuauggaccuucauccuggaagcggcaaaaccagacgcuaucugccggcuaucguccgggaggccauuaagagaaagcugcgcacgcucauccuggcgcccacacgggugguugcuuccgaaauggccgaggcccuuaaagggaugccuaucagauaccaaaccaccgcugugaagucugaacacacaggccgcgagauugucgaucugaugugccaugccaccuucacaaugcggcuccugagccccgugagaguuccuaacuauaauaugaucauuauggacgaggcucacuuuaccgaucccgccuccaucgcggcccggggauacauuagcacgcgcgugggcaugggggaagcugccgcuaucuucaugacagccaccccuccgggaucugucgaggccuuuccccaguccaacgcugugauccaggacgaagagagagauauuccugaacggagcuggaauucuggcuaugacuggaucacagauuuccccgggaaaaccgugugguuugucccuagcauuaaguccggaaacgacaucgcgaauugucugcgcaaaaacggcaagagaguuauucagcucucucggaagacguucgacaccgaguaccaaaaaacaaagaacaaugauugggacuacguggugaccacagauaucagcgagaugggggccaacuuuagagcugaccgcgucauugauccccggagaugccuuaaaccggugauccugaaggacggcccugaacgcguuauccuggccggacccaugcccgugaccgucgccuccgcugcccagcggagaggccgcauugggcggaaucagaacaaagagggagaucaguauguguacaugggccaaccucucaauaacgacgaagaucaugcgcacuggacagaggcuaagaugcugcuugacaauaucaacacccccgaggggauuaucccugcccuguucgaaccggagagagaaaagucugccgcuauugauggagaguaucgccucagaggcgaagcccggaaaacguucguugagcugaugcgcagaggggaccugcccguguggcucagcuacaaggucgcguccgagggcuuucaguauagcgaucggcgcuggugcuucgacggagaaagaaauaaccaggugcuugaggaaaauauggacgucgagaucuggacaaaagaaggcgagcggaagaaacugagaccucgcuggcuggaugcccggaccuacucugacccccucgcucugagagaguuuaaggaauucgccgcugggcgccgguccgugagcggagaucuuauccuggagauuggcaaacucccucagcaccugacccugagagcccaaaacgcucucgacaaucuuguuaugcugcauaacuccgaacaggggggaaaggccuaucggcacgcgauggaggaacugcccgauacaaucgagacccucaugcugcuugcccugauugcugugcucacaggcggcgugaugcuguuuuuccugucugggaagggacucggcaaaacgagcaucgggcuucugugugucaccgccuccucugcucugcucuggauggccagcguugagccgcauuggauugccgcuuccaucauccuggaauuuuuccuuauggugcugcucauuccugagcccgaccgccagagaacaccucaggauaaucaacuggcguacguggucaucggacugcucuuuaugauucuuaccguggccgcuaacgaaaugggccugcuggagacaaccaagcgggaccucgggaucggacacguugccgccgagaaccaccagcaugcuacgaugcuggauguggaccuucgccccgccagcgcguggacccuguacgccgucgcuacaaccgugauuacaccuaugaugagacacaccaucgaaaauacgacagccaacauuucucucaccgcuaucgccaaucaggcggccauccugaugggccuggauaaaggcuggcccauuuccaagauggacaucggggucccgcuccuugcucugggaugcuauagccaagugaacccucugacacucaccgccgcuguucugaugcuuguggcccauuacgcuauuaucggccccgggcugcaggccaaagcgacccgggaggcccagaagcgcacagcugccggaauuaugaagaaucccacggucgauggcaucguggcuaucgaccucgacccuguuguguaugaugccaaauucgaaaagcagcuggggcaaauuaugcugcucauccuuuguaccucucagauucugcugaugagaacaaccugggcccucugcgaguccaucacacuggcgaccggaccgcuuacgacacugugggaaggcagccccggcaaauuuuggaacaccaccauugcugucucuauggccaauaucuuccgggggagcuaccucgcuggagccggccuggccuuuucccugaugaagucucucgggggaggccgcagagggacaggagcucagggcgagacccuuggcgagaaauggaagcggcagcugaaccaacugagcaagccugaauucaauacauauaaaagauccgggaucauggagguggaccgcagcgaagccaaggagggacucaaacggggcgaaacgaccaagcacgcgguguccagagggacagccaaacugcgcugguucguugagcggaaccuugucaagcccgagggaaaggugauugaucugggcugugggagaggaggcuggucuuacuauugcgcuggccucaaaaaggugaccgaagucaaaggguacacaaagggaggcccugggcaugaggaacccaucccuauggccaccuacggauggaaucugguuaaacugcacagcggcaaggacguguuuuucaugccgcccgagaaaugugauacgcuccuuugcgacauuggggaauccucuccuaaccccaccaucgaggagggacgcacacugcgggugcugaagauggucgaaccuuggcucagaggcaaucaguuuuguauuaagauccugaaccccuauaugccgagcgugguugagacccuugaacagaugcagcgcaaacacggcgggaugcuggugcggaauccucucuccagaaacucuacacaugagauguacugggucagcugcggaaccggcaauauuguguccgcuguuaacaugacaagccgcaugcugcugaaccgguucaccauggcccacagaaagcccacguaugagcgcgauguggaccucggggcgggaacaagacaugucaccguggaacccgagguggccaaucuggauaucaucggccaacggauugaaaacaucaaaaaugagcacaagucuaccuggcacuacgacgaagauaacccuuauaaaacaugggcuuaccauggguccuaugaggucaagcccagcggaucugccuccagcaugguuaauggcguggugcgccuucugacgaagccuugggacgucauuccgauggugacccagaucgcuaugacagacaccacacccuuuggccagcaaagaguuuucaaagagaagguggauacccggacaccuagagccaaacgggggaccacgcagauuauggaagucaccgcuaaguggcucuggggauuucugucucgcaacaaaaagcccagaaucuguacacgggaggaauucacccgcaaggugagauccaaugccgcgaucggcgccguuuuuguggacgagaaccaguggaauagcgcuaaagaagccgucgaggaugagcgguucugggaccuugugcaccgcgaaagagagcugcauaagcaggggaaaugcgcuacaugcguuuacaacaugaugggaaagcgggaaaaaaagcucggcgaguuugggaaggccaaaggcucccgcgccauuugguacauguggcugggagcgagauuccuggaauuugaggcucucggcuucaugaaugaggaucacugguucagccgggaaaacucucugagcgggguggagggagaaggccuucauaagcugggguauauccuccgcgacauuuccaaaaucccuggaggcaauauguacgccgaugacaccgccgggugggauacgagaauuacagaggacgaucugcaaaacgaggcuaagaucaccgacaucauggaacccgagcacgcccuucuggcuacaucuauuuuuaaacucaccuaucagaauaaggucgugcggguccagcgcccggccaaaaacggcacggugauggauguuaucagcagacgggaccagagaggauccggccaaguggggaccuacggacugaacacauucaccaauauggaaguccagcugauucgccagauggagucugaaggcaucuuucucccuagcgagcuggagacacccaaccuugcggaacgggugcuggacuggcucgagaagcacggggccgaaagacugaagcgcauggcuauuuccggagaugacugugugguuaaaccuaucgaugaccgguucgccaccgcucuuacagcccugaaugauaugggcaaggugagaaaagacaucccccagugggagccuucuaagggguggaacgauuggcaacagguccccuuuugcagccaucacuuccaucagcucauuaugaaagacggccgcgaaaucgugguuccgugucggaaucaggaugagcuggugggaagagcgcgcgucucccaaggcgccggguggagccugcgggagaccgcuugccucggaaagucuuaugcccagauguggcagcugauguacuuucacagacgcgaccuucggcuggcugccaacgcuauuuguuccgccgugccugucgauugggugcccacgagcagaacaaccuggucuauccacgcgcaucaccaauggaugaccacagaagacaugcucuccguuuggaaucggguguggauugaggaaaaccccuggauggaggacaagacccaugucagcuccugggaagaggugccuuaucugggcaaaagagaggaucaguggugcgggucucuuaucggacugacagcccgcgcuacgugggccaccaauauucagguugccaucaaccaggugcggagacucaucggcaaugaaaacuaccuggacuacaugacaagcaugaagcgcuucaaaaaugaguccgauccggaaggggcucugugguga

SEQ ID NO: 18700 - RNA, 9879 nt, Artificial Sequence
  derived and/or modified CDS sequence (opt5) from DENV-1__KF973459__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacacugaccuacaaaugcccgcaaaucacagaggcugaacccgacgauguggacuguuggugcaaugccaccgauacgugggugaccuauggaacauguucccagaccggcgagcaccgcagagacaagcggucugucgcccucgcuccucauguggggcugggacuugagacacgcaccgaaacguggaugagcuccgagggcgccuggaaacagauucagagaguugaaacaugggcucugcggcaccccggcuucaccgugaucgcccucuuucuggcgcaugccauugggacaucuaucacccaaaagggaaucauuuucauccuucugaugcucgucaccccuagcauggcuaugcgcugcgugggcauugggaacagagauuuuguugagggacuguccggcgccacauggguggacgucgugcuggagcacgggagcugugugacgaccauggcuaagaauaaacccacacucgauaucgaacugcuuaagaccgaggucacaaacccugccauucugcggaaacucugcaucgaagcgaagauuucuaauaccacgacagacucccgcuguccgacccagggagaggccacccugguugaagagcaggaugcuaacuucgugugcagacggacauuuguggaccgcggcuggggcaauggguguggacuuuucggcaaagggagccugcucaccugcgccaaguuuaagugcgucacaaaacuggagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcucacagacuacggcgcccugacccuugacuguagccccagaacaggccuggauuucaacgaaaugguucuccugaccaugaaggagaaaucuuggcuugugcauaagcaaugguuucuggaccucccucugcccuggacguccggggcuagcacaucccaggagaccuggaaucggcaggaucugcucgucacauucaaaaccgcgcacgccaagaagcaagaaguggucgugcugggaucucaggagggcgcuaugcacaccgcccuuacaggggccacggaaauccagaccagcggaacaaccacaauuuuugcuggccaucugaaaugccgccucaagauggacaaacugacccugaaggggacguccuauguuauguguacaggcagcuucaaacuugagaaggaaguggccgagacccagcacggaaccguccucgugcaaguuaaguacgagggcacagaugcgccgugcaaaaucccuuucucuacccaggacgaaaagggggugacacagaacggaagacugaucacggcuaaucccauugucaccgauaaagagaagccugugaacaucgaaacagagccccccuuuggcgaguccuauauugugguuggggccggagaaaaagcccugaagcucagcugguucaagaaaggcucuagcaucgggaagauguuugaggcuaccgcccggggcgcuagacgcauggccauucugggagacacagcgugggauuucggcuccaucgggggagucuuuaccucugugggcaaacuugugcaucaggucuucgggacggccuacggagugcuguuuagcggcguuuccuggaccaugaagaucgggauuggcauccuccugacauggcugggacuuaauagccggucuaccucccucagcaugacauguauugcugugggcauggucacccuguaccugggggugaugguucaagccgacucuggaugcgugaucaacuggaaaggcagagaacucaaguguggguccggaauuuucgucacaaacgaggugcacaccuggacggaacaguauaaguuucaggcugauagcccuaaacgccuguccgccgcgaucggcaaggccugggaggaggggguuugcggcauucggucugcuacaagacuugaaaauaucauguggaaacagaucagcaacgagcugaaucauauucuccuggaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcuuaagcucagagacagcuacacccaagucugcgaucaccgccugauguccgcggccauuaaagacagcaaggcuguucaugccgauaugggcuauuggaucgaaucugagaaaaacgaaacauggaagcuggcccgggcuuccuucaucgaggugaagaccuguacauggcccaaaagccacacccucuggucuaauggggugcuggaauccgagaugauuaucccgaagauuuacggaggcccuaucagccagcauaacuauagacccggguacuucacgcagaccgccggaccuuggcaccuuggcaaacuggagcucgacuuugaucugugcgaagggacaaccgucgugguugacgagcacugcggaaaucgcggccccucucugcggacaaccacggugacaggcaagauuauccaugaaugguguugcagaagcuguacccuuccuccccuccgguuccgcggggaggauggaugcugguacggcauggagaucagaccggucaaagaaaaggaggaaaaccuggugcgguccaugguuagcgcggggucuggagagguggacucccugagccucggcauucugugugcuuccaucaugauugaagaggucaugagaucucgcuggagccggaagaugcuuaugacagggacccuggccguguuucuccugcugaucaugggacaacuuaccuggaaugaccugauuagacucugcaucaugguuggcgccaacgcuuccgaucgcaugggcauggggacaacguaucuggcccucauggcgaccuucaaaaugagaccuauguuugcugugggacugcuuuuccggcgccugacaucuagagagguccuccugcugaccauuggccuuagccugguggccuccguggaacuccccaacucucuggaggaacucggggacggacuggccaugggcaucaugaugcuuaagcugcucacagaguuucagccccaccagcuguggaccacgcugcuuagccugacauucaucaaaaccacccucucccuggauuacgcuuggaagacaaccgccauggcucucagcauuaucucucuguuuccucuuugucuguccacaacgagccagaaaaccacauggcugccgguccuccuggggucuuucggaugcaagccccuuaccauguuucugauuacagaaaauaagaucuggggccggaaauccuggccucucaacgagggcauuauggccaucgggaucguuagcauucugcucucuucccugcuuaagaaugacgugccccuggcgggaccucugaucgccggcgggaugcucauugcuuguuaugugaucagcggauccagcgccgaucugucucuugagaaagcugccgaagucagcugggagcaagaagccgagcauuccggcaccucucacaacauucugguggaaguucaggacgaugggacgaugaagaucaaagacgaggagcgcgaugacacccucacaauccugcucaaggcuacccugcuugcggugagcggagucuaccccauguccauuccugccacacuguucgugugguauuuuuggcagaaaaagaagcagagaucuggcguucugugggauacccccagcccgccugaaguggagcgggcuguccucgacgauggcaucuaccgcauucugcaaagagggcuucugggacggucccaggugggcgucgggguguuccaggacggaguuuuccauacaauguggcacgugacgcgcggcgccguccucauguaucaggggaaaagacuggaacccucuugggccagcgugaagaaagaccucaucuccuacggaggcggcuggcgguuucaagggagcuggaauaccggagaggagguucaggugauugcugucgaaccuggcaagaaccccaaaaaugugcagacaaccccggggaccuucaagacaccugagggagaagugggcgccaucgcgcuggauuuuaagcccgggacgucuggauccccuauuguuaacagagagggcaaaaucgucggccuuuacgggaauggaguggugaccacaagcggcaccuaugucucugcuaucgcccaagccaaggugucccaggaagggccccugcccgagauugaggacgaaguuuucaaaaagcgcaaccugacaaucauggaucuccacccuggaagcggcaaaacccggagauaccugccggcuauugugcgcgaggccaucaagcggaagcuuagaacgcugauucucgcgcccacacgcgucguggcuuccgaaauggccgaggcccugaaagggaugccuauccgguaucagaccaccgcuguuaagucugaacauacaggcagagagaucguggaccugaugugccacgccaccuuuacaaugcgccuccuuagccccguccgggugccuaauuacaacaugauuaucauggaugaggcucauuucaccgaccccgccuccauugcggccagaggauauaucagcacgcggguuggcaugggggaagcugccgcuauuuuuaugacagccaccccuccgggaucuguggaggccuucccccaguccaaugcugucauccaagaugaagagcgcgacaucccugaaagaagcuggaacucuggcuacgauuggauuacagacuuucccgggaaaaccgugugguucgugccuagcaucaaguccggaaaugauauugcgaacugucugcggaaaaacggcaagcgcgucauccagcugucuagaaagacguuugacaccgaguaucagaaaacaaagaauaacgacugggauuacguugugaccacagacauuagcgagaugggggccaauuuccgggcugauagagugaucgacccccgccggugccucaaaccggucauucugaaggauggcccugaaagagugauccuugccggacccaugcccguuaccguggccuccgcugcccagcgccggggcagaaucgggcgcaaccaaaauaaagagggagaccaguacgucuauaugggccagccucugaacaaugaugaagaccacgcgcauuggacagaggcuaagaugcuccuggauaacauuaauacccccgaggggaucauuccugcccuguucgaaccggagcgggaaaagucugccgcuaucgacggagaguacagacuccgcggcgaagccagaaaaacguuuguggagcuuaugcggcgcggggaucugcccguuuggcugagcuauaagguggcguccgagggcuuccaguacagcgacagacgguggugcuuugauggagaacgcaacaaucaaguccucgaggaaaacauggacguggagauuuggacaaaagaaggcgagagaaagaaacugcggccuagauggcuugacgcccgcaccuauucugauccccuggcucuccgggaguucaaggaauuugccgcugggagacgcuccgucagcggagaccugauccuggagaucggcaaacucccucagcaccuuacccugcgggcccagaaugcucuggauaaccucgugaugcugcacaauuccgaacaggggggaaaggccuacagacaugcgauggaggaacuucccgacacaauugagacccugaugcuccuggcccugaucgcuguucucacaggcggcgugacgcuuuucuuucugucugggaagggacugggcaaaaccagcauugggcuccugugugugacagccuccucugcucuucuguggauggccagcgucgagccgcacuggaucgccgcuuccauuauccucgaauucuuucugaugguucugcucaucccugagcccgaucggcaacgcaccccucaggacaaccagcuugcguauguggugauuggacugcuguucaugauccucacagucgccgcuaacgaaaugggccugcuugagaccacgaagaaagaucuggggauuggacauguggccgccgagaaucaccaacacgcuaccaugcucgacguugaucugagacccgccagcgcguggacacuguacgccguggcuaccacagucaucaccccuaugaugcggcauacgauugaaaacacaaccgccaauaucucucucacagcuauugccaaccaggcggccauccuuaugggccuggacaagggcuggcccaucuccaaaauggauauuggggugccgcugcucgcucugggaugcuacagccaggucaauccucuuacccugaccgccgcugugcucaugcugguugcccacuaugcuaucauuggccccgggcugcaggccaaggcgacacgcgaggcccaaaagagaacggcugccggaaucaugaaaaaccccaccguggacggcauugucgcuaucgaucucgacccugugguuuacgacacaaaguuugaaaaacagcuugggcagaucaugcugcugauucucuguaccucucagauccugcuuaugcggacaaccugggcccugugcgaguccauuacgcucgccacaggaccgcugaccacccugugggaaggcagccccggcaaguucuggaauacaaccaucgcggugucuauggcuaacauuuuucgcgggagcuaucucgccggagcuggccuugccuucucccugaugaaaucucuggggggaggcagacgggggacaggagcccaaggcgagacgcucggcgagaaguggaagcgccagcugaaucagcuuagcaaauccgaauucaacaucuacaagagaagcgggaucauggaggucgaucgguccgaagcuaaagagggacugaagagaggcgaaaccacaaaacaugccgugucucgcgggaccgcgaagcuccggugguuuguggagagaaaucugguuaagccugagggaaaagucauugaccugggcugugggcgcggaggcuggagcuauuacugcgccggccucaagaaagugacagaagugaagggguauaccaaaggaggccccgggcacgaggaaccuauccccauggcuacguacggauggaaccuugucaagcugcauuccggcaaagauguuuucuuuaugccuccggagaagugugacacccugcucugcgauauuggggaaucuagccccaauccuacaaucgaggagggacggacccugagagugcuuaagaugguggaacccuggcugcgcggcaaccaguucuguauuaaaauccucaauccuuacaugcccuccgucguggagacacuggaacaaaugcagcggaaguauggcgggaugcugguuagaaacccgcucucucgcaauagcacccacgagauguacuggguguccugcggaacaggcaacauugucagcgccgugaacaugaccucucggaugcugcuuaauagauuuacgauggcucaccgcaaaccuacauaugagcgggacguugaucugggggccggaaccagacauguggcggucgaacccgagguggccaaccucgacaucaucggccagcgcauugaaaauaucaagaacgagcacaaauccaccuggcauuacgaugaagacaaucccuauaagacaugggcuuaccacgggagcuaugaggugaagccuucuggauccgccagcucuauggucaacggcguugugagacugcuuacgaaacccugggaugugauuccuauggucacccaaaucgcuaugacagacaccacaccguucggccagcagcggguguuuaaggagaaaguugacacccgcacacccagagccaagcgggggaccacgcagauuauggaagugaccgcuaaauggcuguggggauuccucuccagaaauaagaagccucggaucuguacacgcgaggaauuuaccagaaaaguccggagcaacgccgcgaucggcgccguguucguugaugagaaucaauggaacuccgcuaaggaagccguggaggacgagcgcuuuugggaucugguccacagagaacgggagcugcauaaacaggggaagugcgcuacaugcguguacaauaugaugggaaaacgcgaaaagaagcucggcgaguucgggaaagccaagggcagcagagccauuugguacauguggcugggagcgcgguuucuugaauucgaggcucugggcuucaugaacgaggaccacugguuuucucgcgaaaauagccucuccgggguugagggagaaggccugcauaaacuuggguauauccugagagauauuucuaagauccccggaggcaacauguacgccgacgauaccgccgggugggacacgcggauuacagaggaugaccuccagaaugaggcuaaaaucaccgauaucauggaaccugagcacgcccugcuggcuacaagcauuuucaagcucaccuaucagaacaaagugguccgcgugcaaagacccgccaagaacggcacggucauggacgugaucucccggcgcgaucagagaggaucuggccagguugggaccuacggacugaauacauuuaccaacauggaagugcagcuuauucggcaaauggagagcgaaggcaucuuccugccguccgagcucgagacaccuaaucuggcgaagagaguccuugacuggcuggaaaaacauggggccgagcgccucaagcggauggcuauuucuggagacgauuguguggugaaacccaucgacgauagauuugccaccgcucugacagcccugaacgacaugggcaagguucgcaaagauaucccucagugggaacccagcaagggguggaaugacuggcagcaggugccuuucugcucccaccacuuucaucaacucauuaugaaggauggccgggagaucgucgugcccuguagaaaccaggacgaacugguuggacgcgcgcgggugagccagggcgccggguggucucuuagagagaccgcuugccugggaaaauccuaugcccaaauguggcagcucauguacuuccaccgccgggaucugagacuugcugccaaugcuauuuguagcgccgucccgguggacugggucccuacgucucgcacaaccugguccauccaugcgcaccaccaguggaugaccacagaggauaugcugagcguguggaaccggguuuggauugaagagaaucccuggauggaagacaagacccauguguccucuugggaggaaguccccuaucucggcaaaagagaggaccaguggugcgggagccugaucggacugacagcccgggcuacgugggccaccaacauucaaguggccaucaaucagguuagacgccucaucggcaacgagaauuaccuggauuacaugacauccaugaagcgguuuaaaaacgaaagcgacccugagggggcucuuugguga

SEQ ID NO: 18701 - RNA, 9879 nt, Artificial Sequence
  derived and/or modified CDS sequence (opt5) from DENV-1__KF973460__SS-prME
agcgugaccaugcugcucaugcugcuucccacagcccuggcuuuccaccucacgaccagaggcggggagccucauaugaucgucuccaagcacgaacggggaaaaucucugcuuuuuaagacaagcaccggcguuaacaugugcacacugauugccauggaccucggggagcugugugaagauaccaugacauacaaaugcccgcgcaucaccgaggcggaacccgacgauguggacuguuggugcaaugcuacggauaccugggugacauauggaaccuguucccagacaggcgagcauagacgggacaagcgcucugucgcccuggccccucacguggggcucggacuggagaccagaacggaaacauggaugagcuccgagggcgcuuggaaacaaauucagcggguugaaaccugggcccuucgccaucccggcuucacagugaucgcucuguuucucgcccacgcgauugggaccucuaucacccagaagggaaucauuuucauccugcuuaugcuggucacaccuagcauggccaugagaugcgugggcauugggaaccgggauuuuguugagggacucuccggcgcuacguggguggacgucgugcuggagcacgggagcugugugaccacaauggccaagaauaaacccacccuggauaucgaacuccugaagacagaggucaccaacccugcuguucuucgcaaacugugcauugaagccaagaucucuaauacgacaaccgacuccagauguccgacccagggagaggcgacacucguggaagagcaagaugccaacuucgugugccggcgcacccuggucgacagaggcuggggcaauggguguggacuuuuuggcaaagggagccugcucacaugcgcuaaguucaagugcgugacgaaacuggagggaaagauuguucaguacgaaaaccugaaauauucugugaucgucaccgugcauacaggcgaucagcaccagguugggaaugagaccacagaacauggaaccaucgccacgauuaccccccaagcuccuacauccgagauccagcucaccgacuacggcgcccuggcccuugacuguagcccccggacaggccuggauuuuaacgaaauggugcuccugaccaugaaggagaaaucuuggcuuguccacaagcagugguuccuggaccucccucugcccuggacguccggggcuagcacaucccaggagaccuggaaucgccaagaucugcucgugacauuuaaaaccgcgcacgccaagaagcaggaagucgugguucugggaucucaggagggcgcuaugcauaccgcccuuacaggggccacggaaauucaaaccagcggaacaaccacaaucuucgcuggccaccugaaaugcagacucaagauggacaaacugacccugaaggggacguccuaugugauguguacaggcagcuuuaaacuugagaaggaagucgccgagacccagcauggaaccgugcucguucaggugaaguacgagggcacagaugcgccgugcaaaauuccuuucucuacccaggacgaaaagggggucacacaaaacggacggcugaucacggcuaaucccaucgugaccgauaaagagaagccugugaacauugaaacagagccccccuucggcgaguccuauaucguugucggggccggagaaaaagcccugaagcucagcugguuuaagaaaggcucuagcauugggaagauguucgaggcuaccgccagaggcgcucgccggauggccauccugggagacacagcgugggauuuuggcuccauugggggaguguucaccucugugggcaaacuuguccaccagguguuugggacggccuacggaguucuguucagcggcguguccuggaccaugaagaucgggaucggcauucuccugacauggcugggacuuaauagcagaucuaccucccucagcaugacauguaucgcugucggcauggugacccuguaccuggggguuauggugcaggccgacucuggaugcgucauuaacuggaaaggccgcgaacucaaguguggguccggaaucuuugugacaaacgagguucauaccuggacggaacaguauaaguuccaagcugauagcccuaaacggcuguccgccgcgauuggcaaggccugggaggagggggugugcggcaucagaucugcuacacgccuugaaaauauuauguggaaacagaucagcaacgagcugaaucacauccuccuggaaaacgacaugaaguuuaccgucguggugggagacgccaauggcauucuggcucaggggaaaaagaugauccggccgcagcccauggagcacaaauacuccuggaagucuuggggaaaggccaaaauuaucggcgccgauauucaaaacaccacauucaucaucgacgggccugauacccccgaauguccugacgaucagagagcuuggaauauuugggaggucgaggacuauggauuuggcaucuucacgacaaacauuuggcuuaagcuccgcgauagcuacacccagaugugcgaccaucggcugauguccgcggccaucaaagauagcaaggcuguucacgccgacaugggcuauuggauugaaucugagaaaaaugaaacauggaagcuggccagagcuuccuuuaucgaggugaagaccuguacauggcccaaaagccauacccucuggucuaacggggugcuggaauccgagaugaucauuccgaagaucuacggaggcccuauuagccagcacaauuaucgccccggguacuucacgcaaaccgccggaccuuggcaccuuggcaaacuggagcucgauuucgaccugugcgaagggacaaccgucgugguugaugagcauugcggaaaccggggccccucucugagaacaaccacggugacaggcaagaucauucacgaaugguguugccggagcuguacccuuccuccccuccgcuuuagaggggaggacggaugcugguacggcauggagauccggccggucaaagaaaaggaggaaaaucuggugagauccaugguuagcgcggggucuggagagguggacucccugagccucggcauccugugugucuccauuaugaucgaagaggugaugcgcucucgguggagcagaaagaugcuuaugacagggacccuggcuguuuuccuccugcugauuaugggacagcuuaccuggaacgaucugauccgccucugcauuauggugggcgccaaugccuccgacagaaugggcauggggacaacguaucuggcucucauggccaccuuuaaacugcggccuauguucgcggucggaauccuuuuucgcagacugacaucucgggaggugcuccugcugaccauuggccuuagccugguggcuuccgucgaacuccccaacucucuggaggaacucggggauggacuggccaugggcaucaugaugcuuaagcugcucacagaguuccagccccaucaacuguggaccacgcugcuuagccugacauuuaucaaaaccacccucucccuggacuacgccuggaagacaaccgcuauggcccucagcauuguuucucuguucccucuuugucuguccacaacgagccagaaaaccacauggcugccggugcuccuggggucuuuuggaugcaagccccuuaccauguauuucaucacagaaaacaagauuuggggccgcaaauccuggccuaucaaugagggcauuauggcuaucgggaucgugagcauucugcucucuucccugcucaagaacgaugucccccuggccggaccucuuaucgcgggcgggaugcugauugccuguuacgugaucagcggauccagcgcugaccugucucucgagaaagccgcugaaguuagcugggagcaggaagccgagcacuccggcaccucucauaauauucugguggaaguccaggaugacgggacgaugagaaucaaggaugaggagaaagacgauacccuuacaauccugcucaaggccacccugcucgcugugagcggaguuuaucccauguccauuccugcgacacuguuugugugguacuucuggcaaaaaaagaagcagcggucuggcguccuuugggacacccccagcccgccugaaguggagcgcgccguccuggaugacggcaucuauagaauucugcagcgggggcuccugggacgcucccaggugggcguugggguguuucaagacggagucuuccacacaauguggcacgugacgagaggcgcuguucuuauguaccaggggaaacggcuggaacccucuugggccagcgugaagaaagaucucaucuccuacggaggcggcuggagauuccaggggagcuggaacaccggagaggagguccaggugauugccguggaaccuggcaagaaucccaaaaacguucaaacaaccccggggaccuuuaagacaccugagggagaagucggcgcuaucgcccuggacuucaagcccgggacgucuggauccccuauugugaaucgcgagggcaaaaucgugggccucuaugggaacggagucgugaccacaagcggcaccuacguuucugcgaucgcucaggccaaggccucccaggaagggccccugcccgagauugaggaugaaguguuuaaaaagcggaaucuuacaaucauggaccugcauccuggaagcggcaaaaccagacgcuaucugccggcuauuguccgggaggccaucaagagaaagcuccgcacgcugauucuugcgcccacacgggugguugcuuccgaaauggccgaggcccugaaagggaugccuaucagauaccaaaccaccgcugugaagucugaacacacaggccgcgagaucgucgaucucaugugccaugccaccuucacaaugcggcugcugagccccgugagaguuccuaacuauaauaugauuaucauggacgaggcucacuuuaccgaucccgccuccauugcggcccggggauacaucagcacgcgcgugggcaugggggaagcugccgcuauuuucaugacagccaccccuccgggaucugucgaggccuuuccccaguccaacgcugugauccaggacgaagagagagauaucccugaacggagcuggaauucuggcuaugacuggauuacagauuuccccgggaaaaccgugugguuugucccuagcaucaaguccggaaacgacauugcgaauugucuccgcaaaaacggcaagagaguuauccagcuuucucggaagacguucgacaccgaguaccaaaaaacaaagaacaaugauugggacuacguggugaccacagauauuagcgagaugggggccaacuuuagagcugaccgcgucaucgauccccggagaugccugaaaccggugauucugaaggacggcccugaacgcguuauccucgccggacccaugcccgugaccgucgccuccgcugcccagcggagaggccgcaucgggcggaaucagaacaaagagggagaucaguauguguacaugggccaaccucugaauaacgacgaagaucaugcgcacuggacagaggcuaagaugcuucuggacaauauuaacacccccgaggggaucauuccugcccucuucgaaccggagagagaaaagucugccgcuaucgauggagaguaucgccugagaggcgaagcccggaaaacguucguugagcugaugcgcagaggggaccuccccguguggcuuagcuacaaggucgcguccgagggcuuucaguauagcgaucggcgcuggugcuucgacggagaaagaaauaaccaggugcuggaggaaaauauggacgucgagauuuggacaaaagaaggcgagcggaagaaacugagaccucgcuggcucgaugcccggaccuacucugacccccuggcucuuagagaguuuaaggaauucgccgcugggcgccgguccgugagcggagaucugauccucgagaucggcaaacugccucagcaccugacccucagagcccaaaacgcucuugacaaucugguuaugcugcauaacuccgaacaggggggaaaggccuaucggcacgcgauggaggaacuccccgauacaauugagacccugaugcuucuggcccucaucgcugugcugacaggcggcgugacgcuguuuuuccucucugggaagggacuuggcaaaaccagcauugggcugcugugugucacagccuccucugcucuccuguggauggccagcguugagccgcauuggaucgccgcuuccauuauccuugaauuuuuccugauggugcuccugaucccugagcccgaccgccagagaaccccucaggauaaucaacuggcguacguggucauuggacuccuuuuuaugauccugacaguggccgcuaacgaaaugggccugcucgagaccacgaagcgggaccuggggauuggacacguugccgccgagaaccaccagcaugcuaccaugcuugauguggaccugcgccccgccagcgcguggacacucuacgccgucgcuaccacagugaucaccccuaugaugagacacacgauugaaaauacaaccgccaacaucucucugacagcuauugccaaucaggcggccauccugaugggccucgauaaaggcuggcccaucuccaagauggacauuggggucccgcuucuggcucugggaugcuauagccaagugaacccucucacccugaccgccgcuguucuuaugcugguggcccauuacgcuaucauuggccccgggcuccaggccaaagcgacacgggaggcccagaagcgcacggcugccggaaucaugaagaaucccaccgucgauggcauuguggcuaucgaccuggacccuguuguguaugaugccaaauucgaaaagcagcuggggcaaaucaugcuccuuauucuguguaucucucagauucugcucaugagaacaaccugggcccugugcgaguccaucacacuugcgaccggaccgcugacgacacucugggaaggcagccccggcaaauuuuggaacaccaccauugcugucucuauggccaauaucuuccgggggagcuaccuggcuggagccggccuggccuuuucccucaugaagucucuugggggaggccgcagagggacaggagcucagggcgagacccugggcgagaaauggaagcggcagcugaaccaacucagcaagccugaauucaauacauauaaaagauccgggaucauggagguggaccgcagcgaagccaaggagggacugaaacggggcgaaacgaccaagcacgcgguguccagagggacagccaaacuucgcugguucguugagcggaaccuggucaagcccgagggaaaggugauugaucucggcugugggagaggaggcuggucuuacuauugcgcuggccugaaaaaggugaccgaagucaaaggguacacaaagggaggcccugggcaugaggaacccaucccuauggccaccuacggauggaaucugguuaaacuccacagcggcaaggacguguuuuucaugccgcccgagaaaugugauacgcuucugugcgacauuggggaauccucuccuaaccccaccaucgaggagggacgcacacugcgggugcucaagauggucgaaccuuggcugagaggcaaucaguuuuguauuaagauccuuaaccccuauaugccgagcgugguugagacccuggaacagaugcagcgcaaacacggcgggaugcucgugcggaauccucuguccagaaacucuacacaugagauguacugggucagcugcggaaccggcaauauuguguccgcuguuaacaugacaagccgcaugcugcucaaccgguucaccauggcccacagaaagcccacguaugagcgcgauguggaccugggggcgggaacaagacaugucgccguggaacccgagguggcuaaucuugauaucaucggccaacggauugaaaacaucaaaaaugagcacaagucuaccuggcacuacgacgaagauaacccuuauaaaaccugggccuaccauggguccuaugaggucaagcccagcggaucugcuuccagcaugguuaauggcguggugcgccugcucacaaagccuugggacgucauuccgauggugacgcagaucgccaugaccgacacaacccccuuuggccagcaaagaguuuucaaagagaagguggauacacggaccccuagagcuaaacgggggacaacccagauuauggaagucacggccaaguggcuguggggauuucuuucucgcaacaaaaagcccagaaucuguacccgggaggaauucacacgcaaggugagauccaaugcggccaucggcgcuguuuuuguggacgagaaccaguggaauagcgccaaagaagcugucgaggaugagcgguucugggaccuggugcaccgcgaaagagagcuccauaagcaggggaaaugcgccaccugcguuuacaacaugaugggaaagcgggaaaaaaagcugggcgaguuugggaaggccaaaggcucccgcgcgauuugguacauguggcugggagcuagauuccucgaauuugaggcccugggcuucaugaaugaggaucacugguucagccgggaaaacucucuuagcgggguggagggagaaggccugcauaagcucggguauauccugcgcgacauuuccaaaaucccuggaggcaauauguacgccgaugacacagcugggugggauaccagaauuacggaggacgaucuucaaaacgaggccaagaucacagacaucauggaacccgagcacgcucugcucgccaccucuauuuuuaaacugacauaucagaauaaggucgugcggguccagcgcccggcgaaaaacggcaccgugauggauguuaucagcagacgggaccagagaggauccggccaaguggggacguacggacugaacaccuucacaaauauggaaguccagcucauucgccagauggagucugaaggcaucuuucugccuagcgagcuugagacccccaaccuggccgaacgggugcucgacuggcuggagaagcacggggcugaaagacuuaagcgcauggccauuuccggagaugacugugugguuaaaccuaucgaugaccgguucgcuacagcccugaccgcgcucaaugauaugggcaaggugagaaaagacaucccccagugggagccuucuaagggguggaacgauuggcaacagguccccuuuugcagccaucacuuccaucagcugauuaugaaagacggccgcgaaaucgugguuccgugucggaaucaggaugagcuggugggaagagcccgcgucucccaaggcgcuggguggagccuccgggagacagccugccugggaaagucuuaugcucagauguggcagcuuauguacuuucacagacgcgaccugcggcucgccgcuaacgccauuuguuccgcggugccugucgauugggugcccaccagcagaacgacauggucuauccacgcccaucaccaauggaugaccaccgaagacaugcuguccguuuggaaucggguguggauugaggaaaaccccuggauggaggacaagacacaugucagcuccugggaagaggugccuuaucuuggcaaaagagaggaucaguggugcgggucucugaucggacucaccgcucgcgccacaugggccacgaauauucagguugcuaucaaccaggugcggagacugaucggcaaugaaagcuaccuggacuacaugaccuccaugaagcgcuucaaaaacgagagcgauccggaaggggcccucugguga

SEQ ID NO: 18702 - RNA, 9879 nt, Artificial Sequence
  derived and/or modified CDS sequence (opt5) from DENV-1__KF973461__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccauggggggagucuuuaccucugugggcaaacuggugcaucaggucuucgggacggccuacggagugcuuuuuagcggcguuuccuggaccaugaagaucgggaucggcauucugcucacauggcugggacugaauagccggucuaccucccuuagcaugacauguaucgcugugggcauggucacccucuaccugggggugaugguucaagccgacucuggaugcgugauuaacuggaaaggcagagaacugaaguguggguccggaaucuucgucacaaacgaggugcacaccuggacggaacaguauaaguuucaggcugauagcccuaaacgccucuccgccgcgauuggcaaggccugggaggaggggguuugcggcauccggucugcuacaagacuggaaaauauuauguggaaacagaucagcaacgagcuuaaucauauccugcucgaaaacgacaugaaguucaccguggucgugggagacgccaauggcauucuggcucaagggaaaaagaugauccgcccgcagcccauggagcacaaauacuccuggaagucuuggggaaaggccaaaauuaucggcgccgauauucagaacaccacauuuaucaucgacgggccugauacccccgaauguccugacaaucagcgggcuuggaacauuugggagguggaggauuauggauucggcaucuuuacgacaaauauuuggcugaagcuuagagacagcuacacccaaaugugcgaucaccgccucauguccgcggccaucaaagacagcaaggcuguccaugccgauaugggcuauuggauugaaucugagaaaaacgaaacauggaagcuggcccgggcuuccuucaucgagguuaagaccuguacauggcccaaaagccacacccuguggucuaauggggugcucgaauccgagaugaucauuccgaagaucuacggaggcccuauuagccagcauaacuauagacccggguacuucacgcagaccgccggaccuuggcaccugggcaaacuugagcuggacuuugaacucugcgaggggacaaccguggucguggaugaacacugcggaaaucgcggccccucucugcggacaaccacgguuacaggcaagaucauucaugagugguguugcagaagcuguacccugccuccccuucgguuccgcggggaggacggaugcugguacggcauggaaaucagaccggugaaagagaaggaagagaaccucguccgguccauggugagcgcggggucuggagaaguugauuccuuuagccugggcauccugugugcuuccauuaugaucgaggaggugaugagaucucgcuggagccggaagaugcucaugacagggacccuggccgucuuccuucugcucauuaugggacaacugaccuggaaugaccugaucagacuuugcauuauggugggcgccaacgcuuccgaccgcaugggcauggggacaacguaucuggcccucauggcgaccuuuaaaaugagaccuauguucgcuguuggacugcucuuucggcgccugacaucuagagaagugcuucugcucaccaucggccugagccuggucgccuccguggagcuucccaacucucuggaagagcucggggauggacuggccaugggcauuaugaugcucaagcugcuuacagaauuccagccccaccagcuguggaccacgcuccugagccugacauuuaucaaaaccacccuuucccuggacuacgcuuggaagaucacagccauggcucucagcauuaucucucuguucccucucugucuguccaccacaagccagaaaacgaccuggcuuccggugcugcuggggucuuuuggaugcaagccccucacaauguuccugauuaccgagaauaagaucuggggccggaaauccuggccucuuaacgagggcauuauggccaucgggaucgucagcauucugcucucuucccugcucaagaaugauguuccccuggcgggaccucuuaucgccggcgggaugcugauugcuuguuaugugaucagcggauccagcgccgaccugucucucgaaaaagcugccgaggugagcugggaacaagaggccgaacauuccggcacaucucacaacauucuggucgaggugcaggaugacgggaccaugaagaucaaagaugaggaacgcgacgauacgcuuaccauccugcucaaggcuacacugcucgcgguuagcggaguguaccccauguccauuccugccacccuguuugucugguauuucuggcagaaaaagaagcagagaucuggcgugcuuugggacacacccagcccgccugagguugaacgggcugugcuggaugacggcaucuaccgcauucugcaaagagggcuccugggacggucccaggucggcgugggggucuuccaggauggaguguuucauaccauguggcacguuacacgcggcgccgugcuuauguaucaggggaaaagacuggagcccucuugggccagcgucaagaaagaccucaucuccuacggaggcggcuggcgguuccaagggagcuggaauacgggagaggaagugcagguuauugcuguggagccuggcaagaaccccaaaaauguccagaccacaccggggaccuuuaagaccccugaaggagaggugggcgccaucgcgcuggacuucaagcccgggacaucuggauccccuauugugaacagagaaggcaaaaucguuggccucuacgggaauggagucgugacgaccagcggcacauaugugucugcuaucgcccaagccaaggcuucccaggaggggccccugcccgagauugaagaugaggucuuuaaaaagcgcaaccuuaccaucauggaccugcacccuggaagcggcaaaacacggagauaccugccggccauugugcgcgaagcgaucaagcggaagcucagaacccugauucuugcucccacgcgcguuguggccuccgagauggccgaagcucugaaagggaugccuauccgguaucagacaaccgccgucaagucugagcauaccggcagagagaucguggaucucaugugccacgcuacauucaccaugcgccugcugagccccguucgggugccuaauuacaacaugauuaucauggacgaagcccauuuuacagaucccgcguccauugccgcuagaggauauaucagcacccgggucggcaugggggaggccgcugccauuuucaugacggccacaccuccgggaucuguggaagcuuuuccccaguccaaugcgguuauccaagacgaggaacgcgauaucccugagagaagcuggaacucuggcuacgacuggauuaccgauuuccccgggaaaacagugugguuugucccuagcaucaaguccggaaaugacauugccaacugucuccggaaaaacggcaagcgcgugauccagcuuucuagaaagaccuucgauacggaguaucagaaaaccaagaauaacgacugggacuacguggucacaaccgauauuagcgaaaugggggcuaauuuccgggccgacagaguuaucgauccccgccggugccugaaaccggugauucugaaggacggcccugagagagugauccucgccggacccaugcccgucacaguggcuuccgccgcgcagcgccggggcagaaucgggcgcaaccaaaauaaagaaggagaucaguacguuuauaugggccagccucugaacaaugacgaggaucacgcucauuggaccgaggccaagaugcuucuggacaacauuaauacacccgaagggaucauuccugcccucuuugagccggaacgggagaagucugcugccaucgauggagaauacagacugcgcggcgaggcgagaaaaaccuucguggagcugaugcggcgcggggaccuccccgucuggcuuagcuauaagguggccuccgaaggcuuucaguacagcgauagacgguggugcuucgacggagagcgcaacaaucaaguucuggaagagaacauggauguggaaauuuggacgaaagagggcgagagaaagaaacugcggccuagauggcucgacgcucgcacauauucugacccccuggcccuucgggaauuuaaggaguucgcugccgggagacgcuccgucagcggagaucugauccucgaaaucggcaaacugccucagcaccugacccuccgggcucagaaugcccuugacaaccuggugaugcugcacaauuccgagcaggggggaaaggcguacagacaugccauggaagagcuccccgauaccauugagacacugaugcuucuggcucucaucgccguccugaccggcggcgugacacuguuuuuccucucugggaagggacuuggcaaaacgagcauugggcugcuguguguuaccgcuuccucugcccuccuguggauggccagcguggaaccgcacuggaucgcugcguccauuauccuugaguuuuuccugauggugcuccugaucccugaacccgaccggcaacgcacaccucaggauaaccagcuggccuaugucguuauuggacuccuuuuuaugauccugaccguggcugccaacgagaugggccugcucgagacaaccaagaaagaccuggggauuggacauguggccgcugaaaaucaccaacacgccacgaugcuugaugucgaccugagacccgcgagcgccuggacccucuacgcuguggccacaaccguuaucacaccuaugaugcggcauaccauugagaacacgacagcuaauaucucucugaccgccauugcgaaccaggccgcuauccugaugggccucgauaagggcuggcccaucuccaaaauggacauuggggugccgcuucuggcccugggaugcuacagccaggucaauccucucacacugaccgcugccgugcuuaugcuggucgcucacuaugccaucauuggccccgggcuccaggcgaaggccacccgcgaagcucaaaagagaacagccgcuggaaucaugaaaaaccccacgguggauggcauuguugccaucgaccuggauccuguggucuacgacaccaaguucgagaaacagcuggggcagaucaugcuccuuauucuguguacaucucagauccugcucaugcggaccacaugggcccugugcgaauccauuacccuugcgacgggaccgcugacaacccucugggagggcagccccggcaaguuuuggaauaccacaaucgcugugucuauggccaacauuuuccgcgggagcuaucuggcuggagccggccuggccuucucccucaugaaaucucuugggggaggcagacgggggaccggagcucaaggcgagacacugggcgaaaaguggaagcgccagcugaaucagcucagcaaauccgaguuuaacaucuacaagagaagcgggaucauggaaguugaccgguccgaggccaaagaaggacugaagagaggcgagacgaccaaacaugcggugucucgcgggacagccaagcuucggugguucgucgagagaaaucuggugaagccugaaggaaaagugauugaucucggcugugggcgcggaggcuggagcuauuacugcgcuggccugaagaaaguuaccgaggucaagggguauacaaaaggaggccccgggcacgaagagccuauccccauggccaccuacggauggaaccuggugaagcuccauuccggcaaagacguguuuuucaugccuccggaaaagugugauacgcuucugugcgacauuggggagucuagccccaauccuaccaucgaggaaggacggacacugagaguccucaagaugguugagcccuggcugcgcggcaaccaguuuuguauuaaaauccuuaauccuuacaugcccuccgugguggaaacccuggagcaaaugcagcggaaguauggcgggaugcucgucagaaacccgcugucucgcaauagcacacacgagauguacuggguguccugcggaaccggcaacauuguuagcgcugugaacaugacaucucggaugcugcucaauagauucaccauggcccaccgcaaaccuacguaugaacgggaugucgaccugggggcgggaacaagacauguggccguugagcccgaaguggcuaaccuugauaucaucggccagcgcauugagaauaucaagaacgaacacaaauccaccuggcauuacgacgaggauaaucccuauaagaccugggccuaccacgggagcuaugaggucaagccuucuggauccgcuagcucuauggugaacggcguggucagacugcucacaaaacccugggacguuauuccuauggugacgcaaaucgccaugaccgauacaaccccguuuggccagcagcggguguucaaggaaaaagucgacacacgcacccccagagcuaagcgggggacaacccagauuauggaggugacggccaaauggcuguggggauuucuuuccagaaauaagaagccucggaucuguacccgcgaagaguucacaagaaaaguucggagcaacgcggccaucggcgcuguguuugucgacgaaaaucaauggaacuccgccaaggaggcuguggaggaugaacgcuucugggaccugguuagacgggagcgcgaacuccacaaacaggggaagugcgccaccugcguguacaauaugaugggaaaaagagagaagaagcugggcgaauuugggaaagccaagggcagccgggcgauuugguacauguggcugggagcucgcuuccucgaguucgaggcccugggcuuuaugaacgaagaucauugguucucuagagagaauagccuuuccggggucgaaggagagggccugcacaaacucggguauauccugcgggacauuucuaagauccccggaggcaacauguacgccgaugacacagcugggugggauacccgcauuacggaggacgaucuucagaaugaagccaaaaucacagacaucauggagccugaacaugcucugcucgccaccagcauuuuuaagcugacauaucagaacaaagugguuagagugcaacggcccgcgaagaacggcaccgucauggaugugaucucccgcagagaccagcggggaucuggccaggucgggacguacggacugaauaccuucacaaacauggaggugcagcucauuagacaaauggaaagcgagggcaucuuucugccguccgagcuugaaaccccuaaucuggccgagcgcguucucgauuggcuggaaaagcacggggcugagcggcuuaaaagaauggccauuucuggagacgacuguguggucaagcccaucgaugaccgcuucgcuacagcccugaccgcgcucaacgauaugggcaaagugcggaaggacaucccucagugggaacccagcaaaggguggaaugauuggcagcaggugccuuuuugcucccaucacuuccaccaacugauuaugaaggacggcagagagaucguugugcccugucgcaaccaggaugagcuggucggacgggccagagugagccagggcgcuggguggucucuccgcgaaacagccugccugggaaaguccuaugcucaaauguggcagcuuauguacuuucaucggagagaccugcgccucgccgcuaaugccauuuguagcgcgguuccgguggauugggucccuaccucucggacgacaugguccauccacgcccaucaccaguggaugaccaccgaggacaugcugagcguguggaacagagucuggauugaagagaaucccuggauggaagauaaaacacacguguccucuugggaggagguucccuaucuuggcaagcgggaagaccaguggugcgggagccugaucggacucaccgcuagagccacaugggccacgaacauucaaguggcuaucaaucagguccgccggcugaucggcaacgagaauuaccuggacuacaugaccuccaugaaaagauucaagaacgaaagcgauccugagggggcccucugguga

SEQ ID NO: 18703 - RNA, 9879 nt, Artificial Sequence
  derived and/or modified CDS sequence (opt5) from DENV-1__KF973462__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacacugaccuacaaaugcccgcaaaucauugaggcugaacccgacgauguggacuguuggugcaaugccacagauaccugggugacguauggaaccuguucccagacaggcgagcaccgcagagacaagcggucugucgcccucgcuccucauguggggcugggacuugagacccgcacagaaaccuggaugagcuccgagggcgccuggaaacagauccagagaguugaaacgugggcucugcggcaccccggcuucacagugauugcccucuuucuggcgcaugccaucgggaccucuaucacacaaaagggaauuaucuucauucuucugaugcucgucaccccuagcauggcuaugcgcugcgugggcaucgggaacagagauuuuguugagggacuguccggcgccaccuggguggacgucgugcuggagcacgggagcugugugacaacgauggcuaagaauaaacccacccucgauauugaacugcuuaagacagaggucaccaacccugccauccugcggaaacucugcauugaagcgaagaucucuaauacaaccacggacucccgcuguccgacacagggagaggccacccugguugaagagcaggaugcuaacuucgugugcagacggaccuuuguggaccgcggcuggggcaauggguguggacuuuucggcaaagggagccugcucacaugcgccaaguuuaagugcgucaccaaacuggagggaaagaucgugcaguacgaaaaccugaaauauucuguuauugugacaguccacacgggcgaucaacaucagguggggaaugagaccacagaacacggaaccaucgcuacaauuaccccccaggccccuacguccgagauccagcucaccgacuacggcgcccugacacuugacuguagccccagaaccggccuggauuucaacgaaaugguucuccugacaaugaaggagaaaucuuggcuugugcauaagcaaugguuucuggaccucccucugcccuggaccuccggggcuagcacgucccaggagacauggaaucggcaggaucugcucgucaccuucaaaacagcgcacgccaagaagcaagaaguggucgugcugggaucucaggagggcgcuaugcacaccgcccuuaccggggccacagaaauucagacgagcggaaccacaaccaucuuugcuggccaucugaaaugccgccucaagauggacaaacugacacugaaggggaccuccuauguuauguguacgggcagcuucaaacuugagaaggaaauggccgagacacagcacggaaccgugcucguccaagugaaguacgagggcaccgaugcgccgugcaaaaucccuuucucuacacaggacgaaaaggggguuacccagaacggaagacugauuacagcuaaucccaucgugacggauaaagagaagccugucaacauugaaaccgagccccccuuuggcgaguccuauaucguggugggggccggagaaaaagcccugaagcucagcugguucaagaaaggcucuagcauugggaagauguuugaggcuacagcccggggcgcuagacgcauggccauccugggagacaccgcgugggauuucggcuccaucgggggaguuuuuacaucugucggcaaacuugugcaucagguguucgggaccgccuacggaguccuguuuagcggcguguccuggacgaugaagauugggaucggcauucuccugaccuggcugggacuuaauagccggucuacaucccucagcaugaccuguaucgcuguuggcauggugacacuguaccugggggucauggugcaagccgacucuggaugcguuauuaacuggaaaggcagagaacucaaguguggguccggaaucuucgugaccaacgagguccacacauggaccgaacaguauaaguuucaggcugauagcccuaaacgccuguccgccgcgauuggcaaggccugggaggagggggugugcggcauccggucugcuacgagacuugaaaauaucauguggaaacagauuagcaacgagcugaaucauauccuccuggaaaacgacaugaaguucacaguuguggucggagacgccaauggcauucuggcucaagggaaaaagaugauccgcccgcagcccauggagcacaaauacuccuggaagucuuggggaaaggccaaaauuaucggcgccgauauccagaacaccaccuuuauuaucgacgggccugauacacccgaauguccugacaaucagcgggcuuggaacauuugggagguggaggauuauggauucggcaucuuuaccacgaauauuuggcuuaagcucagagacagcuacacacaagugugcgaucaccgccugauguccgcggccaucaaagacagcaaggcuguccaugccgauaugggcuauuggaucgaaucugagaaaaacgaaaccuggaagcuggcccgggcuuccuucauugagguuaagacauguaccuggcccaaaagccacacacucuggucuaauggggugcuggaauccgagaugaucauuccgaagaucuacggaggcccuauuagccagcauaacuauagacccggguacuucacccagacggccggaccuuggcaccuuggcaaacuggagcucgacuuugaucugugcgaagggaccacaguggucguggacgagcacugcggaaaucgcggccccucucugcggaccacaaccguuacgggcaagaucauccaugaaugguguugcagaagcuguacacuuccuccccuccgguuccgcggggaggauggaugcugguacggcauggagauuagaccggugaaagaaaaggaggaaaaccugguccgguccauggugagcgcggggucuggagagguugacuccuuuagccugggcauccucugugcuuccauuaugaucgaagaggugaugagaucucgcuggagccggaagaugcugaugaccgggacacuugccgucuuccugcuccugauuaugggacaacugaccuggaaugaccuuaucagacugugcauuauggugggcgccaacgcuuccgaucgcaugggcauggggaccacauaucucgcccugauggcgacguuuaaaaugagaccuauguucgcuguuggacuccuguuucggcgccuuaccucuagagaggugcugcuccugacaaucggccugagccuugucgccuccguggaacugcccaacucucucgaggaacugggggacggacucgccaugggcaucaugaugcugaagcuucugaccgaguuccagccccaccagcucuggacaacccugcugagccuuacguuuauuaaaacaacccugucccucgauuacgcuuggaagaccacagccauggcucugagcaucauuucucucuucccucugugucuuuccaccacaagccagaaaacgaccuggcugccggugcugcucgggucuuuuggaugcaagccccugacaauguuccuuaucaccgaaaauaagauuuggggccggaaauccuggccucugaacgagggcaucauggccaucgggauugucagcauccuccugucuucccuccugaagaaugacguuccccuugcgggaccucugauugccggcgggaugcugaucgcuuguuaugugauuagcggauccagcgccgaucucucucuggagaaagcugccgaagugagcugggagcaagaagccgagcauuccggcacaucucacaacauccuugucgaagugcaggacgaugggaccaugaagaucaaagacgaggagcgcgaugacacgcugaccauucuccugaaggcuacacuccuggcgguuagcggaguguaccccauguccaucccugccacccuuuuugucugguauuucuggcagaaaaagaagcagagaucuggcgugcugugggauacacccagcccgccugaaguugagcgggcugugcuggacgauggcauuuaccgcauccuccaaagagggcugcuuggacggucccaggucggcgugggggucuuccaggacggaguguuucauaccauguggcacguuacacgcggcgccgugcugauguaucaggggaaaagacucgaacccucuugggccagcgucaagaaagaccugauuuccuacggaggcggcuggcgguuccaagggagcuggaauacgggagaggaggugcagguuaucgcuguggaaccuggcaagaaccccaaaaauguccagaccacaccggggaccuuuaagaccccugagggagaagugggcgccauugcgcucgauuucaagcccgggacaucuggauccccuaucgugaacagagagggcaaaaucguuggccuguacgggaauggagucgugacgaccagcggcacauaugugucugcuauugcccaagccaaggucucccaggaagggccccuucccgagaucgaggacgaaguguuuaaaaagcgcaaccugaccauuauggaucugcacccuggaagcggcaaaacacggagauaccucccggcuaucguucgcgaggccauuaagcggaagcugagaacccuuauccuggcgcccacgcgcguggucgcuuccgaaauggccgaggcccucaaagggaugccuauccgguaucagacaaccgcugugaagucugaacauaccggcagagagauuguugaccugaugugccacgccacauucaccaugcgccugcucagccccgugcgggucccuaauuacaacaugaucauuauggaugaggcucauuuuacagaccccgccuccaucgcggccagaggauauauuagcacccgggugggcaugggggaagcugccgcuaucuucaugacggccacaccuccgggaucuguugaggccuuuccccaguccaaugcugugauccaagaugaagagcgcgacauuccugaaagaagcuggaacucuggcuacgauuggaucaccgacuuccccgggaaaacagucugguuugugccuagcauuaaguccggaaaugauaucgcgaacugucuucggaaaaacggcaagcgcgugauucagcugucuagaaagaccuucgacacggaguaucagaaaaccaagaauaacgacugggauuacgucguuacaaccgacaucagcgagaugggggccaauuuccgggcugauagagugauugacccccgccggugccugaaaccggugauccucaaggauggcccugaaagagucauccuggccggacccaugcccgugacaguugccuccgcugcccagcgccggggcagaauugggcgcaaccaaaauaaagagggagaccaguacguguauaugggccagccucuuaacaaugaugaagaccacgcgcauuggaccgaggcuaagaugcugcucgauaacaucaauacacccgaggggauuaucccugcccuguuugaaccggagcgggaaaagucugccgcuauugacggagaguacagacugcgcggcgaagccagaaaaaccuucgucgagcucaugcggcgcggggaucuucccguguggcugagcuauaagguugcguccgagggcuuucaguacagcgacagacgguggugcuucgauggagaacgcaacaaucaagugcuggaggaaaacauggacgucgagaucuggacgaaagaaggcgagagaaagaaacuccggccuagauggcuggacgcccgcacauauucugauccccuugcucugcgggaguuuaaggaauucgccgcugggagacgcuccgugagcggagaccucauccuggagauuggcaaacugccucagcaccucacccuucgggcccagaaugcucuggauaaccuggucaugcuccacaauuccgaacaggggggaaaggccuacagacaugcgauggaggaacugcccgacaccaucgagacacuuaugcugcucgcccugauugcugugcugaccggcggcguuacacucuuuuuccuuucugggaagggacugggcaaaacgagcaucgggcugcucugugugaccgccuccucugcucugcuuuggauggccagcguggagccgcacuggauugccgcuuccaucauccuggaauuuuuccucaugguccugcugauuccugagcccgaucggcaacgcacaccucaggacaaccagcucgcguauguugugaucggacuucuguuuaugauucugaccguggccgcuaacgaaaugggccuccuggagacaaccaagaaagaucuugggaucggacaugucgccgccgagaaucaccaacacgcuacgaugcuggacguggaucucagacccgccagcgcguggacccuguacgccguugcuacaaccgugauuacaccuaugaugcggcauaccaucgaaaacacgacagccaauauuucucugaccgcuaucgccaaccaggcggccauccucaugggccuugacaagggcuggcccauuuccaaaauggauaucggggucccgcugcuggcucucggaugcuacagccaggugaauccucugacacuuaccgccgcuguccugaugcucguggcccacuaugcuauuaucggccccgggcugcaggccaaggcgacccgcgaggcccaaaagagaacagcugccggaauuaugaaaaaccccacgguugacggcaucguggcuaucgaucuggacccugucguguacgacaccaaguucgaaaaacagcucgggcagauuaugcuucugauccuguguacaucucagauucuccugaugcggaccacaugggcccuuugcgaguccaucacccuggccacgggaccgcucacaacccugugggaaggcagccccggcaaguuuuggaauaccacaauugcgguuucuauggcuaacaucuuccgcgggagcuaucuggccggagcuggccucgccuucucccuuaugaaaucucuggggggaggcagacgggggaccggagcccaaggcgagacacugggcgagaaguggaagcgccagcucaaucagcugagcaaauccgaauuuaacaucuacaagagaagcgggauuauggagguggaucgguccgaagcuaaagagggacuuaagagaggcgaaacgaccaaacaugccgucucucgcgggacagcgaagcugcggugguucguggagagaaaucucgugaagccugagggaaaaguuaucgaccugggcugugggcgcggaggcuggagcuauuacugcgccggccugaagaaagucaccgaagugaagggguauacaaaaggaggccccgggcacgaggaaccuauucccauggcuaccuacggauggaaccucgugcggcuucauuccggcaaggaugucuuuuucaugccuccggagaaaugugacacgcugcugugcgauaucggggaaucuagccccaauccuaccauugaggagggaagaacacuccgcguucugaagaugguggaacccuggcuucggggcaaccaguuuuguaucaagauucugaauccuuacaugcccuccguggucgagacccucgaacaaaugcagagaaaauauggcgggaugcuggugcgcaacccgcugucucggaauagcacacacgagauguacuggguuuccugcggaaccggcaacaucgugagcgccgucaacaugacaucuagaaugcuccugaaucgcuucaccauggcucaccggaagccuacguaugagagagacguggaucuuggggccggaacacgccauguugcgguggaacccgaggucgccaaccuggacaucauuggccagagaaucgaaaauauuaaaaacgagcacaaguccaccuggcauuacgaugaagacaaucccuauaaaaccugggcuuaccacgggagcuaugaggugaagccuucuggauccgccagcucuauggugaacggcgucguucggcuccugacaaagcccugggaugugaucccuauggugacgcaaauugcuaugaccgacacaaccccguuuggccagcagcgcgucuucaaagagaagguggacacaagaaccccccgggccaaaagagggacaacccagaucauggaaguuacggcuaaguggcuuuggggauuucugucccggaauaaaaagccucgcaucuguaccagagaggaauucacacggaaggugcgcagcaacgccgcgauuggcgccgucuuuguggaugagaaucaauggaacuccgcuaaagaagccguugaggacgagagauucugggaucucgugcaccgggaacgcgagcugcauaagcaggggaaaugcgcuaccugcgucuacaauaugaugggaaagagagaaaaaaagcugggcgaguuugggaaggccaaaggcagccgggccaucugguacauguggcucggagcgcgcuuccuggaauucgaggcucuuggcuuuaugaacgaggaccacugguucucuagagaaaauagccuguccgggguggagggagaaggccuccauaagcugggguauauucuucgggauaucucuaaaauucccggaggcaacauguacgccgacgauacagccgggugggacacccgcaucacggaggaugaccugcagaaugaggcuaagaucacagauauuauggaaccugagcacgcccuccuggcuaccagcaucuuuaaacugacauaucagaacaagguugugagaguccaacggcccgccaaaaacggcaccgugauggacgucauuucccgcagagaucagcggggaucuggccagguggggacguacggacucaauaccuucacaaacauggaaguucagcugaucagacaaauggagagcgaaggcauuuuucuuccguccgagcuggagaccccuaaucucgcgaagcgcgugcuggacuggcuugaaaagcauggggccgagcggcugaaaagaauggcuaucucuggagacgauugugucgugaagcccaucgacgaucgcuucgccacagcucucaccgcccugaacgacaugggcaaaauucggaaggauaucccucagugggaacccagcaaaggguggaaugacuggcagcaggugccuuuuugcucccaccacuuccaucaacugauuaugaaggauggcagagagaucguugugcccugucgcaaccaggacgaacucgucggacgggcgagagugagccagggcgccggguggucucugcgcgagacagcuugccuuggaaaguccuaugcccaaauguggcagcugauguacuuucaccggagagaucuccgccuggcugccaaugcuauuuguagcgccguuccgguggacugggucccuaccucucggacgacaugguccauccaugcgcaccaccaguggaugaccaccgaggauaugcuuagcguguggaacagagucuggauugaagagaaucccuggauggaagacaaaacacauguguccucuugggaggaaguucccuaucugggcaagcgggaggaccaguggugcgggagccucaucggacugaccgccagagcuacaugggccacgaacauccaaguggccauuaaucagguccgccggcugaucggcaacgagaauuaccucgauuacaugaccuccaugaaaagauucaagaacgaaagcgacccugagggggcucugugguga

SEQ ID NO: 18704 - RNA, 9879 nt, Artificial Sequence
  derived and/or modified CDS sequence (opt5) from DENV-1__KF973463__SS-prME
uccgugaccaugcugcugaugcugaugcccaccgcccuugcuuuccaccugacgacccggggcggggaaccucauaugaucgucuccaagcacgaacggggaaaagcccugcuguuuaagaccucuaccggcguuaauaugugcacacuuauugcgauggaccugggggagcucugugaagauaccaugacauacaaaugcccccgcaucaccgaggcugaacccgacgauguggacuguuggugcaaugccacggauaccugggugacauauggaaccuguagccagacaggcgagcauagacgggacaagcgcuccgucgcccuggcuccucacguggggcugggacucgagaccagaacggaaacauggaugucuagcgagggcgccuggaaacaaauucagcggguugaaaccugggcucugcgccaucccggcuucacagugaucgcccuuuuucuggcgcacgccauugggaccuccaucacccagaagggaaucauuuucauccuccugaugcuugucacaccuucuauggcuaugagaugcgugggcauugggaaccgggauuuuguugagggacugagcggcgccacguggguggacgucgugcucgagcacggguccugugugaccacaauggcuaagaauaaacccacccuggauaucgaacugcucaagacagaggucaccaacccugccguucugcgcaaacuuugcauugaagcgaagaucagcaauacgacaaccgacucuagauguccgacccagggagaggccacacugguggaagaacaagaugcuaacuucgugugccggcgcaccuuugucgacagaggcuggggcaauggguguggacucuucggcaaagggucccugcuuacaugcgccaaguuuaagugcgugacgaaacuggagggaaagauuguucaguacgaaaaccucaaauauagcgugaucgucaccgugcauacaggcgaucagcaccagguugggaaugagaccacagaacauggaaccaucgcuacgauuacaccccaagccccuacaucugagauccagcugaccgacuacggcgcccugacacucgacuguagcccccggaccggccuggauuucaacgaaauggugcuucugacgaugaaggagaaaagcuggcucguccacaagcagugguuucuggaccuuccucugcccuggacaucuggggcuuccaccagccaggagacauggaaucgccaagaucuccuggugaccuucaaaaccgcgcacgccaagaagcaggaagucgugguucugggaucccaggagggcgcuaugcauacagcccucacgggggccaccgaaauucaaacaucuggaaccacaaccaucuuugcuggccaccugaaaugcagacuuaagauggacaaacugacgcucaaggggacaagcuaugugauguguaccggcuccuucaaacuggagaaggaagucgccgagacccagcauggaacagugcugguucaggugaaguacgagggcaccgaugcgccgugcaaaauuccuuucagcacacaggacgaaaagggggucacgcaaaacggacggcuuaucaccgcuaaucccaucgugacagauaaagagaagccugugaacauugaaaccgagccgcccuuuggcgagucuuauaucguugucggggccggagaaaaagcccucaagcuguccugguucaagaaaggcagcucuauugggaagauguuugaggcuacagccagaggcgcucgccggauggccauccugggagacaccgcgugggauuucggcagcauugggggaguguuuacguccgugggcaaacucguccaccagguguucgggaccgccuacggaguucuguuuucuggcgugagcuggacaaugaagaucgggaucggcauucuucugaccuggcucggacucaauuccagaagcacaucucuguccaugaccuguaucgcugucggcauggugacacuuuaccucgggguuauggugcaggccgacagcggaugcgucauuaacuggaaaggccgcgaacugaagugugggucuggaaucuucgugaccaacgagguucauacguggacagaacaguauaaguuucaagcugauuccccuaaacggcugagcgccgcgauuggcaaggccugggaggagggggugugcggcaucagauccgcuacccgccucgaaaauauuauguggaaacagaucucuaacgagcugaaucacauccuucuggaaaacgacaugaaguucaccgucguggugggagacgccaauggcauucucgcucaggggaaaaagaugauccggccgcagcccauggagcacaaauacagcuggaaguccuggggaaaggccaaaauuaucggcgccgauauucaaaacacaaccuuuaucaucgacgggccugauacgcccgaauguccugacgaucagagagcuuggaauauuugggaggucgaggacuauggauucggcaucuuuacaaccaacauuuggcugaagcugcgcgauucuuacacacagaugugcgaccaucggcuuaugagcgcggccaucaaagauuccaaggcuguucacgccgacaugggcuauuggauugaaagcgagaaaaaugaaaccuggaagcucgccagagcuucuuucaucgaggugaagacauguaccuggcccaaaucccauacgcuguggagcaacggggugcuggaaucugagaugaucauuccgaagaucuacggaggcccuauuucccagcacaauuaucgccccggguacuucacccaaacagccggaccuuggcaccucggcaaacuggagcuugauuuugaccugugcgaagggaccacagucgugguugaugagcauugcggaaaccggggccccagccucagaaccacgacagugaccggcaagaucauucacgaaugguguugccggucuuguacacugccuccccugcgcuucagaggggaggacggaugcugguacggcauggagauccggccggucaaagaaaaggaggaaaaucuugugagaagcaugguuuccgcggggagcggagagguggacucuuuuucccucggcauccugugugucagcauuaugaucgaagaggugaugcgcucccgguggucuagaaagaugcugaugaccgggacccucgcuguuuuccugcuucugauuaugggacagcucacauggaacgaucugauccgccugugcauuauggugggcgccaaugccagcgacaaaaugggcauggggacgaccuaucuugcucugauggccacauuuaagaugagaccuauguucgcggucggaauccucuuucggcgccugaccuccagagaggugcuccugcuuacaauuggccugucucucguggcuagcgucgaacugcccaacucccuggaggaacuuggggauggacuggccaugggcaucaugaugcucaaacugcucaccgaguuccagccccaucaacuguggacgacacuucugucucucaccuuuaucaagaccacacugagccuggacuacgccuggaaaaccacagcuauggcccuuuccauuguuagccuguucccucucugucugucuacgaccucccagaagacaaccuggcucccggugcugcuugggagcuuuggaugcaagccccugacaauguuccugaucaccgaaaacaaaauuuggggccggaagucuuggccuaucaaugagggcauuauggcuaucgggaucguguccauucuccugagcucucuucugaaaaacgaugucccccucgccggaccucugaucgcgggcgggaugcucauugccuguuaugugaucuccggaagcuccgcugaccugagccuugagaaggccgcugaaguuucuugggagcaggaagccgagcacagcggcacgucccauaauauucugguggaaguccaggaugacgggaccaugcgcaucaaagaugaggagaaggacgauacacugaccauccuccugaaagccacacuucuggcugugucuggaguuuaccccaugagcauuccugcgacccucuuugugugguauuucuggcaaaagaagaaacagagauccggcguccugugggacacacccucuccgccugaaguggagcgggccguccucgaugacggcaucuaccgcauucugcagagagggcuucugggacggagccaggugggcguugggguguuccaagacggagucuuucacacgauguggcacgugacccgcggcgcuguucugauguaucaggggaagagacucgaacccuccugggccucugugaaaaaggaucugaucagcuacggaggcggcuggcgguuccagggguccuggaacacaggagaggagguccaggugauugccguggaaccuggcaaaaaucccaagaacguucaaaccaccccggggacauuuaagacgagcgagggagaagucggcgcuaucgcccuugacuucaaaccugggaccucuggaucccccauugugaauagagagggcaagaucgugggccuguacgggaacggagucgugacaaccagcggcacauauguuucugcgaucgcucaggccaaaaccucccaggaagggccucuccccgagauugaggaugaaguguuuaagaaacgcaaucugacgaucauggaccuccaucccggaagcggcaagacacggagauaccugccugccauuguccgcgaggcuaucaagaagaaacuucggacccugauucuggccccgaccagagugguugcguccgaaauggcugaggcccucaaagggaugcccauccgcuaucaaacaaccgccgugaaaucugaacacacaggccgggagaucgucgaucugaugugccaugcuaccuucacgaugagacuucugagcccugugcgcguucccaacuacaauaugauuaucauggacgaggcccacuuuacagauccugcuuccauugccgcgcggggauauaucagcaccagagugggcaugggggaagccgcugccauuuucaugacagcuacacccccuggaucugucgaggccuuuccgcaguccaacgccgugauccaggacgaagaacgggauauccccgaacgcagcuggaacucuggcuacgacuggauuacggauuucccugggaaaaccgugugguuuguccccagcaucaaguccggaaacgacauugcuaauugucucagaaagaacggcaaacggguuauccagcugucucgcaagacauucgacaccgaguaucagaagaccaagaacaaugauugggacuacguggugaccacagauauuagcgagaugggggcgaacuucagagccgaccgggucaucgauccuagacgcugccugaaacccgugauucucaaggacggcccggaacggguuauccuugcuggaccuaugcccgugaccgucgccuccgccgcucagagacgcggccggaucgggagaaaucagaacaaggagggagaucaguacguguauaugggccaaccccugaauaacgacgaagaucaugcccacuggacggaggcgaaaaugcugcucgacaauauuaacacaccugaggggaucauucccgcucuguuugaaccugagcgcgaaaagucugccgccaucgauggagaguaccggcuuagaggcgaagcucgcaaaaccuucguugagcugaugagaagaggggaccucccgguguggcugagcuauaaggucgccuccgagggcuuucaguacagcgaucgcagauggugcuucgacggagaacggaauaaccaggugcuggaggaaaauauggacgucgagauuuggaccaaagaaggcgagcgcaagaaacucagaccccgguggcuugaugcgagaacauauucugacccucuggcccugcgcgaguuuaaggaguucgcugccgggcggagauccgugagcggagaucucauccuggagaucggcaaacuuccccagcaccugacccuccgcgcucaaaacgcccuggacaaucugguuaugcuccauaacuccgaacaagggggaaaggcuuaccggcacgccauggaggaacuuccugauacaauugagacgcugaugcugcucgcgcugaucgccgugcuuaccggcggcgugacacuguuuuuccucucugggaagggacugggcaaaaccagcauugggcugcucugugucacagcuuccucugcccuucuguggauggcuagcguugagccccauuggaucgccgccuccauuauccuggaauuuuuccucauggugcugcuuaucccggagccugacagacagcggacaccccaggauaaucaacuggcuuauguggucauuggacuccuguuuaugauccugacgguggcggccaacgaaaugggccuccuugagaccacaaagcgcgaccuggggauuggacacguugcugccgagaaccaccagcaugccaccaugcuggauguggaccucagaccugcuagcgccuggacacuguacgcggucgccaccacggugaucacacccaugaugcggcacaccauugaaaauacaaccgcuaacaucucucuuaccgccauugcuaaucaggccgcgauccugaugggccucgauaaaggcuggccuaucuccaagauggacauuggggucccccugcuggcccucggaugcuacagccaagugaacccgcuuacacugacggcugccguucugaugcucguggcucauuaugccaucauuggcccugggcugcaggcuaaggccacccgcgaggcgcagaaaagaacagccgcuggaaucaugaagaaucccaccgucgauggcauuguggccaucgaccuugaccccguuguguacgaugcuaaauucgaaaagcagcuggggcaaaucaugcuccugauucuguguacaucucagauccuccuuaugcggaccacgugggcccugugcgaguccauuacacuggccaccggaccucucaccacacugugggaaggcagcccgggcaaauuuuggaacaccacaaucgcggucucuauggcuaauauuuuccgcgggagcuaucuugccggagcuggccuggccuucucccucaugaagucucucgggggaggcagacgggggacgggagcccagggcgagacccugggcgagaaguggaaacgccagcucaaccaacuuagcaagcccgaauuuaauacauacaaaagauccgggaucauggagguggaccggagcgaagcuaaggagggacugaaaagaggcgaaaccacaaagcacgccgugucccgcgggaccgcgaagcugcggugguucguugagagaaaccucgucaaaccugagggaaaggugaucgaucugggcugugggcgcggaggcuggucuuauuacugcgccggccuuaaaaaggugacggaagucaaaggguauaccaagggaggccccgggcaugaggaaccuauucccauggcuacauacggauggaaucugguuaaacuccacagcggcaaggacguguuuuucaugccuccggagaagugugauacccugcugugcgacaucggggaauccucucccaacccuacaauugaggagggacggacccucagagugcuuaaaauggucgaacccuggcugcgcggcaaucaguuuuguaucaagauucugaacccuuacaugcccagcgugguugagacacucgaacagaugcagcggaaacacggcgggaugcuggugagaaauccgcuuucccgcaacucuacccaugagauguauugggucagcugcggaacgggcaauaucguguccgccguuaacaugacaagccggaugcugcucaacagauucaccauggcucaccgcaagccuaccuacgagcgggauguggaccugggggccggaacaagacaugucgcgguggaacccgagguggccaaucuggauauuaucggccaacgcaucgaaaacauuaaaaaugagcacaagucuacguggcacuaugacgaagauaaccccuacaagaccugggcuuaucauggguccuacgaggucaaaccuagcggaucugccuccagcaugguuaauggcguggugagacuccugacaaagcccugggacgucaucccuauggugacccagauugcuaugacagacaccacaccguuuggccagcaacggguuuucaaagagaagguggauacccgcacgcccagagccaaacgggggaccacacagaucauggaagucaccgcuaaguggcuuuggggauuucugucuagaaacaagaaaccucggauuuguacacgcgaggaguucaccagaaaggugcgguccaaugccgcgaucggcgccguuuuuguggacgagaaccaguggaauagcgcuaaagaagccgucgaggaugagcgcuucugggaccucgugcacagagaacgggagcugcauaagcaggggaaaugcgcuacgugcguuuauaacaugaugggaaagcgcgaaaagaaacuuggcgaguuugggaaggccaaaggcuccagagccaucugguacauguggcugggagcgcgguuccucgaguucgaggcucugggcuuuaugaaugaggaucacugguucagccgcgaaaacucucugagcgggguggagggagaaggccuccauaagcugggguacauucuuagagacaucuccaaaauucccggaggcaauauguaugccgaugacacagccgggugggauacccggaucacagaggacgaucugcaaaacgaggcuaagauuaccgacaucauggaaccugagcacgcccuccuggcuacgucuaucuuuaaacuuaccuaccagaauaaggucgugcgcguccagagacccgccaagaacggcacagugauggauguuauuagccggcgcgaccagagaggauccggccaaguggggaccuauggacugaacacauucaccaauauggaaguccagcucauccggcagauggagucugaaggcauuuuucugccgagcgagcuggagacaccuaaccucgcggaaagagugcuggacuggcuugagaaacacggggccgaacgccugaagcggauggcuaucuccggagaugacugugugguuaaacccauugaugacagauucgccaccgcucucacggcccugaaugauaugggcaaggugcgcaaagacaucccucagugggagcccucuaagggguggaacgauuggcaacaggucccuuuuugcagccaucacuuccaucagcuuaucaugaaggacggccgggaaauugugguucccuguagaaaucaggaugagcuggugggacgcgcgcgggucucccaaggcgccggguggagccucagagagacagcuugccugggaaaaucuuacgcccagauguggcagcugauguauuuucaccgccgggaccucagacuggcugccaacgcuaucuguuccgccgugccggucgauugggugccuaccagccgcaccacauggucuauucacgcgcaucaccaauggaugaccacagaagacaugcuuuccguuuggaaucggguguggaucgaggaaaaccccuggauggaggacaagacgcaugucagcuccugggaagaggugcccuaccugggcaaaagagaggaucaguggugcgggucucucauuggacugaccgcccgggcuacaugggccaccaauauccagguugccauuaaccaggugagacgccuuaucggcaaugaaaacuaucuggacuacaugacaagcaugaagcgguucaaaaaugaguccgauccugaaggggcucucugguga

SEQ ID NO: 18705 - RNA, 9879 nt, Artificial Sequence
  derived and/or modified CDS sequence (opt5) from DENV-1__KF973464__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaagcuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggacccuggccgucuuccuucugcucaucaugggacaacugaccuggaaugaccugauuagacuuugcaucauggugggcgccaacgcuuccgaucgcaugggcauggggacaacguaucuggcccucauggcgaccuuuaaaaugagaccuauguucgcuguuggacugcucuuucggcgccugacaucuagagaggugcuucugcucaccauuggccugagccuggucgccuccguggaacuucccaacucucuggaggaacucggggacggacuggccaugggcaucaugaugcucaagcugcuuacagaguuccagccccaccagcuguggaccacgcuccugagccugacauuuaucaaaaccacccuuucccuggauuacgcuuggaagacaaccgccauggcucucagcauuaucucucuguucccucucugucuguccacaacgagccagaaaaccacauggcuuccggugcugcuggggucuuuuggaugcaagccccucaccauguuccugauuacagaaaauaagaucuggggccggaaauccuggccucuuaacgagggcauuauggccaucgggaucgucagcauucugcucucuucccugcucaagaaugacguuccccuggcgggaccucuuaucgccggcgggaugcugauugcuuguuaugugaucagcggauccagcgccgaucugucucucgagaaagcugccgaagugagcugggagcaagaagccgagcauuccggcaccucucacaacauucuggucgaagugcaggacgaugggacgaugaagaucaaagacgaggagcgcgaugacacccuuacaauccugcucaaggcuacccugcucgcgguuagcggaguguaccccauguccauuccugccacacuguuugucugguauuucuggcagaaaaagaagcagagaucuggcgugcuuugggauacccccagcccgccugaaguugagcgggcugugcuggacgauggcaucuaccgcauucugcaaagagggcuccugggacggucccaggucggcgugggggucuuccaggacggaguguuucauacaauguggcacguuacgcgcggcgccgugcuuauguaucaggggaaaagacuggaacccucuugggccagcgucaagaaagaccucaucuccuacggaggcggcuggcgguuccaagggagcuggaauaccggagaggaggugcagguuauugcuguggaaccuggcaagaaccccaaaaauguccagacaaccccggggaucuuuaagaccccugagggagaagugggcgccauugcgcuggauuucaagcccgggacaucuggauccccuaucgugaacagagagggcaaaaucguuggccucuacgggaauggagucgugacgaccagcggcacauaugugucugcuauugcccaagccaaggcuucccaggaagggccccugcccgagaucgaggacgaagucuuuaaaaagcgcaaccuuaccauuauggaucugcacccuggaagcggcaaaacacggagauaccugccggccauggugcgcgaggcgaucaagcggaagcucagaacccugauucuugcucccacgcgcguuguggccuccgaaauggccgaggcucugaaagggaugccuauccgguaucagacaaccgccgucaagucugaacauaccggcagagagaucguggaccucaugugccacgcuacauucaccaugcgccugcugagccccguucgggugccuaauuacaacaugauuaucauggaugaggcccauuuuacagaccccgcguccauugccgcuagaggauauaucagcacccgggucggcaugggggaagccgcugccauuuucaugacggccacaccuccgggaucuguggaggcuuuuccccaguccaaugcgguuauccaagaugaagagcgcgacaucccugaaagaagcuggaacucuggcuacgauuggauuaccgacuuccccgggaaaacagugugguuugucccuagcaucaaguccggaaaugauauugccaacugucuccggaaaaacggcaagcgcgugauccagcuuucuagaaagaccuucgacacggaguaucagaaaaccaagaauaacgacugggauuacguggucacaaccgacauuagcgagaugggggcuaauuuccgggccgauagaguuaucgacccccgccggugccugaaaccggugauucugaaggauggcccugaaagagugauccucgccggacccaugcccgucacaguggcuuccgccgcgcagcgccggggcagaaucgggcgcaaccaaaauaaagagggagaccaguacguuuauaugggccagccucugaacaaugaugaagaccacgcucauuggaccgaggccaagaugcuucuggauaacauuaauacacccgaggggaucauuccugcccucuuugaaccggagcgggaaaagucugcugccaucgacggagaguacagacugcgcggcgaagcgagaaaaaccuucguggagcugaugcggcgcggggaucuccccgucuggcuuagcuauaagguggccuccgagggcuuucaguacagcgacagacgguggugcuucgauggagaacgcaacaaucaaguucuggaggaaaacauggacguggagauuuggacgaaagaaggcgagagaaagaaacugcggccuagauggcucgacgcucgcacauauucugauccccuggcccuucgggaguuuaaggaauucgcugccgggagacgcuccgucagcggagaccugauccucgagaucggcaaacugccucagcaccugacccuccgggcucagaaugcccuugauaaccuggugaugcugcacaauuccgaacaggggggaaaggcguacagacaugccauggaggaacuccccgacaccauugagacacugaugcuucuggcucucaucgccguccugaccggcggcgugacacuguuuuuccucucugggaagggacuuggcaaaacgagcauugggcugcuguguguuaccgcuuccucugcccuccuguggauggccagcguggagccgcacuggaucgcugcguccauuauccuugaauuuuuccugauggugcuccugaucccugagcccgaucggcaacgcacaccucaggacaaccagcuggccuaugucguuauuggacuccuuuuuaugauccugaccguggcugccaacgaaaugggccugcucgagacaaccaagaaagaucuggggauuggacauguggccgcugagaaucaccaacacgccacgaugcuugacgucgaucugagacccgcgagcgccuggacccucuacgcuguggccacaaccguuaucacaccuaugaugcggcauaccauugaaaacacgacagcuaauaucucucugaccgccauugcgaaccaggccgcuauccugaugggccucgacaagggcuggcccaucuccaaaauggauauuggggugccgcuucuggcccugggaugcuacagccaggucaauccucucacacugaccgcugccgugcuuaugcuggucgcucacuaugccaucauuggccccgggcuccaggcgaaggccacccgcgaggcucaaaagagaacagccgcuggaaucaugaaaaaccccacgguggacggcauuguugccaucgaucuggacccuguggucuacgacaccaaguucgaaaaacagcuggggcagaucaugcuccuuauucuguguacaucucagauccugcucaugcggaccacaugggcccugugcgaguccauuacccuugcgacgggaccgcugacaacccucugggaaggcagccccggcaaguuuuggaauaccacaaucgcugugucuauggccaacauuuuccgcgggagcuaucuggcuggagccggccuggccuucucccucaugaaaucucuugggggaggcagacgggggaccggagcucaaggcgagacacugggcgagaaguggaagcgccagcugaaucagcucagcaaauccgaauuuaacaucuacaagagaagcgggaucauggagguugaucgguccgaagccaaagagggacugaagagaggcgaaacgaccaaacaugcggugucucgcgggacagccaagcuucggugguucgucgagagaaaucuggugaagccugagggaaaagugauugaccucggcugugggcgcggaggcuggagcuauuacugcgcuggccugaagaaaguuaccgaagucaagggguauacaaaaggaggccccgggcacgaggaaccuauccccauggccaccuacggauggaaccuggugaagcuccauuccggcaaagauguguuuuucaugccuccggagaagugugacacgcuucugugcgauauuggggaaucuagccccaauccuaccaucgaggagggacggacacugagaguccucaagaugguugaacccuggcugcgcggcaaccaguuuuguauuaaaauccuuaauccuuacaugcccuccgugguggagacccuggaacaaaugcagcggaaguauggcgggaugcucgucagaaacccgcugucucgcaauagcacacacgagauguacuggguguccugcggaaccggcaacauuguuagcgcugugaacaugacaucucggaugcugcucaauagauucaccauggcccaccgcaaaccuacguaugagcgggacgucgaucugggggcgggaacaagacauguggccguugaacccgagguggcuaaccuugacaucaucggccagcgcauugaaaauaucaagaacgagcacaaauccaccuggcauuacgaugaagacaaucccuauaagaccugggccuaccacgggagcuaugaggucaagccuucuggauccgcuagcucuauggugaacggcguggucagacugcucacaaaacccugggauguuauuccuauggugacgcaaaucgccaugaccgacacaaccccguuuggccagcagcggguguucaaggagaaagucgacacacgcacccccagagcuaagcgggggacaacccagauuauggaagugacggccaaauggcuguggggauuucuuuccagaaauaagaagccucggaucuguacccgcgaggaauucacaagaaaaguucggagcaacgcggccaucggcgcuguguuugucgaugagaaucaauggaacuccgccaaggaagcuguggaggacgagcgcuucugggaucugguucacagagaacgggagcuccauaaacaggggaagugcgccaccugcguguacaauaugaugggaaaacgcgaaaagaagcugggcgaguuugggaaagccaagggcagcagagcgauuugguacauguggcugggagcucgguuccucgaauucgaggcccugggcuuuaugaacgaggaccacugguucucucgcgaaaauagccuuuccggggucgagggagaaggccugcauaaacucggguauauccugagagauauuucuaagauccccggaggcaacauguacgccgacgauacagcugggugggacacccggauuacggaggaugaccuucagaaugaggccaaaaucacagauaucauggaaccugagcacgcucugcucgccaccagcauuuuuaagcugacauaucagaacaaagugguucgcgugcaaagacccgcgaagaacggcaccgucauggacgugaucucccggcgcgaucagagaggaucuggccaggucgggacguacggacugaauaccuucacaaacauggaagugcagcucauucggcaaauggagagcgaaggcaucuuucugccguccgagcuugagaccccuaaucuggccgaaagaguucucgacuggcuggagaagcauggggcugaacgccuuaaacggauggccauuucuggagacgauuguguggucaagcccaucgacgauagauucgcuacagcccugaccgcgcucaacgacaugggcaaagugcgcaaggauaucccucagugggagcccagcaaaggguggaaugacuggcagcaggugccuuuuugcucccaccacuuccaucaacugauuaugaaggauggccgggaaaucguugugcccuguagaaaccaggacgagcuggucggacgcgcccgggugagccagggcgcuggguggucucucagagagacagccugccugggaaaguccuaugcucaaauguggcagcuuauguacuuucaccgccgggaucugagacucgccgcuaaugccauuuguagcgcgguuccgguggacugggucccuaccucucgcacgacaugguccauccaugcccaccaccaguggaugaccaccgaagauaugcugagcguguggaaccgggucuggauugaggaaaaucccuggauggaggacaaaacacauguguccucuugggaagagguucccuaucuuggcaagagagaggaccaguggugcgggagccugaucggacucaccgcucgggccacaugggccacgaacauucaaguggcuaucaaucaggucagacgccugaucggcaacgaaaauuaccuggauuacaugaccuccaugaaacgguucaagaacgagagcgacccugaaggggcccucugguga

SEQ ID NO: 18706 - RNA, 9879 nt, Artificial Sequence
  derived and/or modified CDS sequence (opt5) from DENV-1__KF973465__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcaaaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcucuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagagcaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccccccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccauggggggagucuuuaccucugugggcaaacuggugcaucaggucuucgggacggccuacggagugcuuuuuagcggcguuuccuggaccaugaagaucgggaucggcauucugcucacauggcugggacugaauagccggucuaccucccuuagcaugacauguaucgcugugggcauggucacccucuaccugggggugaugguucaagccgacucuggaugcgugauuaacuggaaaggcagagaacugaaguguggguccggaaucuucgucacaaacgaggugcacaccuggacggaacaguauaaguuucaggcugauagcccuaaacgccucuccgccgcgauuggcaaggccugggaggaggggguuugcggcauccggucugcuacaagacuggaaaauauuauguggaaacagaucagcaacgagcuuaaucauauccugcucgaaaacgacaugaaguucaccguggucgugggagacgccaauggcauucuggcucaagggaaaaagaugauccgcccgcagcccauggagcacaaauacuccuggaagucuuggggaaaggccaaaauuaucggcgccgauauucagaacaccacauuuaucaucgacgggccugauacccccgaauguccugacaaucagcgggcuuggaacauuugggagguggaggauuauggauucggcaucuuuacgacaaauauuuggcugaagcuuagagacagcuacacccaaaugugcgaucaccgccucauguccgcggccaucaaagacagcaaggcuguccaugccgauaugggcuauuggauugaaucugagaaaaacgaaacauggaagcuggcccgggcuuccuucaucgagguuaagaccuguacauggcccaaaagccacacccuguggucuaauggggugcucgaauccgagaugaucauuccgaagaucuacggaggcccuauuagccagcauaacuauagacccggguacuucacgcagaccgccggaccuuggcaccugggcaaacuugagcuggacuuugaacucugcgaggggacaaccguggucguggaugaacacugcggaaaucgcggccccucucugcggacaaccacgguuacaggcaagaucauucaugagugguguugcagaagcuguacccugccuccccuucgguuccgcggggaggacggaugcugguacggcauggaaaucagaccggugaaagagaaggaagagaaccucguccgguccauggugagcgcggggucuggagaaguugauuccuuuagccugggcauccugugugcuuccauuaugaucgaggaggugaugagaucucgcuggagccggaagaugcucaugacagggacccuggccgucuuccuucugcucauuaugggacaacugaccuggaaugaccugaucagacuuugcauuauggugggcgccaacgcuuccgaccgcaugggcauggggacaacguaucuggcccucauggcgaccuuuaaaaugagaccuauguucgcuguuggacugcucuuucggcgccugacaucuagagaagugcuucugcucaccaucggccugagccuggucgccuccguggagcuucccaacucucuggaagagcucggggauggacuggccaugggcauuaugaugcucaagcugcuuacagaauuccagccccaccagcuguggaccacgcuccugagccugacauuuaucaaaaccacccuuucccuggacuacgcuuggaagacaaccgccauggcucucagcaucauuucucuguucccucucugucuguccacaacgagccagaaaaccacauggcuuccggugcugcuggggucuuuuggaugcaagccccucaccauguuccugaucacagagaauaagauuuggggccggaaauccuggccucuuaacgagggcaucauggccauugggaucgucagcauccugcucucuucccugcucaagaaugauguuccccuggcgggaccucuuauugccggcgggaugcugaucgcuuguuaugugauuagcggauccagcgccgaccugucucucgaaaaagcugccgaggugagcugggaacaagaggccgaacauuccggcaccucucacaacauccuggucgaggugcaggaugacgggacgaugaagauuaaagaugaggaacgcgacgauacccuuacaauccugcucaaggcuacccugcucgcgguuagcggaguguaccccauguccaucccugccacacuguuugucugguauuucuggcagaaaaagaagcagagaucuggcgugcuuugggacacccccagcccgccugagguugaacgggcugugcuggaugacggcauuuaccgcauccugcaaagagggcuccugggacggucccaggucggcgugggggucuuccaggauggaguguuucauacaauguggcacguuacgcgcggcgccgugcuuauguaucaggggaaaagacuggagcccucuugggccagcgucaagaaagaccucauuuccuacggaggcggcuggcgguuccaagggagcuggaauaccggagaggaagugcagguuaucgcuguggagccuggcaagaaccccaaaaauguccagacaaccccggggaccuuuaagacaccugaaggagaggugggcgccauugcgcuggacuucaagcccgggacgucuggauccccuaucgugaacagagaaggcaaaauuguuggccucuacgggaauggagucgugaccacaagcggcaccuaugugucugcuaucgcccaagccaaggcuucccaggaggggccccugcccgagaucgaagaugaggucuuuaaaaagcgcaaccuuacaauuauggaccugcacccuggaagcggcaaaacccggagauaccugccggccaucgugcgcgaagcgauuaagcggaagcucagaacgcugauccuugcucccacacgcguuguggccuccgagauggccgaagcucugaaagggaugccuauucgguaucagaccaccgccgucaagucugagcauacaggcagagagaucguggaucucaugugccacgcuaccuucacaaugcgccugcugagccccguucgggugccuaauuacaacaugaucauuauggacgaagcccauuuuaccgaucccgcguccaucgccgcuagaggauauauuagcacgcgggucggcaugggggaggccgcugccaucuucaugacagccaccccuccgggaucuguggaagcuuuuccccaguccaaugcgguuauucaagacgaggaacgcgauaucccugagagaagcuggaacucuggcuacgacuggaucacagauuuccccgggaaaaccgugugguuugucccuagcauuaaguccggaaaugacaucgccaacugucuccggaaaaacggcaagcgcgugauucagcuuucuagaaagacguucgauaccgaguaucagaaaacaaagaauaacgacugggacuacguggucaccacagauaucagcgaaaugggggcuaauuuccgggccgacagaguuauugauccccgccggugccugaaaccggugauccugaaggacggcccugagagagugauucucgccggacccaugcccgucaccguggcuuccgccgcgcagcgccggggcagaaucgggcgcaaccaaaauaaagaaggagaucaguacguuuauaugggccagccucugaacaaugacgaggaucacgcucauuggacagaggccaagaugcuucuggacaacaucaauacccccgaagggauuaucccugcccucuuugagccggaacgggagaagucugcugccauugauggagaauacagacugcgcggcgaggcgagaaaaacguucguggagcugaugcggcgcggggaccuccccgucuggcuuagcuauaagguggccuccgaaggcuuucaguacagcgauagacgguggugcuucgacggagagcgcaacaaucaaguucuggaagagaacauggauguggaaaucuggacaaaagagggcgagagaaagaaacugcggccuagauggcucgacgcucgcaccuauucugacccccuggcccuucgggaauuuaaggaguucgcugccgggagacgcuccgucagcggagaucugauucucgaaaucggcaaacugccucagcaccugacccuccgggcucagaaugcccuugacaaccuggugaugcugcacaauuccgagcaggggggaaaggcguacagacaugccauggaagagcuccccgauacaaucgagacccugaugcuucuggcucucauugccguccugacaggcggcgugacgcuguuuuuccucucugggaagggacuuggcaaaaccagcaucgggcugcuguguguuacagcuuccucugcccuccuguggauggccagcguggaaccgcacuggauugcugcguccaucauucuugaguuuuuccugauggugcuccugaucccugaacccgaccggcaacgcaccccucaggauaaccagcuggccuaugucguuaucggacuccuuuuuaugauucugacaguggcugccaacgagaugggccugcucgagaccacgaagaaagaccuggggaucggacauguggccgcugaaaaucaccaacacgccaccaugcuugaugucgaccugagacccgcgagcgccuggacacucuacgcuguggccaccacaguuauuaccccuaugaugcggcauacgaucgagaacacaaccgcuaauauuucucugacagccaucgcgaaccaggccgcuauucugaugggccucgauaagggcuggcccaucuccaaaauggacaucggggugccgcuucuggcccugggaugcuacagccaggucaauccucucacccugaccgcugccgugcuuaugcuggucgcucacuaugccauuaucggccccgggcuccaggcgaaggccacacgcgaagcucaaaagagaacggccgcuggaauuaugaaaaaccccaccguggauggcaucguugccauugaccuggauccuguggucuacgacacaaaguucgagaaacagcuggggcagaucaugcuccuuauccuguguaccucucagauucugcucaugcggacaaccugggcccugugcgaauccaucacgcuugcgacaggaccgcugaccacccucugggagggcagccccggcaaguuuuggaauacaaccauugcugugucuauggccaacaucuuccgcgggagcuaucuggcuggagccggccuggccuucucccucaugaaaucucuugggggaggcagacgggggacaggagcucaaggcgagacgcugggcgaaaaguggaagcgccagcugaaucagcucagcaaauccgaguuuaacauuuacaagagaagcgggaucauggaaguugaccgguccgaggccaaagaaggacugaagagaggcgagaccacaaaacaugcggugucucgcgggaccgccaagcuucggugguucgucgagagaaaucuggugaagccugaaggaaaagugaucgaucucggcugugggcgcggaggcuggagcuauuacugcgcuggccugaagaaaguuacagaggucaagggguauaccaaaggaggccccgggcacgaagagccuauucccauggccacguacggauggaaccuggugaagcuccauuccggcaaagacguguuuuucaugccuccggaaaagugugauacccuucugugcgacaucggggagucuagccccaauccuacaauugaggaaggacggacccugagaguccucaagaugguugagcccuggcugcgcggcaaccaguuuuguaucaaaauucuuaauccuuacaugcccuccgugguggaaacacuggagcaaaugcagcggaaguauggcgggaugcucgucagaaacccgcugucucgcaauagcacccacgagauguacuggguguccugcggaacaggcaacaucguuagcgcugugaacaugaccucucggaugcugcucaauagauucacgauggcccaccgcaaaccuacauaugaacgggaugucgaccugggggcgggaaccagacauguggccguugagcccgaaguggcuaaccuugauauuaucggccagcgcaucgagaauauuaagaacgaacacaaauccaccuggcauuacgacgaggauaaucccuauaagacaugggccuaccacgggagcuaugaggucaagccuucuggauccgcuagcucuauggugaacggcguggucagacugcucacgaaacccugggacguuaucccuauggugacccaaauugccaugacagauaccacaccguuuggccagcagcggguguucaaggaaaaagucgacacccgcacacccagagcuaagcgggggaccacgcagaucauggaggugaccgccaaauggcuguggggauuucuuuccagaaauaagaagccucggauuuguacacgcgaagaguucaccagaaaaguucggagcaacgcggccaucggcgcuguguuugucgacgaaaaucaauggaacuccgccaaggaggcuguggaggaugaacgcuucugggaccugguuagacgggagcgcgaacuccacaaacaggggaagugcgccacaugcguguacaauaugaugggaaaaagagagaagaagcugggcgaauuugggaaagccaagggcagccgggcgaucugguacauguggcugggagcucgcuuccucgaguucgaggcccugggcuuuaugaacgaagaucauugguucucuagagagaauagccuuuccggggucgaaggagagggccugcacaaacucggguauauucugcgggacaucucuaagauucccggaggcaacauguacgccgaugacaccgcugggugggauacgcgcaucacagaggacgaucuucagaaugaagccaaaauuaccgacaucauggagccugaacaugcucugcucgccacaagcaucuuuaagcugaccuaucagaacaaagugguuagagugcaacggcccgcgaagaacggcacggucauggaugugauuucccgcagagaccagcggggaucuggccaggucgggaccuacggacugaauacauucaccaacauggaggugcagcucaucagacaaauggaaagcgagggcauuuuucugccguccgagcuugaaacaccuaaucuggccgagcgcguucucgauuggcuggaaaagcacggggcugagcggcuuaaaagaauggccaucucuggagacgacuguguggucaagcccauugaugaccgcuucgcuaccgcccugacagcgcucaacgauaugggcaaagugcggaaggacaucccucagugggaacccagcaaaggguggaaugauuggcagcaggugccuuuuugcucccaucacuuccaccaacugaucaugaaggacggcagagagauuguugugcccugucgcaaccaggaugagcuggucggacgggccagagugagccagggcgcuggguggucucuccgcgaaaccgccugccugggaaaguccuaugcucaaauguggcagcuuauguacuuucaucggagagaccugcgccucgccgcuaaugccaucuguagcgcgguuccgguggauugggucccuacgucucggacaaccugguccauucacgcccaucaccaguggaugaccacagaggacaugcugagcguguggaacagagucuggaucgaagagaaucccuggauggaagauaaaacccacguguccucuugggaggagguucccuaucuuggcaagcgggaagaccaguggugcgggagccugauuggacucacagcuagagccacgugggccaccaacauccaaguggcuauuaaucagguccgccggcugaucggcaacgagaauuaccuggacuacaugacauccaugaaaagauucaagaacgaaagcgauccugagggggcccucugguga

SEQ ID NO: 18707 - RNA, 9879 nt, Artificial Sequence
  derived and/or modified CDS sequence (opt5) from DENV-1__KF973466__SS-prME
uccgugaccaugcugcugaugcugaugcccacagcccuugcuuuccaccugacgaccagaggaggggaaccucauaugaucgucuccaagcacgaacggggaaaagcccugcuguuuaagaccucuaccggcguuaauaugugcacacuuauugcgauggaccugggggaacucugugaagauaccaugacauacaaaugccccagaaucaccgaagcugaacccgacgauguggacuguuggugcaaugccacggauaccugggugacauauggaaccuguagccagacaggcgagcauagacgggacaagcgcuccgucgcccuggcuccucacguggggcugggacucgagaccagaacggaaacauggaugucuagcgagggcgccuggaaacaaauucagcggguugaaaccugggcucugcgccaucccggcuucacagugaucgcccuuuuucuggcgcacgccauugggaccuccaucacccagaagggaaucauuuucauccuccugaugcuugucacaccuucuauggcuaugagaugcgugggcauugggaaccgggauuuuguugagggacugagcggcgccacguggguggacgucgugcucgagcacggguccugugugaccacaauggcuaagaauaaacccacccuggauaucgaacugcucaagacagaggucaccaacccugccguucugcgcaaacuuugcauugaagcgaagaucagcaauacgacaaccgacucuagauguccgacccagggagaggccacacugguggaagaacaagaugcuaacuucgugugccggcgcaccuuugucgacagaggcuggggcaauggguguggacucuucggcaaagggucccugcuuacaugcgccaaguuuaagugcgugacgaaacuggagggaaagauuguucaguacgaaaaccucaaauauagcgugaucgucaccgugcauacaggcgaucagcaccagguugggaaugagaccacagaacauggaaccaucgcuacgauuacaccccaagccccuacaucugagauccagcugaccgacuacggcgcccugacacucgacuguagcccccggaccggccuggauuucaacgaaauggugcuucugacgaugaaggagaaaagcuggcucguccacaagcagugguuucuggaccuuccucugcccuggacaucuggggcuuccaccagccaggagacauggaaucgccaagaucuccuggugaccuucaaaaccgcgcacgccaagaagcaggaagucgugguucugggaucccaggagggcgcuaugcauacagcccucacgggggccaccgaaauucaaacaucuggaaccacaaccaucuuugcuggccaccugaaaugcagacuuaagauggacaaacugacgcucaaggggacaagcuaugugauguguaccggcuccuucaaacuggagaaggaagucgccgagacccagcauggaacagugcugguucaggugaaguacgagggcaccgaugcgccgugcaaaauuccuuucagcacacaggacgaaaagggggucacgcaaaacggacggcuuaucaccgcuaaucccaucgugacagauaaagagaagccugugaacauugaaaccgagccgcccuuuggcgagucuuauaucguugucggggccggagaaaaagcccucaagcuguccugguucaagaaaggcagcucuauugggaagauguuugaggcuacagccagaggcgcucgccggauggccauccugggagacaccgcgugggauuucggcagcauugggggaguguuuacguccgugggcaaacucguccaccagguguucgggaccgccuacggaguucuguuuucuggcgugagcuggacaaugaagaucgggaucggcauucuucugaccuggcucggacucaauuccagaagcacaucucuguccaugaccuguaucgcugucggcauggugacacuuuaccucgggguuauggugcaggccgacagcggaugcgucauuaacuggaaaggccgcgaacugaagugugggucuggaaucuucgugaccaacgagguucauacguggacagaacaguauaaguuucaagcugauuccccuaaacggcugagcgccgcgauuggcaaggccugggaggagggggugugcggcaucagauccgcuacccgccucgaaaauauuauguggaaacagaucucuaacgagcugaaucacauccuucuggaaaacgacaugaaguucaccgucguggugggagacgccaauggcauucucgcucaggggaaaaagaugauccggccgcagcccauggagcacaaauacagcuggaaguccuggggaaaggccaaaauuaucggcgccgauauucaaaacacaaccuuuaucaucgacgggccugauacgcccgaauguccugacgaucagagagcuuggaauauuugggaggucgaggacuauggauucggcaucuuuacaaccaacauuuggcugaagcugcgcgauucuuacacacagaugugcgaccaucggcuuaugagcgcggccaucaaagauuccaaggcuguucacgccgacaugggcuauuggauugaaagcgagaaaaaugaaaccuggaagcucgccagagcuucuuucaucgaggugaagacauguaccuggcccaaaucccauacgcuguggagcaacggggugcuggaaucugagaugaucauuccgaagaucuacggaggcccuauuucccagcacaauuaucgccccggguacuucacccaaacagccggaccuuggcaccucggcaaacuggagcuugauuuugaccugugcgaagggaccacagucgugguugaugagcauugcggaaaccggggccccagccucagaaccacgacagugaccggcaagaucauucacgaaugguguugccggucuuguacacugccuccccugcgcuucagaggggaggacggaugcugguacggcauggagauccggccggucaaagaaaaggaggaaaaucuugugagaagcaugguuuccgcggggagcggagagguggacucuuuuucccucggcauccugugugucagcauuaugaucgaagaggugaugcgcucccgguggucuagaaagaugcugaugaccgggacccucgcuguuuuccugcuucugauuaugggacagcucacauggaacgaucugauccgccugugcauuauggugggcgccaaugccagcgacagaaugggcauggggacgaccuaucuugcucugauggccacauuuaaaaugcggccuauguucgcggucggaauccucuuucgcagacugaccucccgggaggugcuccugcuuacaauuggccugucucucguggcuagcgucgaacugcccaacucccuggaggaacuuggggauggacuggccaugggcaucaugaugcucaagcugcucaccgaguuccagccccaucaacuguggacgacacuucugucucucaccuuuaucaaaaccacacugagccuggacuacgccuggaagaccacagcuauggcccuuuccauuguuagccuguucccucucugucugucuacgaccucccagaaaacaaccuggcucccggugcugcuugggagcuuuggaugcaagccccugacaauguuccugaucaccgaaaacaagauuuggggccgcaaaucuuggccuaucaaugagggcauuauggcuaucgggaucguguccauucuccugagcucucuucugaagaacgaugucccccucgccggaccucugaucgcgggcgggaugcucauugccuguuaugugaucuccggaagcuccgcugaccugagccuugagaaagccgcugaaguuucuugggagcaggaagccgagcacagcggcacgucccauaauauucugguggaaguccaggaugacgggaccaugagaaucaaggaugaggagaaagacgauacacugaccauccuccugaaggccacacuucuggcugugucuggaguuuaccccaugagcauuccugcgacccucuuugugugguauuucuggcagaagaagaagcagcgguccggcguccugugggacacacccucuccgccugaaguggagcgcgccguccucgaugacggcaucuaccgcauucugcagcgggggcuucugggacgcagccaggugggcguugggguguuccaagacggagucuuucacacgauguggcacgugaccagaggcgcuguucugauguaucaggggaaacggcucgaacccuccugggccucugugaagaaagaucugaucagcuacggaggcggcuggagauuccagggguccuggaacacaggagaggagguccaggugauugccguggaaccuggcaagaaucccaaaaacguucaaaccaccccggggacauuuaagacgagcgagggagaagucggcgcuaucgcccuugacuucaagccugggaccucuggaucccccauugugaaucgcgagggcaaaaucgugggccuguacgggaacggagucgugacaaccagcggcacauauguuucugcgaucgcucaggccaagaccucccaggaagggccucuccccgagauugaggaugaaguguuuaaaaagcggaaucugacgaucauggaccuccaucccggaagcggcaaaacaagacgcuaccugccugccauuguccgggaggcuaucaagagaaaacuucgcacccugauucuggccccgacccgggugguugcguccgaaauggcugaggcccucaaagggaugcccaucagauaucaaacaaccgccgugaagucugaacacacaggccgcgagaucgucgaucugaugugccaugcuaccuucacgaugcggcuucugagcccugugagaguucccaacuacaauaugauuaucauggacgaggcccacuuuacagauccugcuuccauugccgcgcggggauauaucagcacccgcgugggcaugggggaagccgcugccauuuucaugacagcuacacccccuggaucugucgaggccuuuccgcaguccaacgccgugauccaggacgaagagagagauauccccgaacggagcuggaacucuggcuacgacuggauuacggauuucccugggaaaaccgugugguuuguccccagcaucaaguccggaaacgacauugcuaauugucuccgcaaaaacggcaagagaguuauccagcugucucggaagacauucgacaccgaguaucagaagaccaagaacaaugauugggacuacguggugaccacagauauuagcgagaugggggcgaacuucagagccgaccgcgucaucgauccucggagaugccugaaacccgugauucucaaggacggcccggaacgcguuauccuugcuggaccuaugcccgugaccgucgccuccgccgcucagcggagaggccgcaucgggcggaaucagaacaaagagggagaucaguacguguauaugggccaaccccugaauaacgacgaagaucaugcccacuggacggaggcgaagaugcugcucgacaauauuaacacaccugaggggaucauucccgcucuguuugaaccugagagagaaaagucugccgccaucgauggagaguaccgccuuagaggcgaagcucggaaaaccuucguugagcugaugcgcagaggggaccucccgguguggcugagcuauaaggucgccuccgagggcuuucaguacagcgaucggcgcuggugcuucgacggagaaagaaauaaccaggugcuggaggaaaauauggacgucgagauuuggaccaaagaaggcgagcggaagaaacucagaccccgcuggcuugaugcgcggacauauucugacccucuggcccugagagaguuuaaggaguucgcugccgggcgccgguccgugagcggagaucucauccuggagaucggcaaacuuccccagcaccugacccucagagcucaaaacgcccuggacaaucugguuaugcuccauaacuccgaacaagggggaaaggcuuaccggcacgccauggaggaacuuccugauacaauugagacgcugaugcugcucgcgcugaucgccgugcuuaccggcggcgugacacuguuuuuccucucugggaagggacugggcaaaaccagcauugggcugcucugugucacagcuuccucugcccuucuguggauggcuagcguugagccccauuggaucgccgccuccauuauccuggaauuuuuccucauggugcugcuuaucccggagccugaccgccagagaacgccccaagauaaucaacuggcuuauguggucauuggacuccuguuuaugauccugaccguggcggccaacgaaaugggccuccuugagaccacaaagcgggaccuggggauuggacacguugcugccgagaaccaccagcaugccaccaugcuggauguggaccuccgcccugcuagcgccuggacacuguacgcggucgccaccacggugaucacacccaugaugagacacaccauugaaaauacaaccgcuaacaucucucuuaccgccauugcuaaucaggccgcgauccugaugggccucgauaaaggcuggccuaucuccaagauggacauuggggucccccugcuggcccucggaugcuacagccaagugaacccgcuuacacugacggcugccguucugaugcucguggcucauuaugccaucauuggcccugggcugcaggcuaaagccacccgggaggcgcagaagcgcacagccgcuggaaucaugaagaaucccaccgucgauggcauuguggccaucgaccuugaccccguuguguacgaugcuaaauucgaaaagcagcuggggcaaaucaugcuccugauucuguguacaucucagauccuccuuaugagaaccacgugggcccugugcgaguccauuacacuggccaccggaccucucaccacacugugggaaggcagcccgggcaaauuuuggaacaccacaaucgcggucucuauggcuaauauuuuccgggggagcuaucuugccggagcuggccuggccuucucccucaugaagucucucgggggaggccgcagagggacgggagcccagggcgagacccugggcgagaaauggaagcggcagcucaaccaacuuagcaagcccgaauuuaauacauacaaaagauccgggaucauggagguggaccgcagcgaagcuaaggagggacugaaacggggcgaaaccacaaagcacgccguguccagagggaccgcgaaacugcgcugguucguugagcggaaccucgucaagccugagggaaaggugaucgaucugggcugugggagaggaggcuggucuuauuacugcgccggccuuaaaaaggugacggaagucaaaggguauaccaagggaggccccgggcaugaggaaccuauucccauggcuacauacggauggaaucugguuaaacuccacagcggcaaggacguguuuuucaugccuccggagaaaugugauacccugcugugcgacaucggggaauccucucccaacccuacaauugaggagggacgcacccuccgggugcuuaagauggucgaacccuggcugagaggcaaucaguuuuguaucaagauucugaacccuuacaugcccagcgugguugagacacucgaacagaugcagcgcaaacacggcgggaugcuggugcggaauccgcuuuccagaaacucuacccaugagauguauugggucagcugcggaacgggcaauaucguguccgccguuaacaugacaagccgcaugcugcucaaccgguucaccauggcucacagaaagccuaccuacgagcgcgauguggaccugggggccggaacaagacaugucgcgguggaacccgagguggccaaucuggauauuaucggccaacggaucgaaaacauuaaaaaugagcacaagucuacguggcacuaugacgaagauaaccccuacaaaaccugggcuuaucauggguccuacgaggucaagccuagcggaucugccuccagcaugguuaauggcguggugcgccuccugacaaagcccugggacgucaucccuauggugacccagauugcuaugacagacaccacaccguuuggccagcaaagaguuuucaaagagaagguggauacccggacgcccagagccaaacgggggaccacacagaucauggaagucaccgcuaaguggcuuuggggauuucugucucgcaacaaaaagccuagaauuuguacacgggaggaguucacccgcaaggugagauccaaugccgcgaucggcgccguuuuuguggacgagaaccaguggaauagcgcuaaagaagccgucgaggaugagcgguucugggaccucgugcaccgcgaaagagagcugcauaagcaggggaaaugcgcuacgugcguuuauaacaugaugggaaagcgggagaagaaacuuggcgaguuugggaaagccaaaggcucccgcgccaucugguacauguggcugggagcgagauuccucgaguucgaggcucugggcuuuaugaaugaggaucacugguucagccgggaaaacucucugagcgggguggagggagaaggccuccauaagcugggguacauucuucgcgacaucuccaaaauucccggaggcaauauguaugccgaugacacagccgggugggauaccagaaucacagaggacgaucugcaaaacgaggcuaagauuaccgacaucauggaaccugagcacgcccuccuggcuacgucuaucuuuaaacuuaccuaccagaauaaggucgugcggguccagcgccccgccaaaaacggcacagugauggauguuauuagcagacgggaccagagaggauccggccaaguggggaccuauggacugaacacauucaccaauauggaaguccagcucauccgccagauggagucugaaggcauuuuucugccgagcgagcuggagacaccuaaccucgcggaacgggugcuggacuggcuugagaagcacggggccgaaagacugaagcgcauggcuaucuccggagaugacugugugguuaaacccauugaugaccgguucgccaccgcucucacggcccugaaugauaugggcaaggugagaaaagacaucccucagugggagcccucuaagggguggaacgauuggcaacaggucccuuuuugcagccaucacuuccaucagcuuaucaugaaagacggccgcgaaauugugguucccugucggaaucaggaugagcuggugggcagagcgcgcgucucccaaggcgccggguggagccuccgggagacagcuugccugggaaagucuuacgcccagauguggcagcugauguauuuucacagacgcgaccuccggcuggcugccaacgcuaucuguuccgccgugccggucgauugggugccuaccagcagaaccacauggucuauucacgcgcaucaccaauggaugaccacagaagacaugcuuuccguuuggaaucggguguggaucgaggaaaaccccuggauggaggacaagacgcaugucagcuccugggaagaggugcccuaccugggcaaaagagaggaucaguggugcgggucucucauuggacugaccgcccgcgcuacaugggccaccaauauccagguugccauuaaccaggugcggagacuuaucggcaaugaaaacuaucuggacuacaugacaagcaugaagcgcuucaaaaaugaguccgauccugaaggggcucucugguga

SEQ ID NO: 18708 - RNA, 9879 nt, Artificial Sequence
  derived and/or modified CDS sequence (opt5) from DENV-1__KF973471__SS-prME
agcgugaccaugcugcucaugcugcuucccacagcccuggcuuuccaccucacgaccagaggcggggaaccucauaugaucgucuccaagcaggaacggggaaagucucugcuuuuuaagacaagcgccggcguuaacaugugcacccugauugcgauggaccucggggagcugugugaagauacaaugaccuacaaaugcccccagaucacagaggcugaacccgacgauguggacuguuggugcaaugccaccgauacgugggugaccuauggaacauguucccagaccggcgagcaccgcagagacaagcggucugucgcccuggcuccucauguggggcucggacuggagacacgcaccgaaacguggaugagcuccgagggcgccuggaaacagauucagagaguugaaacaugggcccuucggcaccccggcuucaccgugaucgcccuguuucucgcgcaugccauugggacaucuaucacccaaaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaagaauaaacccacacuggauaucgaacuccugaagaccgaggucacaaacccugccauucuucggaaacugugcaucgaagcgaagauuucuaauaccacgacagacucccgcuguccgacccagggagaggccacccucguugaagaacaggaugcuaacuucgugugcagacggacauuuguggaccgcggcuggggcaauggguguggacuguucggcaaagggagccuucugaccugcgccaaguuuaagugcgucacaaaacucgagggaaagaucgugcaguacgaaaaccugaaauauucuguuaucgugacgguccacaccggcgaucaacaucagguggggaaugagacaaccgaacacggaacaauugcuaccaucacgccccaggccccuaccuccgagauucagcugacagacuacggcgcccucacccuggacuguagccccagaacaggccuugauuucaacgaaaugguucugcucaccaugaaggagaaaucuuggcuggugcauaagcaaugguuucuugaccugccucuccccuggacguccggggcuagcacaucccaggagaccuggaaucggcaggaucugcuggucacauucaaaaccgcgcacgccaagaagcaagaaguggucgugcucggaucucaggagggcgcuaugcacaccgcccugacaggggccacggaaauccagaccagcggaacaaccacaauuuuugcuggccaucuuaaaugccgccugaagauggacaaacucacccugaaggggacguccuauguuauguguacaggcagcuucaaacuggagaaggaaguggccgagacccagcacggaaccguccuugugcaaguuaaguacgagggcacagaugcgccgugcaaaaucccuuucucuacccaggacgaaaagggggugacacagaacggaagacucaucacggcuaaucccauugucaccgauaaagagaagccugugaacaucgaaacagagccgcccuuuggcgaguccuauauugugguuggggccggagaaaaagcccugaagcugagcugguucaagaaaggcucuagcaucgggaagauguuugaggcuaccgcccggggcgcuagacgcauggccauucucggagacacagcgugggauuucggcuccaucgggggagucuuuaccucugugggcaaacuggugcaucaggucuucgggacggccuacggagugcuuuuuagcggcguuuccuggaccaugaagaucgggauuggcauccugcucacauggcugggacugaauagccggucuaccucccuuagcaugacauguauugcugugggcauggucacccucuaccugggggugaugguucaagccgacucuggaugcgugaucaacuggaaaggcagagaacugaaguguggguccggaauuuucgucacaaacgaggugcacaccuggacggaacaguauaaguuucaggcugauagcccuaaacgccucuccgccgcgaucggcaaggccugggaggaggggguuugcggcauucggucugcuacaagacuggaaaauaucauguggaaacagaucagcaacgagcuuaaucauauucugcucgaaaacgacaugaaguucaccguggucgugggagacgccaauggcauccuggcucaagggaaaaagaugauucgcccgcagcccauggagcacaaauacuccuggaagucuuggggaaaggccaaaaucauuggcgccgauauccagaacaccacauuuaucauugacgggccugauacccccgaauguccugacaaucagcgggcuuggaacaucugggagguggaggauuauggauucggcauuuuuacgacaaauaucuggcugaaacuuagagacagcuacacccaaaugugcgaucaccgccucauguccgcggccauuaaagacagcaaggcuguccaugccgauaugggcuauuggaucgaaucugagaaaaacgaaacauggaagcuggcccgggcuuccuucaucgagguuaagaccuguacauggcccaaaagccacacccuguggucuaauggggugcucgaauccgagaugauuaucccgaagauuuacggaggcccuaucagccagcauaacuauagacccggguacuucacgcagaccgccggaccuuggcaccugggcaaacuugagcuggacuuugaucucugcgaagggacaaccguggucguggacgagcacugcggaaaucgcggccccucucugcggacaaccacgguuacaggcaagauuauccaugaaugguguugcagaagcuguacccugccuccccuucgguuccgcggggaggauggaugcugguacggcauggagaucagaccggugaaagaaaaggaggaaaaccucguccgguccauggugagcgcggggucuggagagguugacuccuuuagccugggcauucugugugcuuccaucaugauugaagaggugaugagaucucgcuggagccggaagaugcucaugacagggaccccugccgucuuccugcuucugaucaugggacaacucaccuggaaugaccugauuagacugugcaucauggugggcgccaacgcuuccgaucgcaugggcauggggacaacguaucuugcccugauggcgaccuuuaaaaugagacccauguucgcuguuggacuccuguuucggcgccucacaucuagagaggugcugcuucugaccauuggccucagccuggucgccuccguggaacugcccaacucucuugaggaacugggggacggacucgccaugggcaucaugaugcugaagcuccugacagaguuccagccucaccagcuuuggaccacgcugcucagccugacauuuaucaaaaccacccugucccuugauuacgcuuggaagacaaccgccauggcucugagcauuaucucucucuucccgcugugucucuccacaacgagccagaaaaccacauggcugcccgugcuucuggggucuuuuggaugcaagccucugaccauguuccucauuacagaaaauaagaucuggggccggaaauccuggccccugaacgagggcauuauggccaucgggaucgucagcauucuucugucuucccuccugaagaaugacguuccucucgcgggaccccugaccgccggcgggaugcuuaucgcuuguuaugugauuagcggauccagcgccgaucugucucuggagaaagcugccgaagugagcugggagcaagaagccgagcauuccggcacgucucacaacauccucgucgaagugcaggacgaugggaccaugaagauuaaagacgaggagcgcgaugacacacugaccauccuucugaaggcuacacuccuggcgguuagcggaguguacccuauguccauccccgccacccucuuugucugguauuucuggcagaaaaagaagcagagaucuggcgugcugugggauacaccgagcccucccgaaguugagcgggcugugcuugacgauggcauuuaccgcauccugcaaagagggcugcucggacggucccaggucggcgugggggucuuccaggacggaguguuucauacgauguggcacguuacccgcggcgccgugcugauguaucaggggaaaagacuugaaccuucuugggccagcgucaagaaagaccugauuuccuacggaggcggcuggcgguuccaagggagcuggaauacaggagaggaggugcagguuaucgcuguggaacccggcaagaacccgaaaaauguccagaccaccccugggacauuuaagacgcccgagggagaagugggcgccauugcgcucgauuucaagccugggaccucuggaucccccaucgugaacagagagggcaaaauuguuggccuguacgggaauggagucgugacaaccagcggcacauaugugucugcuaucgcccaagccaaggcuucccaggaagggccccucccugagaucgaggacgaagucuuuaaaaagcgcaaccugaccauuauggaucuucacccgggaagcggcaaaacgcggagauaccugcccgccaucgugcgcgaggcgauuaagcggaagcugagaacacucauccuggcuccuacccgcguuguggccuccgaaauggccgaggcucuuaaagggaugcccauucgguaucagaccacagccgucaagucugaacauaccggcagagagaucguggaccugaugugccacgcuacauucaccaugcgccuccugagcccuguucgggugcccaauuacaacaugaucauuauggaugaggcccauuuuacggacccugcguccaucgccgcuagaggauauauuagcacacgggucggcaugggggaagccgcugccaucuucaugaccgccacaccgcccggaucuguggaggcuuuuccucaguccaaugcgguuauucaagaugaagaacgcgacauccccgaaagaagcuggaacucuggcuacgauuggaucaccgacuucccugggaaaacggugugguuuguccccagcauuaaguccggaaaugauaucgccaacugucugcggaaaaacggcaagcgcgugauucagcucucuagaaagaccuucgacacagaguaucagaaaaccaagaauaacgacugggauuacguggucacaaccgacaucagcgagaugggggcuaauuuccgggccgauagaguuauugacccgcgccggugccuuaaaccugugauccugaaggauggccccgaaagagugauucuggccggacccaugccugucacaguggcuuccgccgcgcagcgccggggcagaaucgggcgcaaccaaaauaaagagggagaccaguacguuuauaugggccagccccucaacaaugaugaagaccacgcucauuggaccgaggccaagaugcugcuugauaacaucaauacgccugaggggauuaucccggcccuguuugaacccgagcgggaaaagucugcugccauugacggagaguacagacuccgcggcgaagcgagaaaaacauucguggagcugaugcggcgcggggaucugccugucuggcucagcuauaagguggccuccgagggcuuucaguacagcgacagacgguggugcuucgauggagaacgcaacaaucaaguucuugaggaaaacauggacguggagaucuggaccaaagaaggcgagagaaagaaacugcggcccagauggcuggacgcucgcaccuauucugauccucucgcccugcgggaguuuaaggaguucgcugccgggagacgcuccgucagcggagaccuuauucuggagaucggcaaacucccccagcaccugacacugcgggcucagaaugcccucgauaaccuugugaugcugcacaauuccgaacaagggggaaaggcguacagacaugccauggaggaacugccggacaccaucgagacacucaugcugcuugcucugauugccguccucacgggcggcgugacccuguuuuuccugucugggaagggacucggcaaaacaagcaucgggcuucuguguguuaccgcuuccucugcccugcucuggauggccagcguggagccucacuggauugcugcguccaucauucuggaauuuuuccuuauggugcugcucauccccgagccugaucggcaacgcacaccccaggacaaccagcuggccuaugucguuaucggacugcucuuuaugauucuuaccguggcugccaacgaaaugggccugcuggagacgaccaagaaagaucucgggaucggacauguggccgcugagaaucaccaacacgccacaaugcuggacgucgaucuuagaccugcgagcgccuggacccuguacgcuguggccacaaccguuauuacgcccaugaugcggcauacaaucgaaaacaccacagcuaauauuucucucaccgccaucgcgaaccaggccgcuauucugaugggccuggacaagggcuggccgaucuccaaaauggauaucggggugccucuccuugcccugggaugcuacagccaggucaauccccugacccucacagcugccgugcugaugcuugucgcucacuaugccauuaucggccccgggcugcaggcgaaggccacgcgcgaggcucaaaagagaaccgccgcuggaauuaugaaaaacccuacaguggacggcaucguugccauugaucucgacccgguggucuacgacaccaaguucgaaaaacagcuggggcagaucaugcugcucauccuuuguacaucucagauucugcugaugcggaccacgugggcccucugcgaguccaucacacuggcgaccggaccccuuaccacacugugggaaggcagcccuggcaaguuuuggaauaccacaauugcugugucuauggccaacaucuuccgcgggagcuaucucgcuggagccggccuggccuucucccugaugaaaucucucgggggaggcagacgggggacgggagcucaaggcgagacccuuggcgagaaguggaagcgccagcugaaucagcugagcaaauccgaauuuaacauuuacaagagaagcgggaucauggagguugaucgguccgaagccaaagagggacucaagagaggcgaaacaaccaaacaugcggugucucgcgggacagccaagcugcggugguucgucgagagaaaucuugugaagcccgagggaaaagugaucgaccugggcugugggcgcggaggcuggagcuauuacugcgcuggccucaagaaaguuaccgaagucaagggguauacgaaaggaggcccugggcacgaggaacccauuccuauggccaccuacggauggaaccuggugaagcugcauuccggcaaagauguguuuuucaugccgcccgagaagugugacacacuccuuugcgauaucggggaaucuagcccuaaucccaccgucgaggagggacggacacugagaguucugaagaugguggaaccuuggcucaaaggcaaccaguuuuguauuaagauccugaaucccuacaugccguccguggucgagacccuugaacaaaugcagcgcaaauauggcgggaugcuggugcggaacccucucucuagaaauagcacacacgagauguacuggguuuccugcggaaccggcaacauugugagcgcugucaacaugacgucucgcaugcugcugaaucgguucacaauggcccacagaaagcccaccuaugagcgcgacguggaucucggggcgggaacccggcauguugccguggaacccgaggucgcuaaccuggacaucauuggccagagaaucgaaaauaucaaaaacgagcacaaguccacauggcauuacgaugaagacaauccuuauaagacgugggccuaccacgggagcuaugaggugaaacccucuggauccgcuagcucuauggugaacggcgucguucgccuucugaccaagccuugggaugugauuccgauggugacacaaaucgccaugaccgacacaacccccuuuggccagcagagagucuucaaagagaagguggacacacggaccccucgcgcuaaaagagggacgacccagauuauggaaguuacagccaaguggcucuggggauuucugucccggaauaagaaacccagaaucuguacccgggaggaguucacacgcaaggugagaagcaacgcggccauuggcgcugucuuuguggaugagaaucaauggaacuccgccaaagaagcuguugaggacgagcgguucugggaucuugugcaccgcgaaagagagcugcauaagcaggggaaaugcgcuaccugcgucuacaauaugaugggaaagcgggaaaagaaacucggcgaguuugggaaggccaaaggcagccgcgcgaucugguacauguggcugggagcuagauuccuggaguucgaggcccucggcuuuaugaacgaggaccacugguucucucgggaaaauagccuguccgggguggagggagaaggccuucauaagcugggguauauccuccgcgauauuucuaaaaucccuggaggcaacauguacgccgacgauacggcugggugggacacaagaauuaccgaggaugaccugcagaaugaggccaagaucacagauauuauggaacccgagcacgcccuucuggccaccagcaucuuuaaacucacguaucagaacaagguugugcggguccaacgcccggcgaagaacggcaccgugauggacgucaucuccagacgggaucagcgcggaucuggccagguggggacauacggacugaauaccuucacaaacauggaaguucagcugauuagacaaauggagagcgaaggcaucuuucucccuuccgagcuggagacccccaaucuugccgaacgggugcuggacuggcucgagaaacauggggcugaaagacugaagcgcauggccauuucuggagacgauugugucgugaaaccuaucgacgaucgguucgcuacagcccuuaccgcgcugaacgacaugggcaaggugagaaaagauauuccccagugggagccuagcaagggguggaaugacuggcagcagguucccuuuugcucccaccacuuccaucaacucaucaugaaggauggccgcgaaaucguggucccgugucggaaccaggacgagcuggugggcagagcucgcguuagccagggagcuggguggucucugcgggagacggccugccucggaaaauccuaugcucaaauguggcagcugauguacuuucacagacgcgaucuucggcuggccgcuaaugccauuuguagcgcggugccugucgacugggugcccacaucuagaaccaccugguccauccaugcccaccaccaguggaugacaaccgaagauaugcucagcgucuggaaccgcguguggauugaggaaaaucccuggauggaggacaagacacauguuuccucuugggaagaggugccuuaucugggcaaacgggaggaccaguggugcgggagccuuaucggacugacggcuagagccaccugggccacaaacauucaagucgcuaucaaucaggugcggagacucauuggcaacgaaaauuaccuggauuacaugaccuccaugaagcgcuucaaaaacgagagcgacccggaaggggcccugugguga

SEQ ID NO: 18709 - RNA, 9879 nt, Artificial Sequence
  derived and/or modified CDS sequence (opt5) from DENV-1__KF973472__SS-prME
agcgugaccaugcugcucaugcugcuucccacagcccuggcuuuccaccucacgaccagaggcggggagccucauaugaucgucuccaagcacgaacggggaaaaucucugcuuuuuaagacaagcaccggcguuaacaugugcacacugauugccauggaccucggggagcugugugaagauaccaugacauacaaaugcccgcgcaucaccgaggcggaacccgacgauguggacuguuggugcaaugcuacggauaccugggugacauauggaaccuguucccagacaggcgagcauagacgggacaagcgcucugucgcccuggccccucacguggggcucggacuggagaccagaacggaaacauggaugagcuccgagggcgcuuggaaacaaauucagcggguugaaaccugggcccuucgccaucccggcuucacagugaucgcucuguuucucgcccacgcgauugggaccucuaucacccagaagggaaucauuuucauccugcuuaugcuggucacaccuagcauggccaugagaugcgugggcauugggaaccgggauuuuguugagggacucuccggcgcuacguggguggacgucgugcuggagcacgggagcugugugaccacaauggccaagaauaaacccacccuggauaucgaacuccugaagacagaggucaccaacccugcuguucuucgcaaacugugcauugaagccaagaucucuaauacgacaaccgacuccagauguccgacccagggagaggcgacacucguggaagagcaagaugccaacuucgugugccggcgcacccuggucgacagaggcuggggcaauggguguggacuuuuuggcaaagggagccugcucacaugcgcuaaguucaagugcgugacgaaacuggagggaaagauuguucaguacgaaaaccugaaauauucugugaucgucaccgugcauacaggcgaucagcaccagguugggaaugagaccacagaacauggaaccaucgccacgauuaccccccaagcuccuacauccgagauccagcucaccgacuacggcgcccuggcccuugacuguagcccccggacaggccuggauuuuaacgaaauggugcuccugaccaugaaggagaaaucuuggcuuguccacaagcagugguuccuggaccucccucugcccuggacguccggggcuagcacaucccaggagaccuggaaucgccaagaucugcucgugacauuuaaaaccgcgcacgccaagaagcaggaagucgugguucugggaucucaggagggcgcuaugcauaccgcccuuacaggggccacggaaauucaaaccagcggaacaaccacaaucuucgcuggccaccugaaaugcagacucaagauggacaaacugacccugaaggggacguccuaugugauguguacaggcagcuuuaaacuugagaaggaagucgccgagacccagcauggaaccgugcucguucaggugaaguacgagggcacagaugcgccgugcaaaauuccuuucucuacccaggacgaaaagggggucacacaaaacggacggcugaucacggcuaaucccaucgugaccgauaaagagaagccugugaacauugaaacagagccccccuucggcgaguccuauaucguugucggggccggagaaaaagcccugaagcucagcugguuuaagaaaggcucuagcauugggaagauguucgaggcuaccgccagaggcgcucgccggauggccauccugggagacacagcgugggauuuuggcuccauugggggaguguucaccucugugggcaaacuuguccaccagguguuugggacggccuacggaguucuguucagcggcguguccuggaccaugaagaucgggaucggcauucuccugacauggcugggacuuaauagcagaucuaccucccucagcgucacauguaucgcugugggcaugguuacccuguaccugggggugaugguccaggccgacucuggaugcgugauuaacuggaaaggccgcgaacucaaguguggguccggaaucuuuguuacaaacgaggugcauaccuggacggaacaguauaaguuccaagcugauagcccuaaacggcuguccgccgcgauuggcaaggccugggaggagggggucugcggcaucagaucugcuacacgccuugaaaauauuauguggaaacagaucagcaacgagcugaaucacauccuccuggaaaacgacaugaaguuuaccgugguggucggagacgccaauggcauucuggcucaggggaaaaagaugauccggccgcagcccauggagcacaaauacuccuggaagucuuggggaaaggccaaaauuaucggcgccgauauucaaaacaccacauucaucaucgacgggccugauacccccgaauguccugacgaucagagagcuuggaauauuugggagguugaggacuauggauuuggcaucuucacgacaaacauuuggcuuaagcuccgcgauagcuacacccagaugugcgaccaucggcugauguccgcggccaucaaagauagcaaggcugugcacgccgacaugggcuauuggauugaaucugagaaaaaugaaacauggaagcuggccagagcuuccuuuaucgaggugaagaccuguacauggcccaaaagccauacccucuggucuaacgggguccuggaauccgagaugaucauuccgaagaucuacggaggcccuauuagccagcacaauuaucgccccggguacuucacgcaaaccgccggaccuuggcaccuuggcaaacuggagcucgauuucgaccugugcgaagggacaaccgugguuguggaugagcauugcggaaaccggggccccucucugagaacaaccacggucacaggcaagaucauucacgaaugguguugccggagcuguacccuuccuccccuccgcuuuagaggggaggacggaugcugguacggcauggagauccggccggugaaagaaaaggaggaaaaucugguuagauccauggugagcgcggggucuggagaggucgacuccuucagccugggcauccucuguguguccauuaugaucgaagagguuaugcgcucucgguggagcagaaagaugcugaugacagggacccuugcuguguuucugcuccugauuaugggacagcugaccuggaacgaucuuauccgccugugcauuauggucggcgccaaugccuccgacagaaugggcauggggacaacguaucucgcucugauggccaccuucaaacuccggccuauguuugcggugggaauccuguuccgcagacuuacaucucgggaggugcugcuccugaccauuggccugagccuugucgcuuccguugaacugcccaacucucucgaggaacugggggauggacucgccaugggcaucaugaugcugaagcuucugacagaguuucagccccaucaacucuggaccacgcugcugagccuuacauucauccgcaccacccugucccucgacuacgccuggaaaacaaccgcuauggcccugagcauugugucucucuuuccucugugucuuuccacaacgagccagaagaccacauggcugccggugcugcucgggucuuucggaugcaaaccccugaccauguauuuuaucacagaaaacaagauuuggggcagaaaguccuggccuaucaaugagggcauuauggcuaucgggaucgucagcauucuucugucuucccuccugaaaaacgaugugccccucgccggaccucugaucgcgggcgggaugcuuauugccuguuacguuaucagcggauccagcgcugaccugucucuggagaaggccgcugaagugagcugggagcaggaagccgagcacuccggcaccucucauaauauucucgucgaagugcgggaugacgggacgaugcgcaucaaagaugaggagaaggacgauacccugacaauccuucugaaagccacccuccuggcuguuagcggaguguaucccauguccauuccugcgacacucuucgucugguacuuuuggcagaagaaaaagcaaagaucuggcgugcugugggacacccccagcccgccugaagucgagcgggccgugcuugaugacggcaucuaucgcauucugcagagagggcugcucggacggucccagguuggcgugggggucuuccaggacggaguguuccacacaauguggcacguuacgagaggcgcugugcugauguaccaagggaagcgccuugaacccucuugggccagcgucaaaaaggaucugaucuccuacggaggcggcuggcgguuucaggggagcuggaacaccggagaggaggugcaggugauugccguugaaccuggcaaaaaucccaagaacguccagacaaccccggggaccuucaaaacaccugagggagaagugggcgcuaucgcccucgacuuuaagcccgggacgucuggauccccuauugugaauagagagggcaagaucgucggccuguaugggaacggagugguuaccacaagcggcaccuacgugucugcgaucgcucaagccaaagccucccaggaagggccccuccccgagauugaggaugaagucuucaagaaacgcaaucugacaaucauggaccuucauccuggaagcggcaagacccggagauaucugccggcuauugugcgcgaggccaucaaacggaagcugagaacgcucauucuggcgcccacacgcguuguggcuuccgaaauggccgaggcccuuaaggggaugccuauccgguaccagaccaccgcugucaaaucugaacacacaggcagagagaucguggaucugaugugccaugccaccuuuacaaugcggcuccugagccccguucgcgugccuaacuauaauaugauuaucauggacgaggcucacuucaccgaucccgccuccauugcggccagaggauacaucagcacgcgggucggcaugggggaagcugccgcuauuuuuaugacagccaccccuccgggaucuguggaggccuucccccaauccaacgcugugauccaggacgaagagcgcgauaucccugaaagaagcuggaauucuggcuaugacuggauuacagauuuucccgggaagaccgucugguucguuccuagcaucaaauccggaaacgacauugcgaauugucugcggaagaacggcaaaagagugauccagcucucucgcaagacguuugacaccgaguaccagaagacaaaaaacaaugauugggacuacguggucaccacagauauuagcgagaugggggccaacuuccgggcugacagagugaucgauccccgccggugccuuaagccgguuauucugaaagacggcccugaaagagugauccuggccggacccaugcccgucaccguggccuccgcugcccaacgccggggcagaaucgggcgcaaucagaacaaggagggagaucaguauguuuacaugggccagccucucaauaacgacgaagaucaugcgcacuggacagaggcuaaaaugcugcuugacaauauuaacacccccgaggggaucauuccugcccuguucgaaccggagagagaaaagucugccgcuaucgauggagaguaucggcuccgcggcgaagccagaaagacguuuguggagcugaugcggcgcggggaccugcccgucuggcucagcuacaaaguggcguccgagggcuuccaauauagcgauagacgguggugcuuugacggagaaagaaauaaccagguccuugaggaaaauauggacguggagauuuggacaaaggaaggcgagcgcaaaaagcugcggccuagauggcuggaugcccgcaccuacucugacccccucgcucugcgggaguucaaagaauuugccgcugggagacgguccguuagcggagaucuuauccuggagaucggcaagcucccucagcaccugacccugcgcgcccagaacgcucucgacaaucuugugaugcugcauaacuccgaacaagggggaaaagccuauagacacgcgauggaggaacugcccgauacaauugagacccucaugcugcuugcccugaucgcugugcucacaggcggcgucacgcuguucuuucugucugggaagggacucggcaagaccagcauugggcuucuguguguuacagccuccucugcucugcucuggauggccagcguggagccgcauuggaucgccgcuuccauuauccuggaauucuuucuuauggugcugcucaucccugagcccgaccggcagcgcaccccucaggauaaucagcuggcguacgucgugauuggacugcucuucaugauccuuacaguugccgcuaacgaaaugggccugcuggagaccacgaaaagagaccucgggauuggacacguggccgccgagaaccaccaacaugcuaccaugcuggaugucgaccuucggcccgccagcgcguggacacuguacgccguggcuaccacagucaucaccccuaugaugcgccacacgauugaaaauacaaccgccaacaucucucucacagcuauugccaaucaggcggccauccugaugggccuggauaagggcuggcccaucuccaaaauggacauuggggugccgcuccuugcucugggaugcuauagccagguuaacccucugacccucaccgccgcugugcugaugcuugucgcccauuacgcuaucauuggccccgggcugcaagccaaggcgacaagagaggcccagaaacggacggcugccggaaucaugaagaaucccaccguggauggcauuguugcuaucgaccucgacccuguggucuaugaugccaaguuugaaaaacagcuggggcagaucaugcugcucauucuuuguacaucucaaauccugcugaugcgcaccacaugggcccucugcgaguccauuacccuggcgacgggaccgcuuacaacccugugggaaggcagccccggcaaguucuggaacaccacaaucgcugugucuauggccaauauuuuuagagggagcuaccucgcuggagccggccuggccuucucccugaugaaaucucucgggggaggccggagagggaccggagcucagggcgagacacuuggcgagaaguggaaacgccagcugaaccagcugagcaagccugaauucaauacguauaagcgguccgggaucauggagguggacagaagcgaagccaaagagggacucaagcgcggcgaaaccacaaaacacgcgguuucccgggggaccgccaagcugagaugguuugucgagcgcaaccuugugaaacccgagggaaaggugaucgaucugggcugugggcggggaggcuggucuuacuauugcgcuggccucaagaaagucacagaaguuaagggguacaccaaaggaggcccugggcaugaggaacccauuccuauggccacguacggauggaaucuggugaagcugcacagcggcaaagacguguucuuuaugccgcccgagaagugugauacccuccuuugcgacaucggggaauccucuccuaaccccacaauugaggagggaagaacccugcgcguccugaaaaugguggaaccuuggcuccggggcaaucaauucuguaucaagauucugaaccccuauaugccgagcguuguggagacacuugaacagaugcagagaaagcacggcgggaugcugguccgcaauccucucucccggaacucuacccaugagauguacugggugagcugcggaacaggcaauaucguuuccgcugugaacaugaccagcagaaugcugcugaaccgcuuuacgauggcccacagaaaacccacauaugagcgggaugucgaccucggggcgggaacccgccauguggccguggaacccgaggucgcuaaucuggauauuaucggccagagaaucgaaaacauuaagaaugagcacaaaucuaccuggcacuacgacgaagauaacccuuauaagacaugggccuaccauggguccuaugagguuaaacccagcggaucugcuuccagcauggugaauggcgugguccggcuucugacgaagccuugggacgugaucccgaugguuacccaaauugccaugacagacaccacacccuucggccagcagagaguguuuaaggagaaagucgauacccggacaccucgcgcuaagagagggaccacgcaaaucauggaagugaccgccaaauggcucuggggauuccugucucggaacaagaaaccccgcauuuguacaagagaggaauuuacccggaagguucgcuccaaugcggccaucggcgcuguguucgucgacgagaaccaguggaauagcgccaaggaagcuguggaggaugagagauuuugggaccuuguucaccgggaacgcgagcugcauaaacaggggaagugcgccacaugcguguacaacaugaugggaaaaagagaaaagaaacucggcgaguucgggaaggccaagggcucccgggcgaucugguacauguggcugggagcucgcuuucuggaauucgaggcccucggcuucaugaaugaggaucacugguuuagcagagaaaacucucugagcggggucgagggagaaggccuucauaaacugggguauauucuccgggacaucuccaagauuccuggaggcaauauguacgccgaugacaccgcugggugggauacgcgcaucacagaggacgaucugcagaacgaggccaaaauuaccgacaucauggaacccgagcacgcucuucuggccacaucuaucuucaagcucaccuaucaaaauaaaguggucagagugcagcggccggcgaagaacggcacgguuauggaugugauuagcagacgcgaccagcggggauccggccaggucgggaccuacggacugaacacauuuaccaauauggaagugcaacugaucagacagauggagucugaaggcauuuuccucccuagcgagcuggagacacccaaccuugccgaacgcgugcuggacuggcucgagaaacacggggcugaacggcugaagagaauggccaucuccggagaugacuguguugugaagccuauugaugaccgcuuugcuaccgcccuuacagcgcugaaugauaugggcaaaguccggaaggacaucccccagugggagccuucuaaaggguggaacgauuggcagcaagugcccuucugcagccaucacuuucaucagcucaucaugaaggacggcagagaaauuguugugccgugucgcaaucaggaugagcuggucggacgggccagagugucccagggcgcuggguggagccugcgcgagaccgccugccucggaaaaucuuaugcucaaauguggcagcugauguacuuccaccggagagaccuucggcuggccgcuaacgccaucuguuccgcggucccuguggauuggguucccacgagcagaacaaccuggucuauucacgcccaucaccaguggaugaccacagaagacaugcucuccguguggaaucgcgucuggaucgaggaaaaccccuggauggaggacaagacccaugugagcuccugggaagagguuccuuaucugggcaagcgggaggaucaauggugcgggucucuuauuggacugacagcuagagccacgugggccaccaauauccagguggcuauuaaccagguccgcagacucaucggcaaugaaagcuaccuggacuacaugacauccaugaaacgguuuaagaacgagagcgauccggaaggggcccugugguga

SEQ ID NO: 18710 - RNA, 9879 nt, Artificial Sequence
  derived and/or modified CDS sequence (opt5) from DENV-1__KF973474__SS-prME
agcgugaccaugcugcucaugcugcuucccacagcccuggcuuuccaccucacgaccagaggcggggagccucauaugaucgucuccaagcacgaacggggaaaaucucugcuuuuuaagacaagcaccggcguuaacaugugcacacugauugccauggaccucggggagcugugugaagauaccaugacauacaaaugcccgcgcaucaccgaggcggaacccgacgauguggacuguuggugcaaugcuacggauaccugggugacauauggaaccuguucccagacaggcgagcauagacgggacaagcgcucugucgcccuggccccucacguggggcucggacuggagaccagaacggaaacauggaugagcuccgagggcgcuuggaaacaaauucagcggguugaaaccugggcccuucgccaucccggcuucacagugaucgcucuguuucucgcccacgcgauugggaccucuaucacccagaagggaaucauuuucauccugcuuaugcuggucacaccuagcauggccaugagaugcgugggcauugggaaccgggauuuuguugagggacucuccggcgcuacguggguggacgucgugcuggagcacgggagcugugugaccacaauggccaagaauaaacccacccuggauaucgaacuccugaagacagaggucaccaacccugcuguucuucgcaaacugugcauugaagccaagaucucuaauacgacaaccgacuccagauguccgacccagggagaggcgacacucguggaagagcaagaugccaacuucgugugccggcgcacccuggucgacagaggcuggggcaauggguguggacuuuuuggcaaagggagccugcucacaugcgcuaaguucaagugcgugacgaaacuggagggaaagauuguucaguacgaaaaccugaaauauucugugaucgucaccgugcauacaggcgaucagcaccagguugggaaugagaccacagaacauggaaccaucgccacgauuaccccccaagcuccuacauccgagauccagcucaccgacuacggcgcccuggcccuugacuguagcccccggacaggccuggauuuuaacgaaauggugcuccugaccaugaaggagaaaucuuggcuuguccacaagcagugguuccuggaccucccucugcccuggacguccggggcuagcacaucccaggagaccuggaaucgccaagaucugcucgugacauuuaaaaccgcgcacgccaagaagcaggaagucgugguucugggaucucaggagggcgcuaugcauaccgcccuuacaggggccacggaaauucaaaccagcggaacaaccacaaucuucgcuggccaccugaaaugcagacucaagauggacaaacugacccugaaggggacguccuaugugauguguacaggcagcuuuaaacuugagaaggaagucgccgagacccagcauggaaccgugcucguucaggugaaguacgagggcacagaugcgccgugcaaaauuccuuucucuacccaggacgaaaagggggucacacaaaacggacggcugaucacggcuaaucccaucgugaccgauaaagagaagccugugaacauugaaacagagccccccuucggcgaguccuauaucguugucggggccggagaaaaagcccugaagcucagcugguuuaagaaaggcucuagcauugggaagauguucgaggcuaccgccagaggcgcucgccggauggccauccugggagacacagcgugggauuuuggcuccauugggggaguguucaccucugugggcaaacuuguccaccagguguuugggacggccuacggaguucuguucagcggcguguccuggaccaugaagaucgggaucggcauucuccugacauggcugggacuuaauagcagaucuaccucccucagcaugacauguaucgcugucggcauggugacccuguaccuggggguuauggugcaggccgacucuggaugcgucauuaacuggaaaggccgcgaacucaaguguggguccggaaucuuugugacaaacgagguucauaccuggacggaacaguauaaguuccaagcugauagcccuaaacggcuguccgccgcgauuggcaaggccugggaggagggggugugcggcaucagaucugcuacacgccuugaaaauauuauguggaaacagaucagcaacgagcugaaucacauccuccuggaaaacgacaugaaguuuaccgucguggugggagacgccaauggcauucuggcucaggggaaaaagaugauccggccgcagcccauggagcacaaauacuccuggaagucuuggggaaaggccaaaauuaucggcgccgauauucaaaacaccacauucaucaucgacgggccugauacccccgaauguccugacgaucagagagcuuggaauauuugggaggucgaggacuauggauuuggcaucuucacgacaaacauuuggcuuaagcuccgcgauagcuacacccagaugugcgaccaucggcugauguccgcggccaucaaagauagcaaggcuguucacgccgacaugggcuauuggauugaaucugagaaaaaugaaacauggaagcuggccagagcuuccuuuaucgaggugaagaccuguacauggcccaaaagccauacccucuggucuaacggggugcuggaauccgagaugaucauuccgaagaucuacggaggcccuauuagccagcacaauuaucgccccggguacuucacgcaaaccgccggaccuuggcaccuuggcaaacuggagcucgauuucgaccugugcgaagggacaaccgucgugguugaugagcauugcggaaaccggggccccucucugagaacaaccacggugacaggcaagaucauucacgaaugguguugccggagcuguacccuuccuccccuccgcuuuagaggggaggacggaugcugguacggcauggagauccggccggucaaagaaaaggaggaaaaucuggugagauccaugguuagcgcggggucuggagagguggacuccuucagccugggcauccucugugucuccauuaugaucgaagaggugaugcgcucucgguggagcagaaagaugcugaugacagggacccuugcuguuuuucugcuccugauuaugggacagcugaccuggaacgaucuuauccgccugugcauuauggugggcgccaaugccuccgacagaaugggcauggggacaacguaucucgcucugauggccaccuucaaacuccggccuauguuugcggucggaauccuguuccgcagacuuacaucucgggaggugcugcuccugaccauuggccugagccuuguggcuuccgucgaacugcccaacucucucgaggaacugggggauggacucgccaugggcaucaugaugcugaagcuucugacagaguuucagccccaucaacucuggaccacgcugcugagccuuacauucaucaaaaccacccugucccucgacuacgccuggaagacaaccgcuauggcccugagcauuguuucucucuuuccucugugucuuuccacaacgagccagaaaaccacauggcugccggugcugcucgggucuuucggaugcaagccccugaccauguaucuuaucacagaaaacaagauuuggggccgcaaauccuggccuaucaaugagggcauuauggcuaucgggaucgugagcauucugcucucuucccugcucaagaacgaugucccccuggccggaccucuuaucgcgggcgggaugcugauugccuguuacgugaucagcggauccagcgcugaccugucucucgagaaagccgcugaaguuagcugggagcaggaagccgagcacuccggcaccucucauaauauucugguggaaguccaggaugacgggacgaugagaaucaaggaugaggagaaagacgauacccuuacaauccugcucaaggccacccugcucgcugugagcggaguuuaucccauguccauuccugcgacacuguuugugugguacuucuggcaaaaaaagaagcagcggucuggcguccuuugggacacccccagcccgccugaaguggagcgcgccguccuggaugacggcaucuauagaauucugcagcgggggcuccugggacgcucccaggugggcguugggguguuucaagacggagucuuccacacaauguggcacgugacgagaggcgcuguucuuauguaccaggggaaacggcuggaacccucuugggccagcgugaagaaagaucucaucuccuacggaggcggcuggagauuccaggggagcuggaacaccggagaggagguccaggugauugccguggaaccuggcaagaaucccaaaaacguucaaacaaccccggggaccuuuaagacaccugagggagaagucggcgcuaucgcccuggacuucaagcccgggacgucuggauccccuauugugaaucgcgagggcaaaaucgugggccucuaugggaacggagucgugaccacaagcggcaccuacguuucugcgaucgcucaggccaaggccucccaggaagggccccugcccgagauugaggaugaaguguuuaaaaagcggaaucuuacaaucauggaccugcauccuggaagcggcaaaaccagacgcuaucugccggcuauuguccgggaggccaucaagagaaagcuccgcacgcugauucuugcgcccacacgggugguugcuuccgaaauggccgaggcccugaaagggaugccugugagauaccaaaccaccgcugucaagucugaacacacaggccgcgagaucguggaucucaugugccaugccaccuucacaaugcggcugcugagccccguuagagugccuaacuauaauaugaucauuauggacgaggcucacuuuaccgaucccgccuccaucgcggcccggggauacauuagcacgcgcgucggcaugggggaagcugccgcuaucuucaugacagccaccccuccgggaucuguggaggccuuuccccaguccaacgcugugauucaggacgaagagagagauaucccugaacggagcuggaauucuggcuaugacuggaucacagauuuccccgggaaaaccgucugguuuguuccuagcauuaaguccggaaacgacaucgcgaauugucuccgcaaaaacggcaagagagugauucagcuuucucggaagacguucgacaccgaguaccaaaaaacaaagaacaaugauugggacuacguggucaccacagauaucagcgagaugggggccaacuuuagagcugaccgcgugauugauccccggagaugccugaaaccgguuauccugaaggacggcccugaacgcgugauucucgccggacccaugcccgucaccguggccuccgcugcccagcggagaggccgcaucgggcggaaucagaacaaagagggagaucaguauguuuacaugggccaaccucugaauaacgacgaagaucaugcgcacuggacagaggcuaagaugcuucuggacaauaucaacacccccgaggggauuaucccugcccucuucgaaccggagagagaaaagucugccgcuauugauggagaguaucgccugagaggcgaagcccggaaaacguucguggagcugaugcgcagaggggaccuccccgucuggcuuagcuacaagguggcguccgagggcuuucaguauagcgaucggcgcuggugcuucgacggagaaagaaauaaccagguccuggaggaaaauauggacguggagaucuggacaaaagaaggcgagcggaagaaacugagaccucgcuggcucgaugcccggaccuacucugacccccuggcucuuagagaguuuaaggaauucgccgcugggcgccgguccguuagcggagaucugauucucgagaucggcaaacugccucagcaccugacccucagagcccaaaacgcucuugacaaucuggugaugcugcauaacuccgaacaggggggaaaggccuaucggcacgcgauggaggaacuccccgauacaaucgagacccugaugcuucuggcccucauugcugugcugacaggcggcgucacgcuguuuuuccucucugggaagggacuuggcaaaaccagcaucgggcugcuguguguuacagccuccucugcucuccuguggauggccagcguggagccgcauuggauugccgcuuccaucauucuugaauuuuuccugauggugcuccugaucccugagcccgaccgccagagaaccccucaggauaaucaacuggcguacgucgugaucggacuccuuuuuaugauucugacaguugccgcuaacgaaaugggccugcucgagaccacgaagcgggaccuggggaucggacacguggccgccgagaaccaccagcaugcuaccaugcuugaugucgaccugcgccccgccagcgcguggacacucuacgccguggcuaccacagucauuaccccuaugaugagacacacgaucgaaaauacaaccgccaacauuucucugacagcuaucgccaaucaggcggccauucugaugggccucgauaaaggcuggcccaucuccaagauggacaucggggugccgcuucuggcucugggaugcuauagccaaguuaacccucucacccugaccgccgcugugcuuaugcuggucgcccauuacgcuauuaucggccccgggcuccaggccaaagcgacacgggaggcccagaagcgcacggcugccggaauuaugaagaaucccaccguggauggcaucguugcuauugaccuggacccuguggucuaugaugccaaauucgaaaagcagcuggggcaaaucaugcuccuuauccuguguacaucucagauucugcucaugagaaccacaugggcccugugcgaguccaucacccuugcgacgggaccgcugacaacccucugggaaggcagccccggcaaauuuuggaacaccacaauugcugugucuauggccaauaucuuccgggggagcuaccuggcuggagccggccuggccuuuucccucaugaagucucuugggggaggccgcagagggaccggagcucagggcgagacacugggcgagaaauggaagcggcagcugaaccaacucagcaagccugaauucaauacguauaaaagauccgggauuauggagguggaccgcagcgaagccaaggagggacugaaacggggcgaaaccacaaagcacgcgguuuccagagggaccgccaaacuucgcugguucgucgagcggaaccuggugaagcccgagggaaaggugaucgaucucggcugugggagaggaggcuggucuuacuauugcgcuggccugaaaaaggucacagaaguuaaaggguacaccaagggaggcccugggcaugaggaacccaucccuauggccacguacggauggaaucuggugaaacuccacagcggcaaggacguguuuuucaugccgcccgagaaaugugauacccuucugugcgacauuggggaauccucuccuaaccccacaaucgaggagggacgcacccugcggguccucaagaugguggaaccuuggcugagaggcaaucaguuuuguauuaagauccuuaaccccuauaugccgagcguuguggagacacuggaacagaugcagcgcaaacacggcgggaugcucguccggaauccucuguccagaaacucuacccaugagauguacugggugagcugcggaacaggcaauauuguuuccgcugugaacaugaccagccgcaugcugcucaaccgguucacgauggcccacagaaagcccacauaugagcgcgaugucgaccugggggcgggaaccagacaugugaccguggaacccgaggucgccaaucuugauaucauuggccaacggaucgaaaacaucaaaaaugagcacaagucuacauggcacuacgacgaagauaacccuuauaaaacgugggcuuaccauggguccuaugagguuaagcccagcggaucugccuccagcauggugaauggcgugguccgccugcucaccaagccuugggacgugauuccgaugguuacacagaucgcuaugaccgacacaacccccuuuggccagcaaagaguguucaaagagaaggucgauacacggaccccuagagccaaacgggggacgacccagauuauggaagugacagcuaaguggcuguggggauuucuuucucgcaacaaaaagcccagaaucuguacccgggaggaauucacacgcaagguuagauccaaugccgcgauuggcgccguguuugucgacgagaaccaguggaauagcgcuaaagaagccguggaggaugagcgguucugggaccugguucaccgcgaaagagagcuccauaagcaggggaaaugcgcuaccugcguguacaacaugaugggaaagcgggaaaaaaagcugggcgaguuugggaaggccaaaggcucccgcgccaucugguacauguggcugggagcgagauuccucgaauuugaggcucugggcuucaugaaugaggaucacugguucagccgggaaaacucucuuagcggggucgagggagaaggccugcauaagcucggguauauccugcgcgacauuuccaaaaucccuggaggcaauauguacgccgaugacacggccgggugggauacaagaauuaccgaggacgaucuucaaaacgaggcuaagaucacagacauuauggaacccgagcacgcccugcucgcuaccucuaucuuuaaacugacguaucagaauaaggugguccgggugcagcgcccggccaaaaacggcaccguuauggaugugaucagcagacgggaccagagaggauccggccaagucgggacauacggacugaacaccuucacaaauauggaagugcagcucauucgccagauggagucugaaggcaucuuucugccuagcgagcuugagacccccaaccuggcggaacgggugcucgacuggcuggagaagcacggggccgaaagacuuaagcgcauggcuauuuccggagaugacuguguugugaaaccuaucgaugaccgguucgccacagcucugaccgcccucaaugauaugggcaaggucagaaaagacauuccccagugggagccuucuaagggguggaacgauuggcaacaggugcccuuuugcagccaucacuuccaucagcugaucaugaaagacggccgcgaaaucguugugccgugucggaaucaggaugagcuggucggaagagcgcgcgugucccaaggcgccggguggagccuccgggagacggcuugccugggaaagucuuaugcccagauguggcagcuuauguacuuucacagacgcgaccugcggcucgcugccaacgcuauuuguuccgccgucccuguggauuggguucccacaagcagaaccaccuggucuauccacgcgcaucaccaauggaugacaaccgaagacaugcuguccguguggaaucgggucuggauugaggaaaaccccuggauggaggacaagacacaugugagcuccugggaagagguuccuuaucuuggcaaaagagaggaucaguggugcgggucucugaucggacucacggcccgcgcuaccugggccacaaauauucagguggccaucaaccagguccggagacugauuggcaaugaaaacuaccuggacuacaugaccagcaugaagcgcuucaaaaaugaguccgauccggaaggggcucucugguga

SEQ ID NO: 18711 - RNA, 9879 nt, Artificial Sequence
  derived and/or modified CDS sequence (opt5) from DENV-1__KF973475__SS-prME
agcgugaccaugcugcugaugcugaugcccacagcgcuugcuuuccaccugacgaccagaggaggggaaccucauaugaucgucuccaagcacgaacggggaaaagcccuccuguuuaagaccucuaccggcguuaauaugugcacacuuauugcgauggaccugggggaacucugugaagauaccaugacauacaaaugcccccgcaucaccgaagcugaacccgacgauguggacuguuggugcaaugccacggauaccugggugacauauggaaccuguagccaaacaggcgagcauagacgggacaagcgcuccgucgcccuggcuccucacguggggcugggacucgagaccagaacggaaacauggaugucuagcgagggcgccuggaaacaaauucagcggguugaaaccugggcucugcgccaucccggcuucacagugaucgcccuuuuucuggcgcacgccauugggaccuccaucacccagaagggaaucauuuucauccuccugaugcuugucacaccuucuauggcuaugagaugcgugggcauugggaaccgggauuuuguugagggacugagcggcgccacguggguggacgucgugcucgagcacggguccugugugaccacaauggcuaagaauaaacccacccuggauaucgaacugcucaagacagaggucaccaacccugccguucugcgcaaacuuugcauugaagcgaagaucagcaauacgacaaccgacucuagauguccgacccagggagaggccacacugguggaagaacaagaugcuaacuucgugugccggcgcaccuuugucgacagaggcuggggcaauggguguggacucuucggcaaagggucccugcuuacaugcgccaaguuuaagugcgugacgaaacuggagggaaagauuguucaguacgaaaaccucaaauauagcgugaucgucaccgugcauacaggcgaucagcaccagguugggaaugagaccacagaacauggaaccaucgcuacgauuacaccccaagccccuacaucugagauccagcugaccgacuacggcgcccugacacucgacuguagcccccggaccggccuggauuucaacgaaauggugcuucugacgaugaaggagaaaagcuggcucguccacaagcagugguuucuggaccuuccucugcccuggacaucuggggcuuccaccagccaggagacauggaaucgccaagaucuccuggugaccuucaaaaccgcgcacgccaagaagcaggaagucgugguucugggaucccaggagggcgcuaugcauacagcccucacgggggccaccgaaauucaaacaucuggaaccacaaccaucuuugcuggccaccugaaaugcagacuuaagauggacaaacugacgcucaaggggacaagcuaugugauguguaccggcuccuucaaacuggagaaggaagucgccgagacccagcauggaacagugcugguucaggugaaguacgagggcaccgaugcgccgugcaaaauuccuuucagcacacaggacgaaaagggggucacgcaaaacggacggcuuaucaccgcuaaucccaucgugacagauaaagagaagccugugaacauugaaaccgagccgcccuuuggcgagucuuauaucguugucggggccggagaaaaagcccucaagcuguccugguucaagaaaggcagcucuauugggaagauguuugaggcuacagccagaggcgcucgccggauggccauccugggagacaccgcgugggauuucggcagcauugggggaguguuuacguccgugggcaaacucguccaccagguguucgggaccgccuacggaguucuguuuucuggcgugagcuggacaaugaagaucgggaucggcauucuucugaccuggcucggacucaauuccagaagcacaucucuguccaugaccuguaucgcugucggcauggugacacuuuaccucgggguuauggugcaggccgacagcggaugcgucauuaacuggaaaggccgcgaacugaagugugggucuggaaucuucgugaccaacgagguucauacguggacagaacaguauaaguuucaagcugauuccccuaaacggcugagcgccgcgauuggcaaggccugggaggagggggugugcggcaucagauccgcuacccgccucgaaaauauuauguggaaacagaucucuaacgagcugaaucacauccuucuggaaaacggaaugaaguucaccgucguggugggcgacgccaaugggauucucgcucagggcaagaagaugauccggccgcagcccauggagcacaaauacagcuggaaguccuggggcaaggccaaaauuaucggggccgacauucaaaacacaaccuuuaucaucgauggaccugacacgcccgaauguccugaugaccagagagcuuggaauauuugggaggucgaggauuauggcuucggcaucuuuacaaccaacauuuggcugaagcugcgcgacucuuacacacagaugugcgaucaucggcuuaugagcgcggccaucaaagacuccaaggcuguucacgccgauaugggguauuggauugaaagcgagaaaaaugaaaccuggaagcucgccagagcuucuuucaucgaggugaagacauguaccuggcccaaaucccauacgcuguggagcaacggagugcuggaaucugagaugaucauuccgaagaucuacggcgggccuauuucccagcacaauuaucgccccggauacuucacccaaacagccggcccuuggcaccucgggaaacuggagcuugacuuugaucugugcgaaggaaccacagucgugguugacgagcauugcggcaaccggggccccagccucagaaccacgacagugaccgggaagaucauucacgaaugguguugccggucuuguacacugccuccccugcgcuucagaggagaggauggcugcugguacgggauggagauccggccggucaaagaaaaggaggaaaaucuugugagaagcaugguuuccgcgggaagcggcgagguggacucuuuuucccucgggauccugugugucagcauuaugaucgaagaggugaugcgcucccgguggucuagaaagaugcugaugaccggaacccucgcuguuuuccugcuucugauuaugggccagcucacauggaacgaccugauccgccugugcauuauggugggcgccaaugccagcgauagaauggggaugggaacgaccuaucuugcucugauggccacauuuaaaaugcggccuauguucgcggucggcauccucuuucgcagacugaccucccgggaggugcuccugcuuacaauugggcugucucucguggcuagcgucgaacugcccaacucccuggaggaacuuggagacggccuggccauggggaucaugaugcucaagcugcucaccgaguuccagccccaucaacuguggacgacacuucugucucucaccuuuaucaaaaccacacugagccuggauuacgccuggaagaccacagcuauggcccuuuccauuguuagccuguucccucucugucugucuacgaccucccagaaaacaaccuggcucccggugcugcuuggauccuuuggcugcaagccccugacaauguuccugaucaccgaaaacaagauuuggggccgcaaaucuuggccuaucaaugaggggauuauggcuaucggaaucguguccauucuccugagcucucuucugaagaacgacgucccccucgccggcccucugaucgccgggggaaugcucauugccuguuaugugaucuccggcagcuccgcugaucugagccuugagaaagccgcugaaguuucuugggagcaggaagccgagcacagcgggacgucccauaauauucugguggaaguccaggacgauggaaccaugagaaucaaggacgaggagaaagaugacacacugaccauccuccugaaggccacacuucuggcugugucuggcguuuaccccaugagcauuccugcgacccucuuugugugguauuucuggcagaagaagaagcagcgguccggcguccugugggauacacccucuccgccugaaguggagcgcgccguccucgacgaugggaucuaccggauucugcagcggggacuucugggccgcagccagguggggguuggaguguuccaagacggcgucuuucacacgauguggcacgugaccagaggggcuguucugauguaucagggaaaacggcucgaacccuccugggccucugugaagaaagaccugaucagcuacggcggcggguggagauuccagggauccuggaacacaggcgaggagguccaggugauugccguggaaccugggaagaaucccaaaaacguucaaaccaccccgggaacauuuaagacgagcgagggcgaagucggggcuaucgcccuugauuucaagccuggaaccucuggcucccccauugugaaucgcgagggcaaaaucguggggcuguacggaaacggcgucgugacaaccagcgggacauauguuucugcgaucgcucaggccaagaccucccaggaaggaccucuccccgagauugaggacgaaguguuuaaaaagcggaaucugacgaucauggaucuccaucccggcagcgggaaaacaagacgcuaccugccugccauuguccgggaggcuaucaagagaaaacuucgcacccugauucuggccccgacccgggugguugcguccgaaauggcugaggcccucaaaggcaugcccaucagauaucaaacaaccgccgugaagucugaacacacaggacgcgagaucgucgaccugaugugccaugcuaccuucacgaugcggcuucugagcccugugagaguucccaacuacaauaugauuaucauggaugaggcccacuuuacagacccugcuuccauugccgcgcggggcuauaucagcacccgcguggggaugggagaagccgcugccauuuucaugacagcuacacccccuggcucugucgaggccuuuccgcaguccaacgccgugauccaggaugaagagagagacauccccgaacggagcuggaacucuggguacgauuggauuacggacuucccuggaaaaaccgugugguuuguccccagcaucaaguccggcaacgauauugcuaauugucuccgcaaaaacgggaagagaguuauccagcugucucggaagacauucgacaccgaguaucagaaaaccaagaacaaugacugggauuacguggugaccacagacauuagcgagaugggcgcgaacuucagagccgaucgcgucaucgacccucggagaugccugaaacccgugauucucaaggauggaccggaacgcguuauccuugcuggcccuaugcccgugaccgucgccuccgccgcucagcggagagggcgcaucggacggaaucagaacaaagagggcgaccaguacguguauauggggcaaccccugaauaacgaugaagaccaugcccacuggacggaggcgaagaugcugcucgauaauauuaacacaccugagggaaucauucccgcucuguuugaaccugagagagaaaagucugccgccaucgacggcgaguaccgccuuagaggggaagcucggaaaaccuucguugagcugaugcgcagaggcgaucucccgguguggcugagcuauaaggucgccuccgagggauuucaguacagcgaccggcgcuggugcuucgauggcgaaagaaauaaccaggugcuggaggaaaauauggacgucgagauuuggaccaaagaaggggagcggaagaaacucagaccccgcuggcuugacgcgcggacauauucugauccucuggcccugagagaguuuaaggaguucgcugccggacgccgguccgugagcggcgaccucauccuggagaucgggaaacuuccccagcaccugacccucagagcucaaaacgcccuggauaaucugguuaugcuccauaacuccgaacagggaggcaaggcuuaccggcacgccauggaggaacuuccugacacaauugagacgcugaugcugcucgcgcugaucgccgugcuuaccggcggggugacacuguuuuuccucucuggaaagggccuggggaaaaccagcauuggacugcucugugucacagcuuccucugcccuucuguggauggcuagcguugagccccauuggaucgccgccuccauuauccuggaauuuuuccucauggugcugcuuaucccggagccugaucgccagagaacgccccaagacaaucaacuggcuuauguggucauuggccuccuguuuaugauccugaccguggcggccaacgaaauggggcuccuugagaccacaaagcgggaucugggaauuggccacguugcugccgagaaccaccagcaugccaccaugcuggacguggaucuccgcccugcuagcgccuggacacuguacgcggucgccaccacggugaucacacccaugaugagacacaccauugaaaauacaaccgcuaacaucucucuuaccgccauugcuaaucaggccgcgauccugaugggccucgacaaaggguggccuaucuccaagauggauauuggagucccccugcuggcccucggcugcuacagccaagugaacccgcuuacacugacggcugccguucugaugcucguggcucauuaugccaucauugggccuggacugcaggcuaaagccacccgggaggcgcagaagcgcacagccgcuggcaucaugaagaaucccaccgucgacgggauuguggccaucgaucuugaccccguuguguacgacgcuaaauucgaaaagcagcugggacaaaucaugcuccugauucuguguacaucucagauccuccuuaugagaaccacgugggcccugugcgaguccauuacacuggccaccggcccucucaccacacugugggaaggcagcccggggaaauuuuggaacaccacaaucgcggucucuauggcuaauauuuuccggggaagcuaucuugccggcgcugggcuggccuucucccucaugaagucucugggaggcgggcgcagaggaacgggcgcccagggcgagacccugggggagaaauggaagcggcagcucaaccaacuuagcaagcccgaauuuaauacauacaaaagauccggaaucauggagguggaucgcagcgaagcuaaggagggccugaaaagaggggaaaccacaaagcacgccguguccagaggaaccgcgaaacugcgcugguucguugagcggaaccucgucaagccugagggcaaggugaucgaccugggguguggaagaggcggcuggucuuauuacugcgccgggcuuaaaaaggugacggaagucaaaggauauaccaagggcgggcccggacaugaggaaccuauucccauggcuacauacggcuggaaucugguuaaacuccacagcgggaaggauguguuuuucaugccuccggagaaaugugacacccugcugugcgauaucggagaauccucucccaacccuacaauugaggagggccgcacccuccgggugcuuaagauggucgaacccuggcugagaggcaaucaguuuuguaucaagauucugaacccuuacaugcccagcgugguugagacacucgaacagaugcagcgcaaacacgggggaaugcuggugcggaauccgcuuuccagaaacucuacccaugagauguauugggucagcugcggcacggggaauaucguguccgccguuaacaugacaagccgcaugcugcucaaccgguucaccauggcucacagaaagccuaccuacgagcgcgacguggaucugggagccggcacaagacaugucgcgguggaacccgagguggccaaucuggacauuaucgggcaacggaucgaaaacauuaaaaaugagcacaagucuacguggcacuaugaugaagacaaccccuacaaaaccugggcuuaucauggauccuacgaggucaagccuagcggcucugccuccagcaugguuaauggcguggugcgccuccugacaaagcccugggaugucaucccuauggugacccagauugcuaugacagacaccacaccguuugggcagcaaagaguuuucaaagagaagguggacacccggacgcccagagccaaacggggaaccacacagaucauggaagucaccgcuaaguggcuuuggggcuuucugucucgcaacaaaaagccuagaauuuguacacgggaggaguucacccgcaaggugagauccaaugccgcgaucggggccguuuuuguggaugagaaccaguggaauagcgcuaaagaagccgucgaggacgagcgguucugggaucucgugcaccgcgaaagagagcugcauaagcagggaaaaugcgcuacgugcguuuauaacaugaugggcaagcgggagaagaaacuuggggaguuuggcaaagccaaaggaucccgcgccaucugguacauguggcugggcgcgagauuccucgaguucgaggcucugggguuuaugaaugaggaccacugguucagccgggaaaacucucugagcggaguggagggcgaagggcuccauaagcugggauacauucuucgcgauaucuccaaaauucccggcgggaauauguaugccgacgauacagccggcugggacaccagaaucacagaggaugaccugcaaaacgaggcuaagauuaccgauaucauggaaccugagcacgcccuccuggcuacgucuaucuuuaaacuuaccuaccagaauaaggucgugcggguccagcgccccgccaaaaacggaacagugauggacguuauuagcagacgggaucagagaggcuccgggcaagugggaaccuauggccugaacacauucaccaauauggaaguccagcucauccgccagauggagucugaagggauuuuucugccgagcgagcuggagacaccuaaccucgcggaacgggugcuggacuggcuugagaagcacggagccgaaagacugaagcgcauggcuaucuccggcgacgauugugugguuaaacccauugacgaucgguucgccaccgcucucacggcccugaaugacauggggaaggugagaaaagauaucccucagugggagcccucuaagggcuggaacgacuggcaacaggucccuuuuugcagccaucacuuccaucagcuuaucaugaaagauggacgcgaaauugugguucccugucggaaucaggacgagcuggugggcagagcgcgcgucucccaaggggccggauggagccuccgggagacagcuugccugggcaagucuuacgcccagauguggcagcugauguauuuucacagacgcgaucuccggcuggcugccaacgcuaucuguuccgccgugccggucgacugggugccuaccagcagaaccacauggucuauucacgcgcaucaccaauggaugaccacagaagauaugcuuuccguuuggaaucggguguggaucgaggaaaaccccuggauggaggacaagacgcaugucagcuccugggaagaggugcccuaccuggggaaaagagaggaccaguggugcggaucucucauuggccugaccgcccgcgcuacaugggccaccaauauccagguugccauuaaccaggugcggagacuuaucgggaaugaaaacuaucuggauuacaugacaagcaugaagcgcuucaaaaaugaguccgacccugaaggcgcucucugguga

SEQ ID NO: 18712 - RNA, 9879 nt, Artificial Sequence
  derived and/or modified CDS sequence (opt5) from DENV-1__FJ898448__SS-prME
agcgugaccaugcugcucaugcugcuucccaccguccugacguuccaccucaccacaagaggcggggagccucauaugaucguuuccaagcaggaacggggaaaaucucugcuuuuuaagaccagcgccggcgugaauaugugcacacugauugcuauggaccucggggagcugugugaugacaccaugacauacaaaugcccgagaaucaccgaaacggagcccgaugacguggauuguuggugcaaugccaccgaaacauggguuaccuauggaacauguucccagaccggcgagcacagacgggacaagcgcucuguggcgcuggcuccucauguugggcucggacuggagacgagaacagaaaccuggaugagcuccgagggcgccuggcggcagauucagaaaguggaaacaugggcccuucgccaccccggcuucaccgucaucgcucuguuucucgcccaugcuauugggaccucuaucacacagaagggaaucauuuucauccugcuuaugcuggugacgccuagcauggccaugagaugcguuggcauugggaaccgggauuuuguggagggacucuccggcgcgaccugggucgacguggugcuggagcacgggagcugugucacaaccauggccaaggauaaacccacacuggacaucgaacuccugaagaccgagguuacgaauccugcugugcuucgcaaacugugcauugaagccaagaucucuaacacaaccaccgauuccagauguccgacacaaggagaggcuacccucguggaagaacaagacacaaauuucgucugccggcgcacguuuguggauagaggcuggggcaacggguguggacuguucggcaaagggagccuuauuaccugcgccaaguuuaagugcguuacaaaacuggagggaaagaucgugcaguacgaaaaucucaaauauucugucaucgugaccguucacacaggcgaccagcaucaaguggggaacgagaccacggaacacggaaccauugcgacaaucacaccccaggccccuacauccgagauucagcugaccgacuacggcgcucugacgcucgauuguagcccccggacaggccuggacuucaaugaaaugguccuucugaccaugaaggagaaaucuuggcucgugcauaagcagugguuucuggaucuuccucugcccuggacauccggggccagcaccucccaagagaccuggaaccgccaggaccuccuggucacauucaaaacggcucacgccaagaagcaggaagugguugugcugggaucucaagagggcgccaugcacaccgcucucacaggggcgaccgaaauccagacaagcggaaccacgacaauuuuugccggccaucugaaaugcagacuuaagauggauaaacugacccucaaggggaucuccuaugucauguguaccggcagcuucaaacuggagaaggaaguggcugagacacagcacggaaccguucuggugcaggucaaguacgagggcacagacgccccgugcaaaaucccuuucucuucccaagaugaaaagggggugacgcagaauggacggcuugugaccgccaaccccauuguuacagacaaagagaagccugucaauaucgaagcugagccgcccuuuggcgagagcuauauuguggugggggccggagaaaaagcgcucaagcugucuugguucaagaaaggcagcuccaucgggaagauguuugaggcuaccgccagaggcgcccgccggauggcuauucugggagauacagccugggacuucggcucuaucgggggagucuuuaccagcgugggcaaacucguucaucagaucuucgggacggcuuacggagugcuguuuuccggcgucagcuggaccaugaagauugggaucggcauucuucugacauggcucggacugaacucuagauccaccagccugucuaugacauguaucgccgugggcaugguuacccuuuaccucggggugaugguccaggcggauuccggaugcgugauuaauuggaaaggccgcgaacugaagugugggagcggaaucuucguuacaaacgaggugcacaccuggacggaacaauauaaguuucaggccgacuccccuaaacggcugucugcugccauuggcaaggcuugggaggagggggucugcggcaucagaagcgccacacgccucgaaaacaucauguggaaacagauuuccaaugagcugaaccauauccuucuggaaaaugacaugaaguucaccgugguggucggagauguuucuggcauucucgcgcaggggaaaaagaccauccggccgcaacccauggagcacaaauacagcuggaaguccuggggaaaggccaaaauuaucggcgcugacgugcagaacacaaccuuuaucauugaugggccuaauacgcccgaauguccugacgaucagagagccuggaacaucugggagguggaggacuauggauucggcauuuuuacaaccaauaucuggcugaagcugcgcgauagcuacacacaggucugcgaccaccggcuuaugucugcugccauuaaagauuccaaggccgugcaugcugacaugggcuauuggaucgaaagcgagaaaaacgaaaccuggaagcucgcgagagccucuuucaucgagguuaagacauguguguggcccaaaucccacacccuguggagcaaugggguccuggaaucugagaugauuaucccgaagauuuacggaggcccuaucagccaacauaacuaucgccccggguacuucacgcagaccgcuggaccuuggcaccucggcaaacuggagcuugauuuugaccugugcgaagggacaaccgugguuguggaugagcacugcggaaaucggggccccucccucagaacaaccacggucacaggcaagauuauccaugaaugguguugccggagcuguacccugccuccccugcgcuucaaaggggaggacggaugcugguacggcauggagaucagaccggugaaggaaaaggaggaaaaccuuguuaaaucuaugguguccgccgggagcggagaggucgacuccuuuucucucggccugcuguguauuagcaucaugauugaagaggugaugcgguccagauggucucgcaagaugcucaugacagggacccugguggucuuccuucugcucacccugggacagcugacauggaaugaucuuauccggcugugcauuaugguuggcgccaacgcuagcgacaauaugggcauggggacgaccuaucucgcccugauggcgacauuuagaaugcgcccuauguucgcugugggacuccuguuuagacggcuuaccucccgcgaggugcugcuccugacagucggccugucucuuguggccagcguugaacugcccaacucccucgaugagcugggggacggacucgccaugggcaucaugauucugaaacuucugaccgauuuccaaagccaccagcucugggcuacgcugcugucucuuacauuugugaagaccacccugucccuccauuacgccuggaaaacaauggcgaugauccugagcaucgucucucuccugccccuuugucuguccaccacaagccagaagacgaccuggcugccugugcuccuggggucucuuggaugcaagccgcugacaauguuccucauuaccgaaaacaaaaucuggggcagaaaguccuggccccugaaugagggcauuauggcuguugggaucgugagcauucuccuguccagccuucugaaaaacgacgucccucuggccggaccccucaucgccggcgggaugcugaucgcuuguuaugugauuucuggaagcuccgccgaucuuucucuggaaaaggcugccaaagucagcugggaggaggaagcggagcacuccggcgccucucauaauauccucguggaaauucaggacgaugggacaaugaagaucaaagacgaggaacgggaugacaccauuacgauccugcucaaggcuacccugcuugccaucagcggaguuuacccuauguccauucccgcuacacuguuuguguggcacuucuggcaaaagaaaaagcagcgcucuggcguccugugggauaccccuagcccucccgagguggagaaagccguucucgacgacggcaucuaucgcauucugcagcgggggcuucugggacgcucccaggugggcgucgggguguuucaagaaggaguguuccacacaauguggcauguuaccagaggcgccguccucauguaccaggggaagcggcuggagcccagcugggcuucugugaaaaaggaucucaucuccuauggaggcggcuggcgcuuccaggggagcuggaacacaggagaagaggugcaggucauugcgguggagcccggcaagaauccuaaaaacguucaaacggcccccgggaccuuuaagacaucugaaggagaggugggcgcuaucgcccuggacuucaaaccggggaccuccggaagcccuauugucaauagagaaggcaagaucgugggccuuuacgggaacggaguugugaccacauccggcacguacgucucugccaucgcucaggccaaagcgagccaggaggggccccugccugaaauugaggaugagguguuucggaagagaaaucugaccaucauggaccuccaccccggauccggcaagacacgccgguaucugcccgcuauuguuagagaagccaucaaacgcaaacuucggacccuggugcucgccccuacaagagucguggcuagcgagauggccgaagcgcugaaagggaugccgauucgcuaccaaaccacggcugugaagucugagcauacaggcaaagaaaucgucgaucugaugugccacgccaccuucaccaugcggcuccuuucccccguuagagugccuaacuauaauaugaucauuauggacgaggcccauuuuacagaucccgcuagcaucgccgcucgcggauacauuucuacccgggugggcaugggggaggccgcggccaucuucaugacagcuaccccucccggaagcgucgaagccuuuccucaguccaacgcugugauucaggacgaggaaaaggauaucccggagagaucuuggaauagcggcuaugacuggaucacggauuuccccgggaagacaguuugguuugugccuuccauuaaaucuggaaacgacaucgccaauugucugcggaagaacggcaaacgcgucauucagcugagcagaaagaccuucgacacagaauaccagaagaccaagaacaaugauugggacuaugugguuacgaccgauaucuccgagaugggggccaacuuucgggcugaccgcgugauugaucccagacggugccucaagccugucauccugaaagacggccccgagagagugauucuugcgggaccgaugccugucacaguggccagcgcugcccagcgccggggcagaaucgggcgcaaucagaacaaggaaggagaucaguacaucuacaugggccaaccccugaauaacgacgaggaucacgcccacuggaccgaagcuaaaaugcuccuggacaauauuaacacacccgaggggaucauuccugcccuguucgagcccgaacgggagaagucugcggcuaucgauggagaauauagacuccgcggcgaggcccggaaaaccuucguugaacuuaugagacgcggggaccugccuguguggcuguccuacaagguggccagcgagggcuuucaguauuccgauagacgguggugcuucgacggagagcgcaauaaccagguccucgaagagaauauggacguugaaauuuggacaaaagagggcgaaagaaagaagcugcggccgcgcuggcuugaugcuagaaccuacucugacccccuggcccuccgggaguuuaaagaguucgcggccgggagacgcagcguguccggagaucugauccuggaaaucggcaagcucccucagcaucuuacgcaacgggcucagaacgcccuggacaaucuggugaugcuccacaacucugagcaagggggaaaggcuuauagacaugccauggaggaacugcccgauacaauugaaaccaucaugcuucuggcucucauugccguccugaccggcggcgugacacuguuuuuccucagcgggcgcggacuuggcaagaccuccaucgggcugcuguguguuacauccucuagcgcgcuccuguggauggccagcguggagccucacuggauugcugccucuaucauccuugaguuuuuccugaugguccuccugauucccgaaccggaccggcagagaacgccucaagauaaucagcuggcuuacguggucaucggacuccuuuuuaugauucugaccguggccgccaacgagaugggccugcucgaaacaaccaaaaaggaccuggggaucggacacgcugcggccgagaaccaucaccaugcugccaugcuugauguugaccugcaccccgccuccgcuuggacacucuaugccguggcgaccacgauuaucaccccuaugaugcggcauacaauugagaauaccacagccaacaucagccugaccgcuaucgccaaucaggcugccauucugaugggccucgauaagggcuggcccaucucuaaaauggacauuggggucccucuucuggcgcugggaugcuacagccaagugaacccccucacgcugacagccgcuguucuuaugcugguggcccacuacgcuaucauuggcccggggcuccaggccaaggcuacccgcgaagcccagaaaagaacagcggccggaaucaugaagaauccuaccgucgauggcaucguggcuauugaccuggaccccgugguuuaugaugccaaauucgagaagcagcuggggcaaaucaugcuccuuauucuguguaccucccagauccugcucaugcggacaacgugggcucugugcgaaucuauuacccuugccacaggaccccugaccacacucugggagggcagcccuggcaaguuuuggaacaccacgaucgccgucuccauggcgaauaucuuccgcgggagcuaccuggcuggagccggccuggcuuuuucccucaugaaaucucuugggggaggcagacgggggacaggagcccagggcgaaacccugggcgagaaguggaaacgccagcugaaccaacucagcaaguccgaguucaauaccuauaaaagaucugggauuaucgaaguggaccggagcgaggccaaggaaggacugaagcgcggcgagacaaccaaacacgcuguguccagagggacagccaaacuucggugguucgucgaaagaaaccugguuaaaccggagggaaaggugauugaucucggcugugggcgcggaggcuggucuuacuauugcgcgggccugaaaaaggugacggaggucaaaggguacaccaagggaggccccgggcaugaggagccuauccccauggccacauauggauggaaucuggugaagcuccacagcggcaaagacgucuuuuucauuccucccgaaaagugugauacccuucugugcgacaucggggaguccagcccuaacccgacaauugaagagggacggacccugagagugcucaaaauggucgagcccuggcugcgcggcaaucaguuuuguaucaagauccuuaacccuuacaugcccucugugguugaaacgcuggagcagaugcagcggaaacauggcgggaugcucgugagaaauccucugucccgcaacagcacccacgaaauguacugggucucuugcggaacaggcaauauuguguccgcugugaacaugaccagccggaugcugcucaacagauucacaauggcccaccgcaagcccaccuaugagcgggaugucgaccugggggcuggaacaagacauguugccguggagccggaaguggcgaaucuugauaucauuggccaacgcaucgagaacauuaagaaugaacacaaaucuaccuggcauuacgacgaggauaacccuuauaagacgugggccuaccacggguccuaugaagucaaacccagcggauccgcuagcucuauggugaauggcguugugcggcugcucacaaagcccugggacgucaucccuauggugacccagaucgccaugaccgacacaacgcccuuuggccagcaaagaguuuucaaagagaagguggauacccgcacaccuaaggcuaaaagagggaccgcccagauuauggaggucacagcuaaguggcuguggggauuucuuagccggaacaaaaagccgcgcaucuguaccagagaagaguucacacggaaagugagauccaaugccgcgauuggcgccguuuuuguggacgaaaaccaguggaacucugcuaaggaggccgucgaagaugagcgguucugggaccuggugcgcagagagcgggaacuccauaagcaggggaaaugcgcuaccugcgucuacaacaugaugggaaagcgcgagaaaaagcugggcgaauuugggaaagccaagggcagcagagccaucugguauauguggcugggagcgcgguuccucgaguuugaagcucugggcuucaugaaugaggaucacugguucucccgcgagaacucucuuagcgggguggaaggagagggccugcacaaacucggguacauucugagagacaucuccaagauccccggaggcaauauguacgccgaugacacggccgggugggauacccggauuacagaagacgaucuucaaaacgaggcuaagaucaccgacauuauggagccugaacaugcccugcucgcuacaucuaucuuuaaacugaccuaucagaauaagguugugcgcguccagagacccgccaaaaacggcacggugauggaugugauuagccggcgcgaccagagaggauccggccaaguugggacauacggacugaacaccuucacaaauauggaggcgcagcucauccggcagauggaaagcgagggcaucuuuucuccuuccgaacuggagacccccaaccuugccgggcgcgugcuggacuggcucgagaagcacggaacggaaagacugcggagaauggcuauuagcggcgaugacugugucgugaaaccgaucgaugaccgcuucgccaccgcucuuacagcccugaaugauauggggaagguucggaaggacauuccucagugggagcccucuaaaggcuggaacgauuggcaacaggugccuuuuugcucccaucacuuccaccagcucaucaugaaggacggaagagaaauugucgugcccugucgcaaucaggaugagcuggucggccgggcgagagugagccaaggggccggauggucccugcgcgaaaccgcuugccucggcaaaucuuaugcccagauguggcagcugauguacuuucaucggagagaccuucgccuggcugccaacgcuaucuguagcgccguuccuguggauuggguccccacaucccggaccacauggagcauucacgcgcaucaccaauggaugaccacggaggacaugcucucuguguggaauagaguuuggaucgaggaaaacccguggauggaggacaagacacauguguccagcugggaagaugucccuuaucuggggaaacgcgaggaccaguggugcggaucucuuaucggccugaccgcccgggcuaccugggccacaaauauucagguggccaucaaccaggugagacggcucauugggaaugaaaacuaccuggauuauaugaccagcaugaagagauucaagaaugaguccgaccccgagggcgcucugugguga

SEQ ID NO: 18713 - RNA, 9879 nt, Artificial Sequence
  derived and/or modified CDS sequence (opt5) from DENV-1__GQ868602__SS-prME
agcgugaccaugcugcuuaugcugcuucccacagcccuggcuuuccaccucacgacccggggcggggaaccucauaugaucguguccaagcaggaacggggaaagucucugcuuuuuaagacaagcgccggcguuaacaugugcacccugauugcgauggaccucggggaacugugugaagauacaaugaccuacaaaugcccccgcaucacagagaccgaacccgacgauguggacuguuggugcaaugcuacggagaccugggugacauauggaaccuguucccaaacaggcgagcacagacgggauaagcgcucugucgcccuggccccucauguggggcucggacuggaaaccagaacggagacauggaugagcuccgaaggcgcuuggcggcagauucagaaaguugagaccugggcccuucgccaccccggcuucacagugaucgcucuguuucucgcccaugcgauugggaccucuaucacccagaagggaaucauuuucauccugcuuaugcuggucacaccuagcauggccaugagaugcgugggcauugggaaccgggacuuuguugagggacucuccggcgcuacguggguggaugucgugcuggaacacgggagcugugugaccacaauggccaaggacaaacccacccuggauaucgagcuccugaagacagaagucaccaauccugcuguucuucgcaaacugugcauugaggccaagaucucuaacacgacaaccgacuccagauguccgacccaaggagaagcgacacucguggaggagcaggauaccaauuucgugugccggcgcacauuugucgacagaggcuggggcaacggguguggacuguucggcaaagggagccuuauuacgugcgccaaguuuaagugcgugaccaaacuggaaggaaagaucguucaguacgagaaucucaaauauucugugaucgucacagugcacaccggcgaucagcaucaaguugggaacgaaacaaccgagcacggaacgaccgcuacaauuacaccccaggccccuacauccgaaauccagcugaccgacuacggcgcucugacgcucgacuguagcccccggacaggccuggauuucaaugagauggugcuucugaccaugaaggagaaaucuuggcucguccauaagcagugguuucuggaccuuccucugcccuggacauccggggccagcaccucccaagaaaccuggaaccgccaggaucuccuggugacauucaaaacggcccacgcuaagaagcaggaggucgugguucugggaucucaagaaggcgcgaugcacaccgcccucacaggggcuaccgagauucagacaagcggaaccacgacaaucuuugccggccaucugaaaugcagacuuaagauggacaaacugacccucaaggggguguccuaugucauguguaccggcagcuucaaacuggaaaaggagguggccgagacacagcacggaaccguucuggugcaggucaaguacgaaggcacagaugcuccgugcaaaauuccuuucucuucccaagacgagaagggggugacgcagaauggacggcuuaucaccgccaaccccaucgugacagauaaagaaaagccuguuaauauugaggcggagccgcccuuuggcgaaagcuaucucgucgugggggcuggagagaaagcccugaagcugucuugguucaagaaaggcagcuccaucgggaagauguuugaagccaccgcuagaggcgcccgccggauggcuauucucggagacacagccugggauuucggcucuaucgggggaguguuuaccagcgucggcaaacugauucaucagaucuucgggacggcguacggagugcucuuuuccggcguuagcuggaccaugaagaucgggauuggcauccugcucacauggcugggacugaacucuagauccaccagccuuucuaugacauguauugccgugggcauggucacccucuaccugggggugaugguucaggcugacuccggaugcgugaucaauuggaaaggccgcgagcugaagugugggagcggaauuuucgucacaaacgaagugcacaccuggacggagcaauauaaguuucaggccgauuccccuaaacggcucucugcugccaucggcaaggcgugggaggaagggguuugcggcauuagaagcgccacacgccuggagaacaucauguggaaacagaucuccaaugaacuuaaccauauucugcucgagaaugacaugaaguucaccguggucgugggagacgugaacggcguccuggcucaggggaaaaagaugauccggccgcaacccauggaacacaaauacucuuggaaaagcuggggaaaggccaaaguuauuggcgcugaugugcagaauaucaccuuuauuaucgacgggccuaacacacccgaguguccugaugaccagagagccuggaauaucugggagguggaagauuauggauucggcauuuuuaccacgaacaucuggcugaaacuucgcgacuccuacacacaggucugcgaucaccggcucaugagcgccgcuauuaaagacucuaaggcggugcaugccgauaugggcuauuggaucgaguccgagaagaaugagaccuggaagcugacaagagcuagcuucauugaaguuaagaccuguaucuggcccaaaucucacacacugugguccaacggggugcucgagagcgagaugaucauuccgaagaucuacggaggcccuauuucucaacauaauuaucgccccggguacuucacccagacggccggaccuuggcaccugggcaaacuugaacuggacuuugggcucugcgagggaaccacagucgugguugaugaacacugcggcaaccggggccccagccugagaaccacaaccgugacggggaagaucauucaugagugguguugccgguccuguacacugccuccccuucgcuucaaaggagaggacggcugcugguacgggauggaaaucagaccggucaaggagaaggaagagaaucucgugaaaagcaugguuucugccggauccggcgaaguggauagcuuuucccuggggcugcucuguaucucuauuaugaucgaggaggucaugcggagcagauggucccgcaagaugcugaugaccggaacacuugcuguguuccugcuccugauuaugggccagcugaccuggaacgaccuuauccggcugugcauuauggugggcgccaaugcgucugacaaaauggggaugggaaccacauaucucgcucugauggccacguuuagaaugcgcccuauguucgccgucggccuccuguuuagacggcuuaccagccgcgaaguucugcuccugacaguggggcugucccuuguggcuucugucgagcugcccaacagccucgaagaacugggagauggccucgccauggggaucaugaugcugaaacuucugaccgacuuccaaucccaccagcucugggcgacacugcugagccuuaccuuugugaaaacgacauucucucugcauuacgcuuggaagaccauggccaugauucucuccaucguuagccuguuuccccucugucugucuaccacaucccagaagaccacauggcuuccugugcugcugggaagccucggcugcaaaccgcugacgauguuccuuaucaccgaaaacaagauuuggggcagaaaaucuuggccccugaaugaggggaucauggccgucggaauuguguccauccuccugagcucccuccugaagaacgauguuccucuugcuggcccccugauugccgggggaaugcugaucgcuuguuaugugaucagcggcucuagcgccgaccucucccuggagaaagcggccgaagucucuugggaggaagaggcugaacacagcggggccucccauaauauucuuguggagguccaggaugacggaacaaugaagaucaaagaugaggaacgggacgauacccugacaauucuccugaaggcuacccuccuggccaucucuggcguguacccuaugagcauucccgccacgcuuuuuguuugguauuucuggcaaaagaaaaagcagcgcuccggcgugcugugggacaccccuucucccccggaggucgaaagagcugugcuggaugacgggaucuaccggauccuccagcgcggacugcuuggcaaaagccagguuggggugggagucuuccaagagggcguguuucacacaauguggcacgugaccagaggggcgguucugauguaucagggaaagcggcucgagccuuccugggccagcgucaaaaaggaucugauuucuuacggcggcggguggcgcuuccagggauccuggaacaugggcgaagagguccaggugaucgcugucgaacccgggaagaauccuaaaaacgugcaaacagcccccggaaccuuuaagacaccggagggcgaaguuggggccauugcucucgacuucaaaccuggaacgagcggcucucccaucgugaauagagagggcaagauugucgggcuguacggaaacggcgugguuaccacauccgggaccuaugugagcgccaucgcgcaggcuaaagccucccaggagggaccucuucccgaaauugaggacgaagucuuucggaagagaaaucugaccaucauggaucugcaucccggcucugggaagacacgccgguaccucccugccaucgugagagaggcuauuaaacgcaagcugcggacgcuuguucuggccccgaccagaguggucgcgagcgaaauggcugaggcccucaaaggcaugcccauccgcuaucaaacaaccgccgugaaguccgagcacacaggaaaagaaauuguggaccugaugugccaugcuaccuucacgaugcggcugcucagcccugucagaguucccaacuacaauaugaucauuauggaugaggcccacuuuacagacccugcuucuaucgccgcgcgcggcuauaucuccacccggguggggaugggagaagccgcugccauuuucaugaccgcuacacccccuggcagcauggaggccuuuccgcagucuaacgccgcuauccaggaugaagagagagacauucccgagcggagcuggaacuccggguacgauuggaucaccgacuucccuggaaagacagugugguuuguccccucuauuaagagcggcaacgauaucgcgaauugucuucgcaaaaacgggaagagagugguucagcugucccggaaaaccuucgacacggaauaucaaaagaccaagaauaaugauugggacuacguggucaccacagacaucucugagaugggcgccaacuuccgcgcugauagagugauugacccucggagaugccugaagcccguuauccucaaggauggaccggaacgcgugauucuggccggcccuaugcccgucaccguggccagcgcugcccagcggagagggcgcaucggacggaaucagaacaaagagggcgaccaguacauuuauauggggcaaccccuuaauaacgaugaggaccaugcgcacuggacggaagcuaagaugcugcucgauaauaucaacaccccugagggaauuauccccgcccuguuugaaccugagagagaaaaauccgccgcuaucgacggcgaguaccgccugagaggggaagcccggaagacauucgucgaacucaugcgcagaggcgaucuuccgguguggcugagcuauaaaguugcgucugagggauuucaguacuccgaccggcgcuggugcuucgauggcgaaagaaauaaccaggugcugcucaagaauauggacguggagauuuggaccaaagaaggggagcggaagaagcugcgccccagauggcuugaugcccggacauauagcgacccucuggcucucagagaguuuaaagaguucgccgcuggacgccgguccgucucuggcgaccugauccuggagauugggaagcucccccagcaccuuacccaaagagcccagaacgcucuggauaaucugguuaugcuccauaacagcgaacagggaggcaaagccuaccgccacgcgauggaggaacugccugacacaaucgagacccuuaugcugcucgcccugauugcugugcugacgggcggggugacacucuuuuuccuuuccggacggggccuggggaagaccucuaucggacugcucugugucauggccagcuccgcucugcuuuggauggccagcguggagccccauuggaucgccgcuucuauuauccuggaauuuuuccucaugguucugcugauuccggagccugauagacagcggacaccccaagacaaucagcucgcguauguggucaucggccuucuguuuaugauucugacaguggccgcuaacgaaauggggcuccuggagaccaccaagaaggaucuuggaaucggccacgucgccgccgagucccaccaucacgcugccaugcuggacguggaucuccauccugcgagcgccuggacgcuguacgcuguugccaccacaaucauuacccccaugaugcgccacacaaucgaaaacaccacggcuaauauuucucugaccgccaucgcgaaccaggccgcuauucucaugggccuugacaagggguggccuaucuccaaaauggauauuggagugccccugcuggcccucggcugcuacagccaagucaauccgcugacacuuaccgcugccgugcugaugcucguugcucauuaugccaucaucgggccuggacugcaggcgaaggccacaagagaggcucagaaacggaccgccgcuggcauuaugaagaaccccacgguggacgggaucgucgccauugaucuggaccccgugguguacgaugccaaauucgaaaagcagcucggacaaaucaugcuucugauucuguguacaucucagauccuccugaugcgcaccacaugggcgcuuugcgagagcaucacccuggcuaccggcccucucacaacgcugugggaaggcuccccggggaaguuuuggaauaccacaauugccguuucuauggcuaacaucuucagaggaagcuaucuggccggcgccgggcucgcuuucucccuuaugaaaagccugggaggcgggcggcgcggaaccggcgcccagggcgagacacugggggagaaguggaaaagacagcucaaucaacuguccaagucugaauuuaacaccuacaaacggagcggaauuaucgaggucgaccgcuccgaagcgaaggagggccuuaagagaggggaaacgacaaaacacgccgugucucggggaaccgcuaagcugagaugguucguggagcgcaaucucgucaaacccgagggcaagguuauugaccugggguguggacggggcggcuggagcuauuacugcgccgggcugaaaaaggugaccgaagugaaaggauauacaaagggcgggccuggacacgaggaacccaucccuauggcuaccuacggcuggaaccucgucaaacuuuacuccgggaaagauguguuuuucacacccccugagaagugugacacgcugcugugcgauaucggagaaucuagcccgaaucccaccauugaggagggcagaacacuccgcguucugaaaaugguggaaccuuggcuucggggcaaccaguuuuguaucaagguccugaaucccuauaugccuuccgugguugagacccucgaacagaugcagagaaaacaugggggaaugcuggugcgcaacccccugagcagaaauucuacacacgagauguacugggucuccugcggcaccgggaacauugugagcgccgugaauaugacgucuagaaugcuccugaaccgcuucaccauggcgcaucggaagccgacauaugagagagacgucgaucuuggagccggcacccgcaacguugcuguggaaccugagguggccaaucuggacaucauugggcaacggaucgaaaacauuaagaaugagcacaaauccacauggcacuacgaugaagacaaccccuauaagaccugggcuuaccauggaagcuaugaggucaaacccucuggcuccgccagcuccauggugaauggcguugugagacuccugacaaagccuugggaugucauccccauggugacccagaucgcuaugacggacacaaccccuuuugggcagcaacgcguuuucaaagagaagguggauaccagaacaccgaaggccaaacggggaacggcgcagauuauggaagucaccgcccgcuggcuuuggggcuuucugagcagaaacaagaaaccccggaucuguacaagagaggaguucacccggaaggugcgcucuaaugcugccauuggggcuguuuuuaucgacgagaaccaguggaauagcgccaaagaagccguggaggacgagagauucugggaucucguccaccgggaacgcgagcugcauaagcagggaaagugcgcgacaugcguguacaacaugaugggcaaaagagaaaagaaacugggggaguuuggcaaggcuaaaggaucccgggccauuugguacauguggcucggcgcccgcuuccuggaguucgaggcucuuggguuuaugaaugaggaccacugguucucuagagaaaacagccuguccggagucgagggcgaagggcuccauaagcugggauauauccuucgggauaucucuaaaauuccuggcgggaauauguacgccgacgauaccgcuggcugggacacacgcaucaccgaggaugaccugcaaaacgaggccaagauuacggauaucauggaacccgagcacgcgcuccuggccaccagcauuuuuaagcugacauaucagaauaaagugguuagagugcagcggccugcuaagaacggaaccgucauggacgugaucucccgcagagaucagcggggcucugggcaagugggaacauacggccucaacaccuucacgaauauggaagcccagcugauccgccagauggagagcgaagggauuuuucuucccuccgagcuggagacaccgaaccucgcugaaagaguucuggacuggcuugagaaacacggaaucgaacggcugaagagaauggccauuagcggcgaugacuguguggucaaaccuaucgacgaucgcuucgcgaccgcccucacagcucugaaugacauggggaaggugcggaaggauauuccccagugggagccuucuaaaggcuggaacgacuggcaacagguucccuuuugcucccaucacuuccaucagcugaucaugaaggauggaagagaaaucguggucccuugucgcaaucaggacgagcucgugggccgggccagagucagccaaggggcuggauggucucugcgcgagaccgccugccuuggcaaauccuaugcucagauguggcagcugauguacuuucaccggagagaucuccgccuggccgcgaacgccauuuguagcgcugugcccguugacugggugccgacgucccggaccacauggucuauccacgcccaucaccaauggaugaccacagaagauaugcuuagcgucuggaauagaguguggauugaggaaaacccuuggauggaggacaagacccauguuuccagcugggaagaugugcccuaucuggggaaacgcgaggaccaguggugcggaucucucaucggccugacagcccgggcuaccugggccacgaauauucaggucgcgaucaaccaggugagacggcugauugggaaugagaacuaccucgacuacaugacauccaugaagagauucaagaaugaaaacgaucccgagggcgcucugugguga

SEQ ID NO: 18714 - RNA, 9879 nt, Artificial Sequence
  derived and/or modified CDS sequence (opt5) from DENV-1__KF921911__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcguuggcauuaacaugugcacccugaucgccauggaccucggggagcugugugaagauacaaugaccuacaaaugccccagaauuacagaggcggaacccgacgauguggacuguuggugcaaugcuaccgauacgugggugaccuauggaacauguucccaaaccggcgagcacagacgggacaagcgcucugucgcccuggccccucauguggggcucggacuggagacaagaaccgaaacguggaugagcuccgagggcgcuuggaaacagauccagaagguugaaacaugggcccuucggcaccccggcuucaccgugacagcucuguuucucgcccaugcgauugggaccucuaucacccagaagggaaucauuuucauccugcuuaugcuggucacaccuagcauggccaugcgcugcgugggcauugggaacagagauuuuguugagggacucuccggcgcuacguggguggacgucgugcuggagcacgggagcugugugaccacaauggccaaagauaagcccacccuggacaucgaacuccugaaaacagaggucaccaauccugcuguucuucggaagcugugcauugaagccaaaaucucuaacacgacaaccgauucccgcuguccgacccaaggagaggcgacacucguggaggaacaggacagcaauuucgugugcagacggaccuuugucgaucgcggcuggggcaacggguguggacuguucggcaaggggucucuucugacaugcgccaaguuuaaaugcgugacgaagcucgagggaaaaauuguucaguacgaaaaucugaaguauuccgugaucgucaccgugcacacaggcgaccagcaucaaguugggaacgagaccacagaacacggaaccaucgcuacgauuacaccccaggccccuacaagcgagauccagcugaccgacuacggcgcucucacacuggauuguucucccagaaccggccuugacuucaaugaaauggugcugcucacgaugaaagagaaguccuggcugguccauaaacagugguuucuugaucugccucuccccuggacaagcggggccuccaccucucaagagacauggaaccggcaggaccugcuggugaccuucaagaccgcccacgcuaagaaacaggaagucgugguucucggaagccaagagggcgcgaugcacacagcccugacgggggcuaccgaaauucagacauccggaaccacaaccaucuuugccggccaucuuaagugccgccugaaaauggauaagcucacgcugaaagggaugagcuaugugauguguacaggcucuuucaagcuggagaaggaagucgccgagacccagcacggaaccgugcuuguucaggugaaauacgagggcacagacgcuccgugcaagauuccuuucuccgcccaagaugaaaaaggggucacccagaauggaagacucaucacagcgaaccccaucgugacggacaaggagaaaccugugaauauugaaaccgagccgcccuuuggcgagagcuauaucguuauuggggcuggagaaaaggcccugaagcugucuugguucaaaaagggcagcuccaucgggaaaauguuugaggccacagcucggggcgccagacgcauggcuauucucggagauaccgccugggacuucggcucuaucgggggagucuuuacaagcgugggcaagcuggugcaucaggucuucggggcggccuacggagugcucuuuuccggcguuagcuggaccaugaaaaucgggauuggcauccugcucacguggcugggacugaacucucgguccaccagccuuucuaugacauguauugcugugggcauggucacccucuaccugggggugaugguucaggccgauuccggaugcgugaucaauuggaagggcagagaacugaagugugggagcggaauuuucgucacaaacgaggugcacaccuggacagaacaauauaaauuucaggcugacuccccuaagcgccucucugccgcgaucggcaaagccugggaggaggggguuugcggcauucggagcgcuaccagacuggaaaacaucauguggaagcagaucuccaaugagcuuaaccauauucugcucgaaaaugacaugaaauucacgguggucgugggagaugccaacggcauccuggcucaggggaagaaaaugauucgcccgcaacccauggagcaccgguacucuuggaaaagcuggggaaaggccaagaucauuggcgccgacauccagaauacaaccuuuaucauugaugggccugacacccccgaauguccugaugaccagagagcuuggaacaucugggagguggaggauuauggauucggcauuuuuacaaccaauaucuggcugaaacuucgcgacuccuacacgcagaugugcgaucaccggcucaugagcgcggccauuaaagacucuaaggcuguccaugccgauaugggcuauuggaucgaauccgagaaaaacgaaacauggaagcuggccagagcuagcuucaucgagguuaagaccuguauuuggcccaaaucucacacacugugguccaauggggugcucgaaagcgagaugaucauuccgaagaucuacggaggcccuauuucucaacauaacuaucgccccggguacuucacccagacagccggaccuuggcaccugggcaaacuugagcuggacuuugaucucugcgaagggaccacgguggucguggacgagcacugcggaaaucggggccccagccugagaaccacaaccguuacaggcaagaucauccaugaaugguguugccgguccuguacccugccuccccuucgcuucagaggggaggacggaugcugguacggcauggagauucggccggugaaagaaaaggaggaaaaccucgucagaagcauggugucugcgggguccggagagguugauagcuuuucccugggcauccugugugugucuauuaugaucgaagaggucaugcgcagccgguggaauagaaagaugcucaugacggggacacuggcuguguuccuucugcucauuaugggacagcugaccuggaacgaccugauccgccuuugcauuaugguuggcgccaaugccuccgauagaaugggcauggggacaaccuaucuggcucucauggccaccuuuaaaaugcggccuauguucgcggugggacugcucuuucgcagacugacaucucgggagguccuucugcucacgaucggccugagccugguggcuuccguggaacuucccaacucucuggaggaacucggggacggacuggccaugggcaucaugaugcucaagcugcuuaccgaguuccaaccccaccagcuguggacaacccuccugagccugacauuuauuaaaaccacgcuuucccuggauuacgccuggcgcacaauggcuaugguccucagcaucguuucucuguucccucucugucuguccaccaccagccagaagacaaccuggcuuccggugcugcuggggucuuuuggaugcaaaccccucacaauguuccugauuacggaaaacaagaucuggggcagaaaguccuggccucuuaaugagggcauuauggccaucgggaucgugagcauucugcucucuucccugcucaaaaacgacgucccccuggcuggaccucuuaucgccggcgggaugcugauugcguguuaugugaucagcggauccagcgccgaucugucucucgagaaggcugccgaaguuagcugggaggaagaggcugaacauuccggcaccucucacaauauucugguggagguccaggacgaugggacaaugaaaaucaaggacgaggaacgggaugacacccuuacaauccugcucaaagccacccugcucgccgugagcggaguuuaccccauguccauuccugcuacgcuguuugugugguauuucuggcaaaagaaaaagcagcgcucuggcguccuuugggauacccccagcccgccugagguggaaagagcgguccuggacgacggcaucuaccggauucugcagcgcgggcuccugggaagaucccaggugggcguugggguguuccaagauggagucuuucauacaauguggcacgugacccggggcgccguucuuauguaucaggggaagagacuggagcccucuugggcuagcgugaaaaaggaccucaucuccuacggaggcggcuggcgcuuccaggggagcuggaacacaggagaggaaguccaggugauugccguggagccuggcaaaaaucccaagaacguucaaaccacaccggggacguuuaaaaccccugaaggagaggucggcgccaucgcucuggauuucaagcccgggacaucuggauccccuauugugaaucgggaaggcaagaucgugagccucuacggcaacggggucgugaccaccucuggaacauauguuuccgccaucgcgcaggcuaaaacgagccaggagggcccccugcccgagauugaagacgagguguuuaagaaaagaaaucuuaccaucauggaucugcacccuggguccggaaagacacgccgguaccugccggccauugucagagaagccaucaaacgcaagcuccggacccugauucuugcucccacaagagugguugccucugagauggcggaagcucugaagggcaugccuauccgcuaucaaaccacggccgugaaaagcgagcauacagggcgggagaucgucgaccucaugugccacgccaccuucaccaugagacugcugucccccgugcggguuccuaacuacaauaugauuaucauggaugaagcucauuuuacagaccccgccagcauugcugcccgcggcuauaucucuaccagagugggaaugggcgaggcggccgcuauuuucaugacagccaccccuccgggguccgucgaggcuuuuccccagagcaacgccgugauccaggaugaggaacgggacaucccugagcgcucuuggaauagcggauacgauuggauuacggacuuccccggcaagacagugugguuugucccuuccaucaaaucugggaacgacauugccaauugucucagaaagaacggaaaacggguuauccagcuuagcagaaagaccuucgauacagaguaucaaaagaccaaaaacaaugacugggauuacguggugacgaccgacauuuccgaaaugggcgcuaacuuccgcgcggaucgggucaucgaccccagacgcugccugaagccggugauucugaaagaugggccugagcggguuauccucgccggccccaugcccgugacagucgcuucugccgcccagagacgcggacggaucggcagaaaucagaacaaggaaggggaccaguacguguauaugggacaaccucugaauaacgaugaggaccacgcucauuggaccgaggccaaaaugcuucuggauaauauuaacacacccgaaggcaucauuccugcgcucuuugagccggaacgcgaaaagagcgcugccaucgacggggaauacagacugcggggagaggcccgcaagaccuucguugagcugaugagacggggcgaucuccccguguggcuuuccuauaaagucgcuagcgaaggguuucaguacucugaccgcagauggugcuucgacggcgagcggaauaaccaggugcuggaagagaauauggaugucgaaauuuggacaaaggagggagagcgcaagaagcugcgcccucgguggcucgacgccagaaccuauuccgauccccuggcgcuucgcgaauuuaaagaguucgccgcuggccggagaagcguguccggggaccugauccucgaaaucggaaagcugccucagcaccugacgcuccgggcccaaaacgcucuugauaaucugguuaugcugcacaacucugagcagggcgggaaagccuaccgccaugcuauggaagaacuucccgacacaauugagacccugaugcuucuggcccucaucgcggugcugaccggaggcgugacacuguuuuuccucagcggcaaggggcuuggaaagaccuccauuggccugcugugugucauggccucuagcgcucuccuguggauggccaauguugaaccgcacuggaucgcugccuccauuauccuugaguuuuuccugauggugcuccugaucccugaacccgauagacagcggacaccucaggacaaccaacuggccuauguggucauugggcuccuuuuuaugauccugacgguggcugcgaacgagaugggacugcucgagaccaccaagaaggaucugggcauugggcauguugccgcugaaaaucagcaccacgccaccaugcuugacguggaucugcgccccgccagcgcuuggacacucuacgccgucgcgaccacggugaucaccccuaugaugagacauacaauugagaacaccacagccaauaucucucugaccgcuauugccaaccaggcugccauccugaugggacucgacaaaggcuggcccaucuccaagauggauauuggcgucccgcuucuggcgcuggggugcuacagccaagugaauccucucacgcugacagccgcuguucuuaugcugguggcccacuaugcuaucauuggacccggccuccaggccaaagcuacccgggaagcccagaagcgcacagcggccgggaucaugaagaaccccaccgucgacggaauuguggcuaucgaccuggauccuguuguguacgacgccaaauucgagaagcagcugggccaaaucaugcuccuuauucuguguaccucucagauccugcucaugagaacaacgugggcucugugcgaauccauuacccuugccacagggccgcugaccacacucugggagggaagccccggcaaauuuuggaauaccacgaucgccgucucuauggcgaacauuuuccggggcagcuaucuggcuggggccggacuggcuuucucccucaugaagucucuuggcgggggacgcagaggcacaggggcccagggagagacccugggcgaaaaauggaagcggcagcugaaucaacucagcaaguccgaguuuaacaccuacaaaagaagcggcaucauggaaguggaucgcuccgaggccaaggaagggcugaaacggggagagacaaccaagcaugcugugucuagaggcacagccaaacuucgcugguucguugagcggaaucuggucaagccugaagggaaggugaucgaccucggauguggcagagggggauggagcuauuacugcgcgggccugaaaaaggugacggaggucaaaggcuauaccaaagggggacccggccacgaggagccuauucccauggccacauacggguggaaccugguuaaacucuacuccggaaaggauguguuuuucaccccuccggaaaaaugugacacacuucugugcgauaucggcgagucuagccccaauccuaccauugaggaagggcgcacgcugcgggugcucaagauggucgagcccuggcugagaggaaaccaguuuuguaucaagauucuuaauccuuauaugcccuccgugguugaaacccuggagcagaugcagcgcaaacauggcggcaugcucgugcggaacccgcugucuagaaauagcacacacgagauguacugggucuccugcgggaccggaaacaucgugagcgcuguuaacaugacaucucgcaugcugcucaaucgguucaccauggcccacagaaagccuacauaugaacgcgacguggaucugggcgcugggaccagacaugucgccguggagcccgaaguggcgaaccuugacauuaucggacaacggaucgagaauauuaaaaacgaacacaaguccacguggcauuacgaugaggacaaucccuauaaaacaugggccuaccacggcagcuaugaggucaagccuucuggguccgcuagcucuaugguuaacggaguggugcgccugcucaccaagcccugggacgucaucccuauggugacccagauugccaugacagauacgaccccguuuggccagcaaagaguuuucaaagaaaagguggacacacggacccccagagcuaaacggggcacagcccagaucauggaggucaccgcuaaguggcuguggggguuucuuucccgcaauaaaaagccuagaauuuguacacgggaagaguucacccgcaaggugagaagcaacgccgcgaucggagccguuuuuguggaugaaaaucaguggaacuccgcuaaagaggccgucgaggacgaacgguucugggaucugguguaccgcgagagagaacuccacaagcagggcaaaugcgcuacgugcguuuacaauaugauggggaagcgggagaaaaagcugggagaauuuggcaaggccaaagggagccgcgccaucugguauauguggcugggcgcgagauuccucgaguucgaggcucugggauuuaugaacgaagaccauugguucucucgggagaauagcuuuuccggcguggaaggggagggacuucacaagcugggcuacauucuccgcgauaucucuaaaauucccgggggaaacauguaugccgacgauaccgccggcugggacacaagaaucaccgaggaugaccugcaaaaugaagcuaagauuacagauaucauggagccugaacaugcccuucuggcuaccagcaucuucaaacucacguaccagaacaaggucgugcggguccagcgccccgccaaaaacgggacagugauggacguuauuuccagacgggaccagagaggcucuggacaagugggcaccuaugggcugaauacauuuaccaacauggagguccagcugauccgccagauggaaagcgagggaauuuuccucccguccgagcuggaaacgccuaaucuugcggagcgggugcuggauuggcucgaaaagcacggcaccgagagacugaagcgcauggccaucucuggggacgauugugugguuaaacccguggacgaucgguuugcuacagcccuuauugcucugaacgacaugggaaaggucagaaaagauaucccucagugggaacccagcaagggcuggaaugacuggcaacaggugccuuucugcucccaucacuuucaccagcucaucaugaaagaugggcgcgagauuguugugcccugucggaaccaggacgagcuggucggcagagcccgcgugagccaaggagcgggcuggucucugcgggaaaccgccugccucgggaaguccuacgcucagauguggcagcugauguauuuccauagacgcgaucuucggcuggccgcuaaugccaucuguagcgcugucccgguggacuggguuccuacaucuagaaccacaugguccauucacgcccaucaccaauggaugaccacggaggacaugcucagcguguggaaccgggucuggaucgaagagaaucccuggauggaagauaagacacacguguccucuugggaggagguucccuaccugggaaaaagagaagaccaguggugcggcagccuuauugggcugaccgcgcgcgccaccugggcuacaaacauccagguggccauuaaucagguccggagacucaucggaaacgagaauuaccuggauuauaugaccuccaugaagcgcuuuaaaaacgaaagcgacccugagggcgcccugugguga

SEQ ID NO: 18715 - RNA, 9879 nt, Artificial Sequence
  derived and/or modified CDS sequence (opt5) from DENV-1__KJ189350__SS-prME
agcgugaccaugcugcucaugcugcuucccaccgcccuggcuuuccaccucacgacccggggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccaaaacggcgagcacagacgggagaagcgcucugucgcccuggcuccucauguggggcucggacuggaaaccagaacagagaccuggaugagcuccgaaggcgccuggaaacagauucagcggguugagacgugggcucuuagacaccccggcuucacagugaucgccuuuuuccuggcgcaugccauugggaccucuaucacacagaagggaaucauuuuuauccuccugaugcuugucaccccuagcauggcuaugagaugcgugggcauugggaaucgggacuucguugagggacuguccggcgccaccuggguggaugucgugcucgaacacgggagcugugugacaacgauggcuaagaacaaacccacccuggacaucgagcugcucaagacagaagucaccaauccugccguucugcgcaaacuuugcauugaggcgaagaucucuaacacaaccacggauuccagauguccgacacaaggagaagccacccugguggaggagcaggacgcuaauuuugugugccggcgcaccuucgucgauagaggcuggggcaacggguguggacucuuuggcaaagggagccugcuuacaugcgccaaguucaagugcgugaccaaacuggaaggaaagauuguucaguacgagaaucucaaauauucugugaucgucacagugcacacgggcgaccagcaucaaguugggaacgaaaccacagagcacggaaccaucgcuacaauuacaccccaggccccuacguccgaaauccagcugaccgauuacggcgcccugacacucgacuguagcccccggaccggccuggacuuuaaugagauggugcuucugacaaugaaggagaaaucuuggcucguccauaagcagugguuccuggaucuuccucugcccuggaccuccggggcuagcacgucccaagaaacauggaaccgccaggaccuccuggugaccuuuaaaacagcgcacgccaagaagcaggaggucgugguucugggaucucaagaaggcgcuaugcacaccgcccucaccggggccacagagauucagacgagcggaaccacaaccaucuucgcuggccaucugaaaugcagacuuaagauggauaaacugacacucaaggggauguccuaugugauguguaccggcagcuucaaacuggaaaaggaggucgccgagacgcagcacggaacagugcugguucaggugaaguacgaaggcaccgacgcgccgugcaaaauuccuuuuucuacccaagaugagaagggggucacacagaauggacggcuuaucaccgcuaaccccaucgugacagacaaagaaaagccugugaauauugagacggagccgcccuucggcgaauccuauaucguugucggggccggagagaaagcccucaagcugagcugguuuaagagaggcucuagcauugggaaaauguucgaagcuaccgcccgcggcgcucggagaauggccauccugggagauacagcgugggacuuuggcuccauugggggaguguucaccucugugggcaagcucguccaucagaucuuugggacagccuacggagugcuguucagcggcguuuccuggaccaugaaaaucgggauuggcauccuucugacguggcucggacugaacagccgcucuaccucccugagcaugacauguauugcugugggcauggucacccuuuaccucggggugaugguucaggccgauucuggaugcgugaucaacuggaagggccgggagcugaaauguggguccggaauuuuugucacaaaugaagugcacaccuggacagagcaauauaaguuccaggcugacagcccuaagagacuguccgccgcgaucggcaaagccugggaggaagggguuugcggcauucgcucugcuacccggcucgagaacaucauguggaagcagaucagcaaugaacugaaccauauucuucuggagaaugauaugaaauuuacgguggucgugggagacgccaacggcauccucgcucaggggaagaaaaugauuagaccgcaacccauggaacacaaguacuccuggaaaucuuggggaaaggccaagaucauuggcgccgacauccagaauacaaccuucaucauugaugggccugacacccccgaguguccugauggacagcgcgcuuggaacaucugggagguggaagacuauggcuuuggcgucuucacaaccaauauuuggcugaaacugcgggauagcuacacgcagaugugcgaccacagacuuauguccgcggccaucaaggauagcaaagcuguucaugccgacaugggguauuggauugagucugaaaagaacgagacauggaaacucgcccgcgcuuccuucaucgaagugaagaccuguacauggcccaagagccacacccuguggucuaauggagugcuggaguccgagaugaucauuccgaaaaucuacggcgggccuauuagccaacauaacuaucggcccggauacuuuacacagaccgccggcccuuggcaccucgggaagcuggaacuugauuucgaccugugcgagggaacgaccgucgugguugaugaacacugcggcaauagaggccccucucuccggacaaccacagugaccgggaaaaucauucaugagugguguugccgcagcuguacgcugccuccccugagauuucggggagaggacggcugcugguacgggauggaaaucagaccggucaaggagaaagaagagaaccuugugcgcuccaugguuagcgcgggaucuggcgaaguggauuccuucagccucgggauccugugugucuccauuaugaucgaggaggugaugcggucuagauggagccgcaagaugcugaugacaggaacccucgcuguuuuucugcuucugauuaugggccagcucacauggaaugaccugaucagacugugcauuauggugggcgccaacgccuccgaccggauggggaugggaaccaccuaucuugcucugauggccacauucaagaugcgcccuauguuugcggucggccuccuguucagacggcucacgucucgcgaagugcugcuucugaccaucgggcucagccugguggcuuccgucgagcugcccaacucucuugaggaacugggagauggccucgccauggggauuaugaugcugaaacuccugacagaauuucaaccccaccagcuuuggaccacacugcucagccugaccuucguuaagacgacacugucccuugacuacgccuggaaaaccaccgcuauggcccugagcaucgugucucucuuuccucugugucucuccacaaccagccagaagacaacguggcugccggugcuucugggaucuuucggcugcaaaccccugaccauguuucucaucacagagaauaagauuuggggcagaaaguccuggccucugaacgaggggaucauggcuauuggaaucgucagcauucuucugucuucccuccugaaaaaugaugugccccucgccggcccucugaucgccgggggaaugcuuaucgccuguuauguuauuagcggcuccagcgcugaccugucucuggaaaaggccgcugaggugagcugggaacaggaggccgaacauuccggggccucucacagcauccucgucgaggugcaagaugacggaaccaugaaaauuaaggaugaggaacgggacgauacacugaccauccuucugaaagcuacgcuccuggcgguuuccggcguguaccccaugucuauuccugccacccucuucgucugguauuucuggcagaagaaaaagcagcgcagcggcgugcugugggacacacccuccccgccugaggucgaaagagcugugcuugauaacgggaucuaccggauccugcagcgcggacugcucggcagaucucaaguuggggugggagucuuucaggacggcguguuccauaccauguggcacguuacaagaggggcggugcugauguaucagggaaagcggcuugagcccagcugggccuccgucaaaaaggaucugauuagcuacggcggcggguggcgcuuucagggaucuuggaauaccggcgaggaagugcaagugaucgcuguugagccugggaaaaaccccaagaauguccagacaacgccgggaaccuucaaaacaccugaaggcgaggugggggccauugcgcucgacuuuaagcccggaaccuccggcagcccuaucgugaaccgggaaggcaagauugucgggcuguacggaaauggcgugguuaccacaucugggacguauguguccgcuaucgcccaggccaaagcuagccaagagggaccccuccccgagauugaagacgaggucuucaagaaaagaaaccugaccaucauggaucuucacccuggcuccgggaagacacgccgguaccugccggccaucgugagagaagcgauuaaacgcaagcugcggacccucauccuggcucccacaagaguuguggccucugagauggccgaagcucuuaagggcaugccuauucgcuaucagaccacggccgucaaaagcgagcauacaggacgggagaucguggaccugaugugccacgcuaccuuuaccaugagacuccugucccccguucgggugccuaauuacaacaugauuaucauggaugaagcccauuucacagaccccgcgagcaucgccgcucgcggcuauauuucuaccagagucgggaugggagaggccgcugccaucuuuaugacagccaccccuccgggcuccguggaggcuuucccccagagcaaugcggugauucaggaugaggaacgggacaucccugagcgcucuuggaacagcggguacgauuggauuacggacuuucccggaaagacagucugguucguuccuuccaucaaaucuggcaaugauaucgccaacugucugagaaagaacgggaaacgggugauucaacucagcagaaagaccuucgacacagaguaucagaagaccaaaaauaacgauugggacuacguggucacgaccgacaucuccgaaaugggcgcuaauuuucgcgccgaucgggugauugaccccagacgcugccuuaagccgguuauccugaaagauggaccugagcgggugauucuggccggccccaugcccgucacagcugccucugcggcucagagacgcgggcggaucggaagaaaccagaauaaggaaggcgaccaauacguguauauggggcagccucucaacaaugaugaggaccacgcccauuggaccgaggccaaaaugcugcuugauaacauuaauacacccgaaggaaucaucccugcucuguucgagccggaacgcgaaaagagcgccgcgauugacggcgaauacagacucagaggggaagcccgcaagaccuuuguugagcugaugagacggggcgaucugcccguguggcucuccuauaaagucgcuagcgaaggauuccaguacucugaccgcagauggugcuuugauggcgagcggaacaaucaggugcuugaagagaacauggacgucgaaaucuggacaaaggagggggagcgcaagaagcugcgcccucgguggcuggaugccagaaccuauuccgacccccucgcucugcgcgaguucaaagaguuugccgcuggacggagaagcguguccggcgaccuuauucuggaaaucgggaagcucccucaacaccugacgcugcgggcccagaaugcgcucgauaaccuuguuaugcugcacaauucugagcagggaggcaaagccuaccgccaugcuauggaggaacugcccgacacaauugagacccucaugcugcuugcccugaucgcugugcucaccggcggggugacacuguucuuucugagcggaaagggccucgggaagaccuccaucggacuucugugugucacagccucuagcgcccugcucuggauggcuuccguugaaccgcacuggauugcggccagcaucauucuggaguucuuucuuauggugcugcucaucccugaacccgauagacagcggacgccucaagacaaccagcuggcuuauguggucauuggccuccuguucaugauccuuaccguggccgccaacgagauggggcugcuggagacaaccaaaaaggaucucggaaucggcuacguugcugccgaaaaucaucagcacgcgacaaugcuggacguggaucuucaccccgccucugcuuggacccuguacgccgucgcuacgaccgugauuacaccuaugaugcgccauaccaucgagaacacaaccgccaauauuucccucacggcgaucgccaaccaagcugccauucugaugggccuggacaaaggguggcccaucagcaagauggauauuggagucccgcuccuugcucugggcugcuauucucaggugaauccucugacacucaccgccgcuguucugaugcuuguggcccacuacgcgaucaucgggcccggacugcaggccaaagcuacaagagaagcccagaagcggaccgcugccggcauuaugaagaaccccaccgucgacgggaucguggccauugaucucgacccuguuguguaugaugcgaaauuugagaagcaacugggacagaucaugcugcucauucuuuguacaucccagauccugcugaugcgcacgaccugggcucucugcgaaagcaucacacuggccaccggcccgcuuacaacccugugggagggcucucccgggaaauucuggaauacgacaauugcugucagcauggccaacaucuucagaggauccuaccucgccggcgcugggcuggccuuuucucugaugaaaagccucggaggcgggcggcgcggaaccggcgcgcagggcgagacccuuggggaaaaauggaagagacaacugaaucagcuguccaagagcgaguucaacacauauaaacgguccggaauuauggaaguggacagaucugaggccaaggaaggccucaaacgcggggagaccacaaagcaugcugugagccggggaacggccaaacugagaugguuuguugagcgcaaucuugucaagccugaaggcaaggugaucgaccugggguguggacggggcggcugguccuacuauugcgcugggcucaaaaaggugaccgaggucaaaggauacacaaagggcgggcccggacacgaggaaccuauucccauggccaccuacggcuggaaccugguuaaacugcauucugggaaggauguguucuuuaugccuccggaaaaaugugacacacuccuuugcgauaucggagagagcucccccaauccuaccaucgaggaaggcagaacgcugcgcgugcugaagauggucgagcccuggcuccggggcaaccaguucuguauuaagauccugaauccuuauaugcccucugugguugaaacccuugagagaaugcagcgcaaacacgggggaaugcuggugcggaacccgcucagcagaaauuccacacacgagauguacugggucagcugcggcaccgggaacauugugucugcgguuaacaugacaucccgcaugcugcugaaucgguuuaccauggcccauagaaagccuacauaugaacgcgacguggaucucggagcuggcaccagacacgucgccguggagcccgaaguggcuaaccuggacaucauugggcaacggaucgagaauauuaaaaacgaacauaagagcacguggcacuacgaugaggacaaucccuauaaaacaugggccuaccacggaucuuaugaggucaagccuuccggcagcgcuucuuccaugguuaacggcguggugcgccuucugaccaagcccugggaugucaucccuauggugacccagaucgccaugacagacacgaccccguucgggcagcaaagaguuuuuaaagaaaagguggauacacggacccccagagcgaaacggggaacaacccagauuauggaggucacagccaaguggcucuggggcuuccugagccgcaauaaaaagccuagaaucuguacccgggaagaguuuacgcgcaaggugagauccaacgcugccauuggggcuguuuucguggacgaaaaucaguggaacagcgccaaagaggccgucgaggacgaacgguuuugggaucuugugcaucgcgagagagaacugcacaagcagggaaaaugcgcgaccugcguuuacaauaugaugggcaagcgggagaaaaagcucggggaguucggcaaggcuaaaggaucucgcgccaucugguacauguggcugggcgccagauuccuggaguuugaggcucucggguucaugaacgaagaccauugguuuagccgggaaaauucccugucuggaguggaaggcgaggggcuucacaagcugggauauauucuccgcgauaucagcaaaauccccggcgggaacauguacgccgacgauacagcuggcugggacaccagagucacagaggaugaccugcaaaaugaagccaagauuaccgauaucauggagccugaacaugcgcuucuggccacguccauuuucaaacucacauaucagaacaaggugguccgggugcagcgccccgcuaaaaacggaaccguuauggacgugaucucuagacgggaucagagaggcagcgggcaagucggaacauacggccugaauaccuuuacgaacauggaggugcagcugauucgccagauggaauccgaggggaucuuccucccgucugagcuggaaaccccuaaucuugccgagcgggcucuggacuggcucgaaaagcacggagccgagagacugaagcgcauggcgaucagcggcgaugacugugugguuaaacccauugacgaucgguuugccacagcucuuaccgcccugaacgacauggggaaggugagaaaagauaucccucagugggaacccuccaagggcuggaaugacuggcaacaggucccuuucugcagccaccauuuucaccagcucauuaugaaagauggacgcgagaucgugguucccugucggaaccaggacgagcuggugggcagagcucgcgucucucaaggggccggauggucccugcgggaaacagcuugccucggcaagagcuaugcccagauguggcagcugauguacuuccauagacgcgaucuucggcuggcggccaaugcuauuuguucugccgugccggucgacugggugccuaccuccagaacaaccuggagcauccacgcccaccaucaauggaugacgacagaggauaugcucuccguuuggaaccggguguggaucgaagagaaucccuggauggaaaacaagacccacgucucuagcugggaggaggugcccuaucuggggaaaagagaagaccaguggugcggaucccuuauuggccugaccgcucgcgccacaugggcgaccaauauccagguugcuauuaaccaggugcggagacucaucgggaaugagaacuaccuggauuacaugacaagcaugaagcgcuuuaaaaaugaaucugacuccgagggcgcccugugguga

SEQ ID NO: 18716 - RNA, 9879 nt, Artificial Sequence
  derived and/or modified CDS sequence (opt5) from DENV-1__KJ189351__SS-prME
agcgugaccaugcugcucaugcugcuucccacaguccuggccuuccaccucacgaccagaggcggggagccucauaugaucguuuccaagcaggaacggggaaaaucucugcuuuuuaagacaagcgcuggcgugaacaugugcacccugauugccauggaccucggggagcugugugaagauacaaugaccuacaaaugcccgcgcaucacagaggcggaacccgacgauguggacuguuggugcaaugcuaccgauacgugggucaccuauggaacauguucccaaaccggcgagcacagacgggagaagcgcucuguggcccuggccccucauguugggcucggacuggaaacaagaaccgagacguggaugagcuccgaaggcgcuuggaaacagauucagcggguggagacaugggcccuucgccaccccggcuucaccgucaucgcuuuuuuccuggcccaugcgauugggacaucuaucacccagaagggaaucauuuuuauccuccugaugcuugugaccccuagcauggccaugagaugcguuggcauugggaaccgggacuucguggagggacuguccggcgcuacaugggucgauguggugcucgaacacgggagcugugucacgaccauggccaagaauaaacccacacuggacaucgagcugcucaagaccgaaguuacaaacccugcugugcugcgcaaacuuugcauugaggccaagaucucuaauaccacgacagauuccagauguccgacccaaggagaagcgacccugguggaggagcaggacgccaacuuugucugccggcgcacauucguggauagaggcuggggcaauggguguggacucuuuggcaaagggagccugcuuaccugcgcuaaguucaagugcguuacaaaacuggaaggaaagauugugcaguacgagaaccucaaauauucugucaucgugacgguucacaccggcgaccagcaucaaguggggaaugaaacaaccgagcacggaacaaucgccaccauuacgccccaggcuccuaccuccgaaauccagcugacagauuacggcgcccugacccucgacuguagcccccggacaggccuggacuuuaacgagaugguccuucugaccaugaaggagaaaucuuggcucgugcauaagcagugguuccuggaucuuccucugcccuggacgccgggggccuccacaagccaagaaaccuggaaucgccaggaccuccuggucacauuuaaaaccgcucacgcgaagaagcaggaggugguugugcugggaucccaagaaggcgccaugcacaccgcucucacaggggccacggagauucagaccucuggaacaaccacaaucuucgccggccaucugaaaugcagacuuaagauggauaaacugacccucaaggggaugagcuaugucauguguacgggcuccuucaaacuggaaaaggagguggcugagacacagcacggaaccguucuggugcaggucaaguacgaaggcaccgacgccccuugcaaaauucccuuuagcacacaagaugagaagggggugacccagaacggacggcuuaucacagcgaauccuaucgugacggacaaagaaaagcccguuaacauugagaccgagcccccuuucggcgaaucuuauaucgucgugggggcuggagagaaagcccucaagcuguccugguuuaagagaggcagcucuauugggaaaauguucgaagccacagcucgcggcgcccggagaauggcuauccugggagauaccgccugggacuuuggcagcauugggggaguguucacauccgucggcaagcucgugcaucagguuuuugggaccgcguacggagugcuguucucuggcgucagcuggacgaugaaaaucgggaucggcauucuucugaccuggcucggacugaauucccgcagcacaucucuguccaugaccuguaucgccgugggcaugguuacacuuuaccucggggugaugguccaggcugauagcggaugcgugauuaacuggaagggccgggagcugaaaugugggucuggaaucuuuguuaccaacgaagugcacacauggaccgagcaauauaaguuccaggccgacuccccgaagagacugagcgcugccauuggcaaagcgugggaggaaggggucugcggcauccgcuccgccacgcggcucgagaauauuauguggaagcagaucucuaacgaacugaaucauauccuucuggagaacgauaugaaauuuacagugguggucggagacgcuaauggcauucucgcccaggggaagaaaaugaucagaccccaaccuauggaacacaaguacagcuggaaauccuggggaaaggcuaagauuaucggcgccgacauucagaacaccaccuucaucaucgaugggcccgacacaccugagugucccgauggacagcgcgccuggaauauuugggagguugaagacuauggcuuuggcguguucaccacgaacaucuggcugaaacugcgggauucuuacacacagaugugcgaccacagacuuaugagcgcugcgauuaaggauuccaaagccgugcaugcugacaugggguauuggaucgagagcgaaaagaaugagaccuggaaacucgcccgcgccucuuucauugaagucaagacauguaccuggccgaagucccacacacuguggagcaacggagugcuggagucugagaugaucaucccuaaaauuuacggcgggcccaucucccaacauaauuaucggccuggauacuuuacccagacggcuggccccuggcaccucgggaagcuggaacuugauuucgaccugugcgagggaaccacaguuguggucgaugaacacugcggcaacagaggcccuagccuccggaccacaaccgugacggggaaaauuauccaugagugguguugccgcucuuguacacugcccccgcugagauuucggggagaggacggcugcugguacgggauggaaauuagaccuguuaaggagaaagaagagaaucuugugcgcagcauggucuccgccggaagcggcgaaguggauucuuucucccucgggauccuguguguuagcaucaugauugaggaggugaugcgguccagauggucucgcaagaugcugaugaccggaacacucgcggucuuucugcuucugaucaugggccagcucaccuggaacgaccugaccagacugugcauuauggugggcgcuaaugccagcgaccggauggggaugggaacaacguaucuugcccugauggcuaccuucaagaugcgccccauguuugccgugggccuccuguucagacggcucacaucccgcgaaguccugcuucugaccaucgggcucucucugguugcgagcguggagcugcccaacucccuugaagagcugggagauggccucgcuauggggauuaugaugcugaaacuccugacagaauuucaaccucaccagcuuuggaccacgcugcucucucugacauucgugaagaccacccugagccuugacuacgccuggaaaacaaccgccauggcucuguccaucgucagccucuuuccgcugugucucucuacaacgucccagaagaccacauggcugcccgugcuucugggaagcuucggcugcaaaccucugaccauguuucucauugccgagaacagaaucuggggccggaagucuuggccccugaaugaggggaucauggcuauuggaaucguuuccauucuucugagcucucuccugaagaacgaugugccucucgccggcccccugaucgcggggggaaugcuuauugccuguuaugucaucuccggcagcuccgcugaccugagccuggaaaaagccgcugaggugucuugggaacaggaggccgaacauagcggggccucccacucuauccucguugaggugcaagaugacggaacaaugaagauuaaagaugaggaacgcgacgauacccugacgauccuucugaaggcuacccuccuggcggucagcggcguguacccuauguccauucccgccacacucuucgucugguauuucuggcagaaaaagaaacagagaucuggcgugcugugggacaccccgagcccucccgagguugaacgggcugugcuugauaaugggaucuaccgcauucugcagagaggacugcucggccggucccaagucggggugggaguuuuucaggacggcguguuccauacaauguggcacgucaccagaggggccgugcugauguaucagggaaagcgccuugagccuucuugggccagcgugaagaaagaucugaucuccuacggcggcggguggcgguuucagggaagcuggaacacaggcgaggaaguucaagucaucgcuguggagcccgggaagaauccgaaaaacgugcagacgaccccuggaacauucaagacccccgaaggcgaggucggggccauugcgcucgacuuuaaaccuggaaccucuggcucccccaucgugaauagagaaggcaagauuguugggcuguacggaaacggcguggucacaacgagcgggaccuaugugucugcuaucgcccaggccaaggcuucccaagagggaccccucccugagauugaagacgagguuuucaaaaagcgcaaucugacaaucauggaucuucacccgggcagcgggaaaacccggagauaccugcccgccauugugcgcgaagcgaucaagcggaaacugagaacacucauccuggcuccuacccgcgucguggccuccgagauggccgaagcucuuaagggcaugcccauucgguaucagacgacagccguuaagucugagcauaccggaagagagaucguggaccugaugugccacgcuaccuuuacaaugcggcuccugagcccuguccgcgugcccaacuacaauaugauuaucauggaugaagcccauuucaccgacccugcguccauugccgcuagaggcuauaucagcacacggguggggaugggagaggccgcugccaucuuuaugaccgccacgccgcccggcucugucgaagcuuucccucaguccaacgcgguuauucaggaugaggaacgcgacauccccgagagaagcuggaauucuggguacgauuggauuacagacuuuccuggaaaaaccgugugguucgugcccagcaucaaguccggcaacgauauugccaauugucugcggaaaaacgggaagagagucauccaacucucucgcaaaacauucgacaccgaguaucagaagacgaagaacaaugauugggacuacgugguuaccacagacaucagcgaaaugggcgcuaacuuucgggccgauagagugauugacccgcgccggugccuuaaaccugucauccugaaggauggacccgagagagugauucuggccggccccaugccuguuaccguggcuuccgccgcgcagcgccgggggagaaucggacgcaaucagaacaaagaaggcgaccaauacgucuauauggggcagccccucaauaacgaugaggaccacgcucauuggacagaggccaagaugcugcuugauaauauuaacaccccugaaggaaucauuccggcccuguucgagcccgaaagagagaaaucugcugccaucgacggcgaauaccggcuccgcggggaggcgagaaagacauuuguggagcugaugcggcgcggcgaucugccugucuggcucagcuauaagguggccuccgaaggauuccaguacagcgacagacgguggugcuuugauggcgagagaaauaaccagguucuugaagagaauauggacguggaaaucuggaccaaagagggggagcgcaagaaacugcggcccagauggcuggaugcucgcacguauucugacccucucgcccugcgggaauucaaggaguuugcugccggaagacgguccgugagcggcgaccuuauucuggaaaucgggaaacucccccaacaccugacacugcgcgcucagaacgcccucgauaaucuugucaugcugcacaacuccgagcagggaggcaaggcguacagacaugccauggaagagcugccggacaccauugagacccucaugcugcuugcucugaucgccguucucacaggcggggugacccuguucuuucugucuggaaaaggccucgggaagacaagcauuggacuucugugugugacggcuuccucugcccugcucuggauggccagcgucgaaccucacuggaucgcugcguccaucauucuggaguucuuucuuauggugcugcucauccccgaaccugaucggcagcgcaccccccaagacaaucagcuggccuauguugugauuggccugcucuucaugauccuuacagucgcugccaacgagauggggcugcuggagaccacaaagaaagaucucggaauuggcuacguggccgcugaaaaccaucagcacgccaccaugcuggacgucgaucuucacccugcgagcgccuggacgcuguacgcuguggccaccacaguuaucacccccaugaugagacauacaaucgagaauaccacggcuaacauuucucucacagccaucgcgaaucaagccgcuauucugaugggccuggacaagggguggccgaucuccaaaauggauauuggagugccucuccuugcccugggcugcuauagccaggucaacccccugacccucacagcugccgugcugaugcuuguugcucacuacgccaucauugggcccggacugcaggcgaaggccacccgggaagcucagaaacgcaccgccgcuggcaucaugaagaauccuacaguggacgggaucgucgccauugaucucgacccggugguguaugaugccaaguuugagaaacaacugggacagaucaugcugcucauucuuuguacgucucagauccugcugaugagaaccacaugggcgcucugcgaauccauuacccuggcuacaggcccccuuaccacgcugugggagggcagcccugggaaguucuggaacacaaccaucgccguuucuauggcuaauaucuuccggggaagcuaccucgccggcgccgggcuggcuuuuucccugaugaaaucucucggaggcgggcgcagaggaaccggcgcccagggcgagacacuuggggaaaaguggaaacggcaacugaaccagcugagcaaguccgaguucaauauuuauaagagaagcggaaucauggaagucgaccgcuccgaggcgaaagaaggccucaagcggggggagaccacaaaacaugccgugucuagaggaacggcuaagcugcgcugguuuguggagcggaaccuugucaaacccgaaggcaagguuauugaccugggguguggaagaggcggcuggagcuacuauugcgccgggcucaagaaagugaccgaggugaagggauacacaaaaggcgggccuggacacgaagagcccaucccuauggcuaccuacggcuggaaucuggucaagcugcauuccgggaaagauguguucuuuaugccgcccgaaaagugugacacacuccuuugcgauauuggagagucuagcccuaaccccaccaucgaggaaggccgcacgcugcggguucugaaaaugguggagccuuggcucagaggcaaucaguucugugucaagauccugaaccccuauaugccguccgugguugaaacccuugagcgcaugcagcggaagcacgggggaaugcuggugagaaauccucucucucgcaacagcacacacgagauguacugggucuccugcggcaccgggaauauugugagcgccgugaacaugacaucucggaugcugcugaacagauuuaccauggcgcaucgcaaacccacauaugaaagagacgucgaucucggagccggcacccggcacguugcuguggagcccgaaguggccaaucuggacaucauugggcaacgcaucgagaacauuaagaaugaacauaaauccacguggcacuacgaugaggacaacccuuauaagacaugggcuuaccacggaagcuaugaggucaaaucuuccggcagcgccucuuccauggugaauggcguugugagacuucugaccaagcccugggaugucaucccuauggugacccagauugcuaugacagacacgaccccguucgggcagcaacggguuuuuaaggaaaaaguggauacaagaaccccccgggccaagcgcggaacaacccagaucauggaggucacagcgaaauggcucuggggcuuccugagcagaaacaagaaaccucggaucuguacccgcgaagaguuuacgagaaaggugcgguccaaugccgcuauuggggccguuuucguggacgaaaaccaguggaauagcgcuaaggaggccgucgaggacgaacgcuuuugggaucuugugcauagagagcgggaacugcacaaacagggaaagugcgccaccugcgucuacaacaugaugggcaaacgcgagaagaaacucggggaauucggcaaggcgaagggaucuagagcuaucugguacauguggcugggcgcccgguuccuggaguuugaggcccucggguucaugaaugaagaccauugguuuagccgcgagaacucccugucuggaguggaaggcgaggggcuucacaaacugggauauauucucagagauaucagcaagauucccggcgggaauauguacgcugacgauacagccggcugggacacccggaucacagaggaugaccugcaaaacgaagcuaaaaucaccgauauuauggagccugaacaugcccuucuggcgacguccaucuucaagcucacauaucagaauaaaguugugcgcguccagagacccgccaagaacggaaccgugauggacgugauuucucggagagaucagcgcggcagcgggcaaguuggaacauacggccugaacaccuuuacgaauauggaggugcagcugauccggcagauggaauccgaggggauuuuccucccgucugagcuggaaaccccuaaccuugcugagagagcccuggacuggcucgaaaaacacggagcugagcgccugaagcggauggccaucagcggcgaugacugugucgugaagcccaucgacgauagauuugcgacagcccuuaccgcucugaaugacauggggaaaguucgcaaggauauuccucagugggaacccuccaaaggcuggaacgacuggcaacaggugccuuucugcagccaccauuuucaccagcucaucaugaaggauggacgggagauugucgugcccuguagaaaucaggacgagcuggucggccgcgcccgggugucucaaggggcuggauggucccugagagaaacagccugccucggcaaaagcuaugcucagauguggcagcugauguacuuccaucgccgggaucuuagacuggccgcgaacgccaucuguucugcuguuccgguggacugggucccuaccucccggacaaccuggagcauucacgcccaccaucaauggaugacgacagaggauaugcucuccguguggaauagaguuuggaucgaagagaaccccuggauggaagacaagacccacgugucuagcugggaggagguccccuaucuggggaagcgcgaagaucaguggugcggaucccuuaucggccugaccgcccgggcuacaugggccaccaauauucagguggcgaucaaccaggugagacgccucauugggaaugagaacuaccuggacuacaugacaagcaugaaaagauuuaagaaugaaucugacuccgagggcgcucugugguga

SEQ ID NO: 18717 - RNA, 9879 nt, Artificial Sequence
  derived and/or modified CDS sequence (opt5) from DENV-1__KJ189352__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccccccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagaucuuugggaccgccuacggagugcuguucagcggcguuuccuggacgaugaaaaucgggauuggcauccuucugaccuggcucggacugaauagccgcucuacaucccugagcaugaccuguauugcugugggcauggucacacuuuaccucggggugaugguucaggccgauucuggaugcgugaucaacuggaagggccgggagcugaaauguggguccggaauuuuugucaccaacgaagugcacacauggaccgagcaauauaaguuccaggcugacagcccuaagagacuguccgccgcgaucggcaaagccugggaggaagggguuugcggcauucgcucugcuacgcggcucgagaauaucauguggagacagaucagcaacgaacugaaucauauucuucuggagaacgauaugaaguuuacaguggucgugggagacgccaauggcauccucgcucaggggaaaaagaugauucgcccgcaacccauggaacacaaauacuccuggaagucuuggggaaaagccaaggugaucggcgccgacauucagaacaccaccuucaucaucgaugggccugacacacccgaguguccugauggacagcgggcuuggaauauuugggaggucgaagacuauggcuuuggcguuuucaccacgaacaucuggcugaagcugagagauagcuacacacagaugugcgaccaccgccuuauguccgcggccauuaaagauagcaaggcugugcaugccgacaugggguauuggaucgagucugaaaaaaaugagaccuggaagcucgcccgggcuuccuucauugaagugaaaacauguaccuggcccaagagccacacacuguggucuaacggaguccuggaguccgagaugaucaucccgaagauuuacggcgggccuaucagccaacauaauuauagacccggauacuuuacccagacggccggcccuuggcaccucgggaaacuggaacuugauuucgaccugugcgagggaaccacagugguuguggaugaacacugcggcaaccggggccccucucuccgcaccacaaccgucacggggaagauuauccaugagugguguugcagaagcuguacacugccuccccugcgguuuagaggagaggacggcugcugguacgggauggaaauucgcccggugaaagagaaggaagagaaucuuguucgguccauggugagcgcgggaucuggcgaagucgauuccuucagccucgggauccuguguguguccaucaugauugaggagguuaugagaucucgcuggagcagaaaaaugcugaugaccggaacacucgcuguguuucugcuucugaucaugggccagcucaccuggaacgaccugauucggcugugcaucauggucggcgccaaugccuccgaccgcauggggaugggaaccacauaucuugcucugauggccacguucaagaugagaccuauguuugcggugggccuccuguuccggcgccucaccucuagagaagugcugcuucugacaauugggcucagccuggucgcuuccguugagcugcccaacucucuugaagagcugggagauggccucgccauggggaucaugaugcugaagcuccugaccgaauuucaaccccaccagcuuuggacaacccugcucagccugacguucgugaaaacaacccugucccuugacuacgccuggaagaccacagcuauggcccugagcauugugucucucuuuccucugugucucuccaccacaagccagaaaacgaccuggcugccgguccuucugggaucuuucggcugcaagccccugacaauguuucucaucaccgagaacaaaaucuggggccggaaguccuggccucugaaugaggggauuauggcuaucggaauugugagcauccuucugucuucccuccugaagaacgauguuccccucgccggcccucugauugcggggggaaugcuuaucgccuguuaugugaucagcggcuccagcgcugaccugucucuggaaaaagccgcugaggucagcugggaacaggaggccgaacauuccggggccucucacagcauucucguggagguucaagaugacggaacaaugaagaucaaagaugaggaacgcgacgauacccugacgauucuucugaaggcuacccuccuggcgguguccggcgucuaccccaugucuaucccugccacacucuucgugugguauuucuggcagaaaaagaaacagagaagcggcguccugugggacacccccuccccgccugagguggaacgggcuguucuugauaaugggauuuaccgcauccugcagagaggacugcucggccggucucaagugggggucggaguguuucaggacggcguuuuccauacaauguggcacgugaccagaggggccguccugauguaucagggaaagcgccuugagcccagcugggccuccgugaagaaagaucugaucagcuacggcggcggguggcgguuucagggaucuuggaacacaggcgaggaagugcaaguuauugcugucgagccugggaagaaucccaaaaacgugcagacgaccccgggaacauucaagaccccugaaggcgaggugggggccaucgcgcucgacuuuaaacccggaaccuccggcagcccuauugucaauagagaaggcaagaucguggggcuguacggaaacggcguugugacaacgucugggaccuaugucuccgcuauugcccaggccaaggcuagccaagagggaccccuccccgagaucgaagacgagguguucaaaaagcgcaaucugacaauuauggaucuucacccuggcuccgggaaaacccggagauaccugccggccaucguucgcgaagcgaucaagcggaaacugagaacacucauucuggcucccacccgcguggucgccucugagauggccgaagcucuuaagggcaugccuauccgguaucagacgacagccgugaagagcgagcauaccggaagagagauuguugaccugaugugccacgcuaccuuuacaaugcggcuccugucccccgugcgcgucccuaacuacaauaugaucauuauggaugaagcccauuucaccgaccccgcgagcaucgccgcuagaggcuauaucucuacacggguggggaugggagaggccgcugccauuuuuaugaccgccacgccuccgggcuccguggaagcuuucccccagagcaacgcggucauccaggaugaggaacgcgacauuccugagagaucuuggaauagcggguacgauuggaucacagacuuucccggaaaaaccguuugguucgugccuuccauuaagucuggcaacgauaucgccaauugucugcggaaaaacgggaagagagugauccaacucagccgcaaaacauucgacaccgaguaucagaagacgaagaacaaugauugggacuacgucgugaccacagacauuuccgaaaugggcgcuaacuuucgggccgauagaguuaucgacccccgccggugccuuaaaccggugauucugaaggauggaccugagagagucauccuggccggccccaugcccgugaccgcugccucugcggcucagcgccgggggagaauuggacgcaaucagaacaaagaaggcgaccaauacguuuauauggggcagccucucaauaacgaugaggaccacgcccauuggacagaggccaagaugcugcuugauaauaucaacacccccgaaggaauuaucccugcucuguucgagccggaaagagagaaaagcgccgcgaucgacggcgaauaccggcuccgcggggaggccagaaagacauuuguggagcugaugcggcgcggcgaucugcccgucuggcucuccuauaagguggcuagcgaaggauuccaguacucugacagacgguggugcuuugauggcgagagaaauaaccagguccuugaagagaauauggacguggaaauuuggaccaaagagggggagcgcaagaaacugcggccuagauggcuggaugcccgcacguauuccgacccccucgcucugcgggaauucaaggaguuugccgcuggaagacggagcguuuccggcgaccuuauccuggaaauugggaaacucccucaacaccugacacugcgcgcccagaacgcgcucgauaaucuugugaugcugcacaacucugagcagggaggcaaggccuacagacaugcuauggaagagcugcccgacaccaucgagacccucaugcugcuugcccugauugcugugcucacaggcggggucacccuguucuuucugagcggaaaaggccucgggaagacauccaucggacuucuguguguuacggccucuagcgcccugcucuggauggcuuccguggaaccgcacuggaucgcggccagcauuauccuggaguucuuucuuauggugcugcucauuccugaacccgaucggcagcgcaccccucaagacaaucagcuggcuuaugucgugaucggccugcucuucaugauucuuacaguugccgccaacgagauggggcugcuggagaccacaaagaaagaucucggaaucggcuacguggcugccgaaaaccaucagcacgcgaccaugcuggacgucgaucuucaccccgccucugcuuggacgcuguacgccguggcuaccacagucaucaccccuaugaugagacauacaauugagaauaccacggccaacaucucccucacagcgauugccaaucaagcugccauccugaugggccuggacaagggguggcccauuagcaaaauggauaucggagugccgcuccuugcucugggcugcuauucucagguuaacccucugacccucacagccgcugugcugaugcuugucgcccacuacgcgauuaucgggcccggacugcaggccaaggcuacccgggaagcccagaaacgcaccgcugccggcaucaugaagaaucccacaguggacgggauuguugccaucgaucucgacccuguggucuaugaugcgaaguuugagaaacaacugggacagauuaugcugcucauccuuuguacgucccagauucugcugaugagaaccacaugggcucucugcgaaagcaucacccuggccacaggcccgcuuaccacgcugugggagggcucucccgggaaguucuggaacacaaccaucgcugugagcauggccaauauuuuccggggauccuaccucgccggcgcugggcuggccuuuucucugaugaaaagccucggaggcgggcgcagaggaaccggcgcgcagggcgagacacuuggggaaaaguggaaacggcaacugaaccagcuguccaagagcgaguucaauaccuauaagagauccggaaucauggaaguggaccgcucugaggccaaagaaggccucaagcggggggagacaacgaaacaugcuguuagcagaggaaccgccaagcugcgcugguuugucgagcggaaccuugugaaaccugaaggcaaggugauugaccugggguguggaagaggcggcugguccuacuauugcgcugggcucaagaaagucacagagguuaagggauacaccaaaggcgggcccggacacgaagagccuauccccauggccacauacggcuggaaucuggugaagcugcauucugggaaagauguguucuuuaugccuccggaaaagugugacacccuccuuugcgauauuggagagagcucccccaacccuacgaucgaggaaggccgcacccugcggguccugaaaaugguggagcccuggcucagaggcaaucaguucuguaucaagauucugaacccuuauaugcccucuguuguggaaacacuugagcgcaugcagcggaagcacgggggaaugcuggucagaaauccgcucagccgcaacuccacccacgagauguacugggugagcugcggcacagggaauaucguuucugcggugaacaugaccucccggaugcugcugaacagauuuacaauggcccaucgcaaaccuaccuaugaaagagacgucgaucucggagcuggcacgcggcacguggccguggagcccgaagucgcuaaucuggacauuaucgggcaacgcauugagaacaucaagaaugaacauaaaagcacauggcacuacgaugaggacaaccccuauaagaccugggccuaccacggaucuuaugagguuaaaccuuccggcagcgcuucuuccauggugaauggcguggucagacuucugaccaagcccugggaugugauuccuaugguuacacagaucgccaugacggacaccacaccguucgggcagcaacggguguuuaaggaaaaagucgauaccagaacaccccgggcgaagcgcggaaccacacagaucauggaggugaccgccaaauggcucuggggcuuccugagcagaaacaagaaaccucggauuuguacgcgcgaagaguuuaccagaaagguucgguccaaugcugccaucggggcuguguucgucgacgaaaaccaguggaauagcgccaaggaggccguggaggacgaacgcuuuugggaucuuguucauagagagcgggaacugcacaaacagggaaagugcgcgacaugcguguacaacaugaugggcaaacgcgagaagaaacucggggaauucggcaaggcuaagggaucuagagccauuugguacauguggcugggcgcccgguuccuggaguuugaggcucucggguucaugaaugaagaccauugguuuagccgcgagaacucccugucuggagucgaaggcgaggggcuucacaaacugggauauauccucagagauauuagcaagauccccggcgggaauauguacgccgacgauaccgcuggcugggacacacgggugaccgaggaugaccugcaaaacgaagccaaaaucacggauauuauggagccugaacaugcgcuucuggccacauccaucuucaagcucaccuaucagaauaaagucgugcgcguucagagacccgcuaagaacggaacagugauggacgucauuucucggagagaucagcgcggcagcgggcaagugggaaccuacggccugaacacguuuaccaauauggaggugcagcugauccggcagauggaauccgaggggauuuuccucccgucugagcuggaaacaccuaaccuugccgagagagcucuggacuggcucgaaaaacacggagccgagcgccugaagcggauggcgaucagcggcgaugacuguguugugaagcccaucgacgauagauuugccaccgcucuuacagcccugaaugacauggggaaaguccgcaaggauauuccucagugggaacccuccaaaggcuggaacgacuggcaacaggugccuuucugcagccaccauuuucaccagcucaucaugaaggauggacgggagauuguugugcccuguagaaaucaggacgagcuggucggccgcgcucgggugucucaaggggccggauggucccugagagaaaccgcuugccucggcaaaagcuaugcccagauguggcagcugauguacuuccaucgccgggaucuuagacuggcggccaacgcuaucuguucugccgucccgguggacuggguuccuacaucccggaccacguggagcauucacgcccaccaucaauggaugacaaccgaggauaugcucuccguguggaauagagucuggaucgaagagaaccccuggauggaaaauaagacccacgugucuagcugggaggagguucccuaucuggggaagcgcgaagaccaguggugcggaucccuuaucggccugacagcucgggccaccugggcgacaaacauucagguggcuaucaaucaggucagacgccucauugggaacgagaauuaccuggauuacaugacgagcaugaaaagauuuaagaacgaaucugacuccgagggcgcccugugguga

SEQ ID NO: 18718 - RNA, 9879 nt, Artificial Sequence
  derived and/or modified CDS sequence (opt5) from DENV-1__KJ189353__SS-prME
agcgugacaaugcugcucaugcugcuucccacagcccuggcuuuccaccucacgacccggggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuuagacaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccgcccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagaucuuugggaccgccuacggagugcuguucagcggcguuuccuggacgaugaaaaucgggauuggcauccuucugaccuggcucggacugaauagccgcucuacaucccugagcaugaccuguauugcugugggcauggucacacuuuaccucggggugaugguucaggccgauucuggaugcgugaucaacuggaagggccgggagcugaaauguggguccggaauuuuugucaccaacgaagugcacacauggaccgagcaauauaaguuccaggcugacagcccuaagagacuguccgccgcgaucggcaaagccugggaggaagggguuugcggcauucgcucugcuacgcggcucgagaauaucauguggaagcagaucagcaacgaacugaaucauauucuucuggagaacgauaugaaauuuacaguggucgugggagacgccaauggcauccucgcucaggggaagaaaaugauuagaccgcaacccauggaacacaaguacuccuggaaaucuuggggaaaggccaagaucauuggcgccgacauccagaacaccaccuucaucauugaugggccugacacacccgaguguccugauggacagcgcgcuuggaauaucugggagguggaagacuauggcuuuggcgucuucaccacgaacauuuggcugaaacugcgggauagcuacacacagaugugcgaccacagacuuauguccgcggccaucaaggauagcaaagcuguucaugccgacaugggguauuggauugagucugaaaagaaugagaccuggaaacucgcccgcgcuuccuucaucgaagugaagacauguaccuggcccaagagccacacacuguggucuaacggagugcuggaguccgagaugaucauuccgaaaaucuacggcgggccuauuagccaacauaauuaucggcccggauacuuuacccagacggccggcccuuggcaccucgggaagcuggaacuugauuucgagcugugcgaaggaaccacagucgugguugacgagcacugcggcaacagaggccccucucuccggaccacaaccgugacggggaaaaucauucaugagugguguugccgcagcuguacacugccuccccugagauuucggggagaagauggcugcugguacgggauggagaucagaccggucaaggaaaaagaggaaaaucuugugcgcuccaugguuagcgcgggaucuggcgagguggacuccuucagccucgggauccugugugucuccauuaugaucgaggaagugaugcggucuagauggagccgcaagaugcugaugaccggaacacucgcuguuuuucugcuucugauuaugggccagcucaccuggaacgaucugaucagacugugcauuauggugggcgccaaugccuccgaccggauggggaugggaaccacauaucuugcucugauggccacguucaagaugcgcccuauguuugcggucggccuccuguucagacggcucaccucucgcgaggugcugcuucugacaaucgggcucagccugguggcuuccgucgaacugcccaacucucuugaggaacugggagacggccucgccauggggauuaugaugcugaaacuccugaccgaguuucaaccccaccagcuuuggacaacccugcucagccugacguucguuaagacaacccugucccuugauuacgccuggaaaaccacagcuauggcccugagcaucgugucucucuuuccucugugucucuccaccacaagccagaagacgaccuggcugccggugcuucugggaucuuucggcugcaaaccccugacaauguuucucaucaccgagaacaagauuuggggcagaaaguccuggccucugaaugaagggaucauggcuauuggaaucgucagcauucuucugucuucccuccugaaaaacgacgugccccucgccggcccucugaucgccgggggaaugcuuaucgccuguuauguuauuagcggcuccagcgcugaucugucucuggagaaggccgcugaagugagcugggagcaggaagccgagcauuccggggccucucacagcauccucgucgaggugcaagacgauggaacaaugaaaauuaaggacgaagaacgggaugacacccugacgauccuucugaaagcuacccuccuggcgguuuccggcguguaccccaugucuauuccugccacacucuucgucugguauuucuggcagaagaaaaagcagcgcagcggcgugcugugggauacccccuccccgccugaagucgagagagcugugcuugacaaugggaucuaccggauccugcagcgcggacugcucggcagaucucaaguuggggugggagucuuucaggauggcguguuccauacaauguggcacguuaccagaggggcggugcugauguaucagggaaagcggcuugagcccagcugggccuccgucaaaaaggaccugauuagcuacggcggcggguggcgcuuucagggaucuuggaacacaggcgaagaggugcaagugaucgcuguugaaccugggaaaaaucccaagaacguccagacgaccccgggaacauucaaaaccccugagggcgaagugggggccauugcgcucgauuuuaagcccggaaccuccggcagcccuaucgugaaucgggagggcaagauugucgggcuguacggaaacggcgugguuacaacgucugggaccuauguguccgcuaucgcccaggccaaagcuagccaagagggaccccuccccgaaauugaggacgaagucuucaagaaaagaaaucugacaaucauggaccuucacccuggcuccgggaagacccgccgguaccugccggccaucgugagagaggcgauuaaacgcaagcugcggacacucauccuggcucccaccagaguuguggccucugaaauggccgaggcucuuaagggcaugccuauucgcuaucagacgacagccgucaaaagcgagcauaccggacgggaaaucguggaucugaugugccacgcuaccuuuacaaugagacuccugucccccguucgggugccuaacuacaauaugauuaucauggacgaggcccauuucaccgaucccgcgagcaucgccgcucgcggcuauauuucuacaagagucgggaugggagaagccgcugccaucuuuaugaccgccacgccuccgggcuccguggaggcuuucccccagagcaacgcggugauucaggacgaagaacgggauaucccugagcgcucuuggaauagcggguacgacuggauuacagauuuucccggaaagaccgucugguucguuccuuccaucaaaucuggcaacgacaucgccaauugucugagaaagaacgggaaacgggugauucaacucagcagaaagacauucgauaccgaauaucagaagacgaaaaacaaugacugggauuacguggucaccacagacaucuccgagaugggcgcuaacuuucgcgccgaccgggugauugaucccagacgcugccuuaagccgguuauccugaaagacggaccugaacgggugauucuggccggccccaugcccgucaccgcugccucugcggcucagagacgcgggcggaucggaagaaaucagaacaaggagggcgaucaauacguguauauggggcagccucucaauaacgacgaggaucacgcccauuggacagaagccaaaaugcugcuugacaauauuaacacccccgagggaaucaucccugcucuguucgaaccggagcgcgaaaagagcgccgcgauugauggcgaguacagacucagaggggaagcccgcaagacauuuguugaacugaugagacggggcgaccugcccguguggcucuccuauaaagucgcuagcgagggauuccaguacucugaucgcagauggugcuuugacggcgaacggaauaaccaggugcuugaggaaaauauggaugucgagaucuggaccaaggagggggaacgcaagaagcugcgcccucgguggcuggacgccagaacguauuccgauccccucgcucugcgcgaguucaaagaauuugccgcuggacggagaagcguguccggcgaccuuauucuggagaucgggaagcucccucaacaccugacacugcgggcccagaacgcgcucgacaaucuuguuaugcugcacaacucugaacagggaggcaaagccuaccgccaugcuauggaggagcugcccgauaccauugaaacccucaugcugcuugcccugaucgcugugcucacaggcggggugacccuguucuuucugagcggaaagggccucgggaagacauccaucggacuucugugugucacggccucuagcgcccugcucuggauggcuuccguugagccgcacuggauugcggccagcaucauucuggaguucuuucuuauggugcugcucaucccugagcccgacagacagcggaccccucaagauaaucagcuggcuuauguggucauuggccuccuguucaugauccuuacaguggccgccaacgagauggggcugcuggaaaccaccaaaaaggaccucggaaucggcuacguugcugccgagaaccaucagcacgcgaccaugcuggauguggaccuucaccccgccucugcuuggacgcuguacgccgucgcuaccacagugauuaccccuaugaugcgccauacaaucgaaaauaccacggccaacauuucccucacagcgaucgccaaucaagcugccauucugaugggccuggauaaaggguggcccaucagcaagauggacauuggagucccgcuccuugcucugggcugcuauucucaggugaacccucugacccucacagccgcuguucugaugcuuguggcccacuacgcgaucaucgggcccggacugcaggccaaagcuaccagagaggcccagaagcggaccgcugccggcauuaugaagaaucccacagucgaugggaucguggccauugaccucgauccuguuguguaugacgcgaaauuugaaaagcaacugggacagaucaugcugcucauucuuuguacgucccagauccugcugaugcgcaccacaugggcucucugcgagagcaucacccuggccacaggcccgcuuaccacgcugugggagggcucucccgggaaauucuggaacacaaccauugcugucagcauggccaauaucuucagaggauccuaccucgccggcgcugggcuggccuuuucucugaugaaaagccucggaggcgggcggcgcggaaccggcgcgcagggcgaaacacuuggggagaaauggaagagacaacugaaccagcuguccaagagcgaguucaauaccuauaaacgguccggaauuauggagguggauagaucugaagccaaggagggccucaaacgcggggagacaacgaagcaugcugugagccggggaaccgccaaacugagaugguuuguugaacgcaaccuugucaagccugagggcaaggugaucgaccugggguguggacggggcggcugguccuacuauugcgcugggcucaaaaaggugacagaagucaaaggauacaccaagggcgggcccggacacgaggaaccuauucccauggccacauacggcuggaaucugguuaaacugcauucugggaaggacguguucuuuaugccuccggagaaaugugauacccuccuuugcgacaucggagagagcucccccaacccuacgaucgaagagggcagaacccugcgcgugcugaagauggucgaacccuggcuccggggcaaucaguucuguauuaagauccugaacccuuauaugcccucugugguugagacacuugagagaaugcagcgcaaacacgggggaaugcuggugcggaauccgcucagcagaaacuccacccacgaaauguacugggucagcugcggcacagggaauauugugucugcgguuaacaugaccucccgcaugcugcugaaccgguuuacaauggcccauagaaagccuaccuaugagcgcgauguggaccucggagcuggcacgagacacgucgccguggaacccgagguggcuaaucuggauaucauugggcaacggaucgaaaacauuaaaaaugagcauaagagcacauggcacuacgacgaggauaaccccuauaaaaccugggccuaccacggaucuuaugaagucaagccuuccggcagcgcuucuuccaugguuaauggcguggugcgccuucugaccaagcccugggacgucaucccuauggugacacagaucgccaugacggauaccacaccguucgggcagcaaagaguuuuuaaagagaagguggacacccggacacccagagcgaaacggggaaccacacagauuauggaagucaccgccaaguggcucuggggcuuccugagccgcaacaaaaagccuagaaucuguacgcgggaggaauuuacccgcaaggugagauccaaugcugccauuggggcuguuuucguggaugagaaccaguggaauagcgccaaagaggccgucgaagacgagcgguuuugggaccuugugcaucgcgaaagagagcugcacaagcagggaaaaugcgcgacaugcguuuacaacaugaugggcaagcgggagaaaaagcucggggaguucggcaaggcuaaaggaucucgcgccaucugguacauguggcugggcgccagauuccuggaguuugaagcucucggguucaugaaugaggaucauugguuuagccgggaaaacucccugucuggaguggagggcgaggggcuucacaagcugggauauauucuccgcgacaucagcaaaauccccggcgggaauauguacgccgaugacaccgcuggcugggauacaagagucaccgaagacgaucugcaaaacgaggccaagauuacggacaucauggaaccugagcaugcgcuucuggccacauccauuuucaaacucaccuaucagaauaaggugguccgggugcagcgccccgcuaaaaacggaacaguuauggaugugaucucuagacgggaccagagaggcagcgggcaagucggaaccuacggccugaacacguuuaccaauauggaagugcagcugauucgccagauggaguccgaggggaucuuccucccgucugaacuggagacaccuaaccuugccgaacgggcucuggauuggcucgagaagcacggagccgaaagacugaagcgcauggcgaucagcggcgacgauugugugguuaaacccauugacgaccgguuugccaccgcucuuacagcccugaaugauauggggaaggugagaaaagacaucccucagugggagcccuccaagggcuggaacgauuggcaacaggucccuuucugcagccaccauuuucaccagcucauuaugaaagacggacgcgagaucgugguucccugucggaaucaggaugaacuggugggcagagcucgcgucucucaaggggccggauggucccugcgggagaccgcuugccucggcaagagcuaugcccagauguggcagcugauguacuuccauagacgcgaccuucggcuggcggccaacgcuauuuguucugccgugccggucgauugggugccuacauccagaaccacguggagcauccacgcccaccaucaauggaugacaaccgaagacaugcucuccguuuggaaucggguguggaucgaggaaaaccccuggauggagaauaagacccacgucucuagcugggaggaagugcccuaucuggggaaaagagaggaucaguggugcggaucccuuauuggccugacagcucgcgccaccugggcgacaaacauccagguugcuauuaaucaggugcggagacucaucgggaacgaaaauuaccuggacuacaugacgagcaugaagcgcuuuaaaaacgagucugauuccgagggcgcccugugguga

SEQ ID NO: 18719 - RNA, 9879 nt, Artificial Sequence
  derived and/or modified CDS sequence (opt5) from DENV-1__KJ189354__SS-prME
agcgugacaaugcugcucaugcugcuucccacagcccuggcuuuccaccucacgacccggggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuuagacaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccgcccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagaucuuugggaccgccuacggagugcuguucagcggcguuuccuggacgaugaaaaucgggauuggcauccuucugaccuggcucggacugaauagccgcucuacaucccugagcaugaccuguauugcugugggcauggucacacuuuaccucggggugaugguucaggccgauucuggaugcgugaucaacuggaagggccgggagcugaaauguggguccggaauuuuugucaccaacgaagugcacacauggaccgagcaauauaaguuccaggcugacagcccuaagagacuguccgccgcgaucggcaaagccugggaggaagggguuugcggcauucgcucugcuacgcggcucgagaauaucauguggaagcagaucagcaacgaacugaaucauauucuucuggagaacgauaugaaauuuacaguggucgugggagacgccaauggcauccucgcucaggggaagaaaaugauuagaccgcaacccauggaacacaaguacuccuggaaaucuuggggaaaggccaagaucauuggcgccgacauccagaacaccaccuucaucauugaugggccugacacacccgaguguccugauggacagcgcgcuuggaauaucugggagguggaagacuauggcuuuggcgucuucaccacgaacauuuggcugaaacugcgggauagcuacacacagaugugcgaccacagacuuauguccgcggccaucaaggauagcaaagcuguucaugccgacaugggguauuggauugagucugaaaagaaugagaccuggaaacucgcccgcgcuuccuucaucgaagugaagacauguaccuggcccaagagccacacacuguggucuaacggagugcuggaguccgagaugaucauuccgaaaaucuacggcgggccuauuagccaacauaauuaucggcccggauacuuuacccagacggccggcccuuggcaccucgggaagcuggaacuugauuucgaccugugcgagggaaccacagucgugguugaugaacacugcggcaacagaggccccucucuccggaccacaaccgugacggggaaaaucauucaugagugguguugccgcagcuguacacugccuccccugagauuucggggagaggacggcugcugguacgggauggaaaucagaccggucaaggagaaagaagagaaucuugugcgcuccaugguuagcgcgggaucuggcgaaguggauuccuucagccucgggauccugugugucuccauuaugaucgaggaggugaugcggucuagauggagccgcaagaugcugaugaccggaacacucgcuguuuuucugcuucugauuaugggccagcucaccuggaacgaccugaucagacugugcauuauggugggcgccaaugccuccgaccggauggggaugggaaccacauaucuugcucugauggccacguucaagaugcgcccuauguuugcggucggccuccuguucagacggcucaccucucgcgaagugcugcuucugacaaucgggcucagccugguggcuuccgucgagcugcccaacucucuugaagaacugggagauggccucgccauggggauuaugaugcugaaacuccugaccgaauuucaaccccaccagcuuuggacaacccugcucagccugacguucguuaagacaacccugucccuugacuacgccuggaaaaccacagcuauggcccugagcaucgugucucucuuuccucugugucucuccaccacaagccagaagacgaccuggcugccggugcuucugggaucuuucggcugcaaaccccugacaauguuucucaucaccgagaacaagauuuggggcagaaaguccuggccucugaaugaggggaucauggcuauuggaaucgucagcauucuucugucuucccuccugaaaaacgaugugccccucgccggcccucugaucgccgggggaaugcuuaucgccuguuauguuauuagcggcuccagcgcugaccugucucuggaaaaggccgcugaggugagcugggaacaggaggccgaacauuccggggccucucacagcauccucgucgaggugcaagaugacggaacaaugaaaauuaaggaugaggaacgggacgauacccugacgauccuucugaaagcuacccuccuggcgguuuccggcguguaccccaugucuauuccugccacacucuucgucugguauuucuggcagaagaaaaagcagcgcagcggcgugcugugggacacccccuccccgccugaggucgaaagagcugugcuugauaaugggaucuaccggauccugcagcgcggacugcucggcagaucucaaguuggggugggagucuuucaggacggcguguuccauacaauguggcacguuaccagaggggcggugcugauguaucagggaaagcggcuugagcccagcugggccuccgucaaaaaggaucugauuagcuacggcggcggguggcgcuuucagggaucuuggaacacaggcgaggaagugcaagugaucgcuguugagccugggaaaaaucccaagaacguccagacgaccccgggaacauucaaaaccccugaaggcgaggugggggccauugcgcucgacuuuaagcccggaaccuccggcagcccuaucgugaaucgggaaggcaagauugucgggcuguacggaaacggcgugguuacaacgucugggaccuauguguccgcuaucgcccaggccaaagcuagccaagagggaccccuccccgagauugaagacgaggucuucaagaaaagaaaucugacaaucauggaucuucacccuggcuccgggaagacccgccgguaccugccggccaucgugagagaagcgauuaaacgcaagcugcggacacucauccuggcucccaccagaguuguggccucugagauggccgaagcucuuaagggcaugccuauucgcuaucagacgacagccgucaaaagcgagcauaccggacgggagaucguggaccugaugugccacgcuaccuuuacaaugagacuccugucccccguucgggugccuaacuacaauaugauuaucauggaugaagcccauuucaccgaccccgcgagcaucgccgcucgcggcuauauuucuacaagagucgggaugggagaggccgcugccaucuuuaugaccgccacgccuccgggcuccguggaggcuuucccccagagcaacgcggugauucaggaugaggaacgggacaucccugagcgcucuuggaauagcggguacgauuggauuacagacuuucccggaaagaccgucugguucguuccuuccaucaaaucuggcaacgauaucgccaauugucugagaaagaacgggaaacgggugauucaacucagcagaaagacauucgacaccgaguaucagaagacgaaaaacaaugauugggacuacguggucaccacagacaucuccgaaaugggcgcuaacuuucgcgccgaucgggugauugaccccagacgcugccuuaagccgguuauccugaaagauggaccugagcgggugauucuggccggccccaugcccgucaccgcugccucugcggcucagagacgcgggcggaucggaagaaaucagaacaaggaaggcgaccaauacguguauauggggcagccucucaauaacgaugaggaccacgcccauuggacagaggccaaaaugcugcuugauaauauuaacacccccgaaggaaucaucccugcucuguucgagccggaacgcgaaaagagcgccgcgauugacggcgaauacagacucagaggggaagcccgcaagacauuuguugagcugaugagacggggcgaucugcccguguggcucuccuauaaagucgcuagcgaaggauuccaguacucugaccgcagauggugcuuugauggcgagcggaauaaccaggugcuugaagagaauauggacgucgaaaucuggaccaaggagggggagcgcaagaagcugcgcccucgguggcuggaugccagaacguauuccgacccccucgcucugcgcgaguucaaagaguuugccgcuggacggagaagcguguccggcgaccuuauucuggaaaucgggaagcucccucaacaccugacacugcgggcccagaacgcgcucgauaaucuuguuaugcugcacaacucugagcagggaggcaaagccuaccgccaugcuauggaggaacugcccgacaccauugagacccucaugcugcuugcccugaucgcugugcucacaggcggggugacccuguucuuucugagcggaaagggccucgggaagacauccaucggacuucugugugucacggccucuagcgcccugcucuggauggcuuccguugaaccgcacuggauugcggccagcaucauucuggaguucuuucuuauggugcugcucaucccugaacccgauagacagcggaccccucaagacaaucagcuggcuuauguggucauuggccuccuguucaugauccuuacaguggccgccaacgagauggggcugcuggagaccaccaaaaaggaucucggaaucggcuacguugcugccgaaaaccaucagcacgcgaccaugcuggacguggaucuucaccccgccucugcuuggacgcuguacgccgucgcuaccacagugauuaccccuaugaugcgccauacaaucgagaauaccacggccaacauuucccucacagcgaucgccaaucaagcugccauucugaugggccuggacaaaggguggcccaucagcaagauggauauuggagucccgcuccuugcucugggcugcuauucucaggugaacccucugacccucacagccgcuguucugaugcuuguggcccacuacgcgaucaucgggcccggacugcaggccaaagcuaccagagaagcccagaagcggaccgcugccggcauuaugaagaaucccacagucgacgggaucguggccauugaucucgacccuguuguguaugaugcgaaauuugagaagcaacugggacagaucaugcugcucauucuuuguacgucccagauccugcugaugcgcaccacaugggcucucugcgaaagcaucacccuggccacaggcccgcuuaccacgcugugggagggcucucccgggaaauucuggaacacaaccauugcugucagcauggccaauaucuucagaggauccuaccucgccggcgcugggcuggccuuuucucugaugaaaagccucggaggcgggcggcgcggaaccggcgcgcagggcgagacacuuggggaaaaauggaagagacaacugaaccagcuguccaagagcgaguucaauaccuauaaacgguccggaauuauggaaguggacagaucugaggccaaggaaggccucaaacgcggggagacaacgaagcaugcugugagccggggaaccgccaaacugagaugguuuguugagcgcaaccuugucaagccugaaggcaaggugaucgaccugggguguggacggggcggcugguccuacuauugcgcugggcucaaaaaggugacagaggucaaaggauacaccaagggcgggcccggacacgaggaaccuauucccauggccacauacggcuggaaucugguuaaacugcauucugggaaggauguguucuuuaugccuccggaaaaaugugacacccuccuuugcgauaucggagagagcucccccaacccuacgaucgaggaaggcagaacccugcgcgugcugaagauggucgagcccuggcuccggggcaaucaguucuguauuaagauccugaacccuuauaugcccucugugguugaaacacuugagagaaugcagcgcaaacacgggggaaugcuggugcggaauccgcucagcagaaacuccacccacgagauguacugggucagcugcggcacagggaauauugugucugcgguuaacaugaccucccgcaugcugcugaaccgguuuacaauggcccauagaaagccuaccuaugaacgcgacguggaucucggagcuggcacgagacacgucgccguggagcccgaaguggcuaaucuggacaucauugggcaacggaucgagaacauuaaaaaugaacauaagagcacauggcacuacgaugaggacaaccccuauaaaaccugggccuaccacggaucuuaugaggucaagccuuccggcagcgcuucuuccaugguuaauggcguggugcgccuucugaccaagcccugggaugucaucccuauggugacacagaucgccaugacggacaccacaccguucgggcagcaaagaguuuuuaaagaaaagguggauacccggacacccagagcgaaacggggaaccacacagauuauggaggucaccgccaaguggcucuggggcuuccugagccgcaacaaaaagccuagaaucuguacgcgggaagaguuuacccgcaaggugagauccaaugcugccauuggggcuguuuucguggacgaaaaccaguggaauagcgccaaagaggccgucgaggacgaaaaguuuugggaucuugugcaucgggagcgcgaacugcacaaacagggaaagugcgcgacaugcguuuacaacaugaugggcaaaagagagaagaagcucggggaguucggcaaagcuaagggaucucgggccaucugguacauguggcugggcgcccgcuuccuggaguuugaggcucucggguucaugaaugaagaccauugguuuagcagagagaacucccugucuggaguggaaggcgaggggcuucacaaacugggauauauucuccgggauaucagcaagauccccggcgggaauauguacgccgacgauaccgcuggcugggacacacgcgucaccgaggaugaccugcaaaacgaagccaaaauuacggauaucauggagccugaacaugcgcuucuggccacauccauuuucaagcucaccuaucagaauaaaguggucagagugcagcggcccgcuaagaacggaacaguuauggacgugaucucucgcagagaucagcggggcagcgggcaagucggaaccuacggccugaacacguuuaccaauauggaggugcagcugauuagacagauggaauccgaggggaucuuccucccgucugagcuggaaacaccuaaccuugccgagcgcgcucuggacuggcucgaaaagcacggagccgagcggcugaaaagaauggcgaucagcggcgaugacugugugguuaagcccauugacgaucgcuuugccaccgcucuuacagcccugaaugacauggggaaagugcggaaggauaucccucagugggaacccuccaaaggcuggaacgacuggcaacaggucccuuucugcagccaccauuuucaccagcucauuaugaaggauggaagagagaucgugguucccugucgcaaucaggacgagcuggugggccgggcuagagucucucaaggggccggauggucccugcgcgaaaccgcuugccucggcaagagcuaugcccagauguggcagcugauguacuuccaucggagagaucuucgccuggcggccaacgcuauuuguucugccgugccggucgacugggugccuacaucccggaccacguggagcauccacgcccaccaucaauggaugacaaccgaggauaugcucuccguuuggaauagaguguggaucgaagagaaccccuggauggaaaauaaaacccacgucucuagcugggaggaggugcccuaucuggggaagcgggaagaccaguggugcggaucccuuauuggccugacagcuagagccaccugggcgacaaacauccagguugcuauuaaucaggugcgccggcucaucgggaacgagaauuaccuggauuacaugacgagcaugaaaagauuuaagaacgaaucugacuccgagggcgcccugugguga

SEQ ID NO: 18720 - RNA, 9879 nt, Artificial Sequence
  derived and/or modified CDS sequence (opt5) from DENV-1__KJ189355__SS-prME
agcgugacaaugcugcucaugcugcuucccacggcccuggcuuuccaccucacgacacggggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuuagacaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugauugacaaagaaaagccugugaacaucgagacggagccgcccuucggcgaauccuauauuguugucggggccggagagaaagcccucaagcugagcugguuuaagagaggcucuagcaucgggaaaauguucgaagcuaccgcccgcggcgcucggagaauggccauucugggagauacagcgugggacuuuggcuccaucgggggaguguucaccucugugggcaagcucguccaucagaucuuugggacagccuacggagugcuguucagcggcguuuccuggaccaugaaaauugggaucggcauucuucugacguggcucggacugaauagccgcucuaugucccugagcaugaccuguaucgcugugggcauggucacacuuuaccucggggugaugguucaggccgauucuggaugcgugauuaacuggaagggccgggagcugaaauguggguccggaaucuuugucaccaacgaagugcacacauggaccgagcaauauaaguuccaggcugacagcccuaagagacuguccgccgcgauuggcaaagccugggaggaagggguuugcggcauccgcucugcuacacggcucgagaauaucauguggaagcagauuagcaacgaacugaaucauauccuucuggagaacgauaugaaauuuaccguggucgugggagacgccaauggcauucucgcucaggggaagaaaaugaucagaccgcaacccauggaacacaaguacuccuggaaaucuuggggaaaggccaagauuaucggcgccgacauccagaacacgacauucauuaucgaugggccugacacccccgaguguccugauggacagcgcgcuuggaauauuugggagguggaagacuauggcuuuggcgucuucaccacaaacaucuggcugaaacugcgggauagcuacacccagaugugcgaccacagacuuauguccgcggccauuaaggauagcaaagcuguucaugccgacaugggguauuggaucgagucugaaaagaaugagacguggaaacucgcccgcgcuuccuucaucgaagugaagacauguaccuggcccaagagccacacacuguggucuaacggagugcuggaguccgagaugauuaucccgaaaauuuacggcgggccuaucagccaacauaauuaucggcccggauacuuuacccagacagccggcccuuggcaccucgggaagcuggaacuugauuucgaccugugcgagggaaccacggucgugguugaugaacacugcggcaacagaggccccucucuccggaccacaaccgugacagggaaaauuauccaugagugguguugccgcagcuguacccugccuccccugagauuucggggagaggacggcugcugguacgggauggaaaucagaccggucaaggagaaagaagagaaucuugugcgcuccaugguuagcgcgggaucuggcgaaguggauuccuucagccucgggauucugugugucuccaucaugauugaggaggugaugcggucuagauggagccgcaagaugcugaugacgggaacacucgcuguuuuucugcuucugaucaugggccagcucaccuggaacgaccugauuagacugugcaucauggugggcgccaaugccuccgaccggauggggaugggaacaaccuaucuugcucugauggccaccuucaagaugcgcccuauguuugcggucggccuccuguucagacggcucacaucucgcgaagugcugcuucugacgauugggcucagccugguggcuuccgucgagcugcccaacucucuugaagaacugggagauggccucgccauggggaucaugaugcugaaacuccugaccgaauuucaaccccaccagcuuuggacaacccugcucagccugacauucguuaagaccacgcugucccuugacuacgccuggaaaacaaccgcuauggcccugagcaucgugucucucuuuccucugugucucuccaccacaagccagaagaccacauggcugccggugcuucugggaucuuucggcugcaaaccccugacgauguuucucauuaccgagaacaagaucuggggcagaaaguccuggccucugaaugaggggauuauggcuaucggaauugucagcauccuucugucuucccuccugaaaaacgaugugccccucgccggcccucugaucgccggcgggaugcuuauugccuguuauguuaucagcggguccagcgcugaccugucucuggaaaaggccgcugaggugagcugggaacaggaggccgaacauuccggggccucucacagcauucucgucgaggugcaagaugacggaacaaugaaaaucaaggaugaggaacgggacgauacccugacaauucuucugaaagcuacccuccuggcgguuuccggcguguaccccaugucuaucccugccacacuguucgucugguauuucuggcagaagaaaaagcagcgcagcggcgugcugugggacacccccuccccgccugaggucgaaagagcugugcuugauaaugggaucuaccggauucugcagcgcggacugcucggcagaucucaaguuggggugggagucuuucaggacggcguguuccauacaauguggcacguuaccagaggggcggugcugauguaucagggaaagcggcuugagcccagcugggccuccgucaaaaaggaucugaucagcuacggcggcggguggcgcuuucagggaucuuggaacacaggcgaggaagugcaagugauugcuguugagccugggaaaaaucccaagaacguccagaccacaccgggaacguucaaaaccccugaaggcgaggugggggccaucgcgcucgacuuuaagcccggaacauccggcagcccuauugugaaucgggaaggcaagaucgucgggcuguacggaaacggcgugguuaccaccucugggacauauguguccgcuauugcccaggccaaagcuagccaagagggaccccuccccgagaucgaagacgaggucuucaagaaaagaaaucugacgaucauggaucuucacccuggcuccgggaagacccgccgguaccugccggccauugugagagaagcgaucaaacgcaagcugcggacacucauucuggcucccaccagaguuguggccucugagauggccgaagcucuuaagggcaugccuauccgcuaucagacaaccgccgucaaaagcgagcauacgggacgggagauuguggaccugaugugccacgcuacauuuaccaugagacuccugucccccguucgggugccuaacuacaauaugaucaucauggaugaagcccauuucaccgaccccgcgagcauugccgcucgcggcuauaucucuacaagagucgggaugggagaggccgcugccauuuuuaugaccgccacaccuccgggcuccguggaggcuuucccccagagcaacgcggugauccaggaugaggaacgggacauuccugagcgcucuuggaauagcggguacgauuggaucaccgacuuucccggaaagacggucugguucguuccuuccaucaaaucuggcaacgauauugccaauugucugagaaagaacgggaaacgggugauccaacucagcagaaagacauucgacaccgaguaucagaagaccaagaacaaugauugggacuacguggucaccacggacauuuccgaaaugggcgcuaacuuucgcgccgaucgggugaucgaccccagacgcugccuuaagccgguuauucugaaagauggaccugagcgggugauccuggccggccccaugcccgucaccgcugccucugcggcucagagacgcgggcggauuggaagaaaucagaacaaggaaggcgaccaauacguguauauggggcagccucucaauaacgaugaggaccacgcccauuggacagaggccaaaaugcugcuugauaauaucaacacccccgaaggaaucauuccugcucuguucgagccggaacgcgaaaagagcgccgcgaucgacggcgaauacagacucagaggggaagcccgcaagacauuuguugagcugaugagacggggcgaucugcccguguggcucuccuauaaagucgcuagcgaaggauuccaguacucugaccgcagauggugcuuugauggcgagcggaauaaccaggugcuugaagagaauauggacgucgaaauuuggaccaaggagggggagcgcaaaaagcugcgcccucgguggcuggaugccagaacauauuccgacccccucgcucugcgcgaguucaaagaguuugccgcuggacggagaagcguguccggcgaccuuauccuggaaauugggaagcucccucaacaccugacccugcgggcccagaacgcgcucgauaaucuuguuaugcugcacaacucugagcagggaggcaaagccuaccgccaugcuauggaggaacugcccgacacgaucgagacacucaugcugcuugcccugaucgcugugcucaccggcggggugacccuguucuuucugagcggaaagggccucgggaagacauccauuggacuucugugugucaccgccucuagcgcccugcucuggauggcuuccguugaaccgcacuggaucgcggccagcauuauccuggaguucuuucuuauggugcugcucauuccugaacccgauagacagcggacaccucaagacaaucagcuggcuuauguggucaucggccuccucuucaugauccuuacgguggccgccaacgagauggggcugcuggagaccaccaaaaaggaucucggaauuggcuacguugcugccgaaaaccaucagcacgcgaccaugcuggacguggaucuucaccccgccucugcuuggacacuguacgccgucgcuaccacggugaucaccccuaugaugcgccauacaauugagaauaccacagccaacaucucccucaccgcgauugccaaucaagcugccauccugaugggccuggacaaaggguggcccauuagcaagauggauaucggagucccgcuccuugcucugggcugcuauucucaggugaacccucugacgcucacagccgcuguucugaugcuuguggcccacuacgcgaucauugggcccggacugcaggccaaagcuaccagagaagcccagaagcggacagcugccggcaucaugaagaaucccaccgucgacgggauuguggccaucgaucucgacccuguuguguaugaugcgaaauuugagaagcaacugggacagauuaugcugcucauccuuuguaccucccagauccugcugaugcgcacaacgugggcucucugcgaaagcauuacccuggccacaggcccgcuuaccacacugugggagggcucucccgggaaauucuggaacaccacgaucgcugucagcauggccaauauuuucagaggauccuaccucgccggcgcugggcuggccuuuucucugaugaaaagccucggaggcgggcggcgcggaacaggcgcgcagggcgagacccuuggggaaaaauggaagagacaacugaaccagcuguccaagagcgaguucaauaccuauaaacgguccggaaucauggaaguggacagaucugaggccaaggaaggccucaaacgcggggagacaaccaagcaugcugugagccggggaacagccaaacugagaugguuuguugagcgcaaccuugucaagccugaaggcaaggugauugaccugggguguggacggggcggcugguccuacuauugcgcugggcucaaaaaggugacggaggucaaaggauacaccaagggcgggcccggacacgaggaaccuauccccauggccacauacggcuggaaucugguuaaacugcauucugggaaggauguguucuuuaugccuccggaaaaaugugacacccuccuuugcgauaucggagagagcucccccaacccuacaauugaggaaggcagaacccugcgcgugcugaagauggucgagcccuggcuccggggcaaucaguucuguaucaagauucugaacccuuauaugcccucugugguugaaacgcuugagagaaugcagcgcaaacacgggggaaugcuggugcggaauccgcucagcagaaacuccacccacgagauguacugggucagcugcggcacagggaauaucgugucugcgguuaacaugaccucccgcaugcugcugaaccgguuuacaauggcccauagaaagccuaccuaugaacgcgacguggaucucggagcuggcacaagacacgucgccguggagcccgaaguggcuaaucuggacauuaucgggcaacggauugagaacaucaaaaaugaacauaagagcaccuggcacuacgaugaggacaaccccuauaaaacgugggccuaccacggaucuuaugaggucaagccuuccggcagcgcuucuuccaugguuaauggcguggugcgccuucugacaaagcccugggaugucaucccuauggugacccagauugccaugaccgacacaacgccguucgggcagcaaagaguuuuuaaagaaaagguggauacccggacacccagagcgaaacggggaaccacacagaucauggaggucaccgccaaguggcucuggggcuuccugagccgcaacaaaaagccuagaauuuguacacgggaagaguuuacccgcaaggugagauccaaugcugccaucggggcuguuuucguggacgaaaaccaguggaauagcgccaaagaggccgucgaggacgaacgguuuugggaucuugugcaucgcgagagagaacugcacaagcagggaaaaugcgcgacgugcguuuacaacaugaugggcaagcgggagaaaaagcucggggaguucggcaaggcuaaaggaucucgcgccauuugguacauguggcugggcgccagauuccuggaguuugaggcucucggguucaugaaugaagaccauugguuuagccgggagaacucccugucuggaguggaaggcgaggggcuucacaagcugggauauauccuccgcgauaucagcaaaauucccggcgggaauauguacgccgacgauaccgcuggcugggacacaagagucaccgaggaugaccugcaaaacgaagccaagaucacagauauuauggagccugaacaugcgcuucuggccaccuccaucuucaaacucacguaucagaauaaggugguccgggugcagcgccccgcuaaaaacggaacaguuauggacgugauuucuagacgggaucagagaggcagcgggcaagucggaaccuacggccugaacacauuuaccaauauggaggugcagcugauccgccagauggaauccgaggggaucuuccucccgucugagcuggaaacgccuaaccuugccgagcgggcucugggauggcucgaaaagcacggcgccgagagacugaagcgcauggcgauuagcggggacgauugugugguuaaacccaucgacgaccgguuugccaccgcucuuacagcccugaaugauaugggcaaggugagaaaagacauuccucagugggaacccuccaagggauggaacgauuggcaacaggucccuuucugcagccaccauuuucaccagcucaucaugaaagacggccgcgagauugugguucccugucggaaucaggaugagcugguggggagagcucgcgucucucaaggagccggcuggucccugcgggaaaccgcuugccucggaaagagcuaugcccagauguggcagcugauguacuuccauagacgcgaccuucggcuggcggccaacgcuaucuguucugccgugccggucgauugggugccuacauccagaaccacauggagcauccacgcccaccaucaauggaugaccacggaggacaugcucuccguuuggaaucggguguggauugaagagaaccccuggauggaaaauaagacacacgucucuagcugggaggaggugcccuaucugggaaaaagagaagaucaguggugcggcucccuuaucgggcugaccgcucgcgccaccugggcgacaaacauucagguugcuaucaaucaggugcggagacucauuggcaacgagaauuaccuggacuacaugaccagcaugaagcgcuuuaaaaacgaaucugauuccgagggagcccugugguga

SEQ ID NO: 18721 - RNA, 9879 nt, Artificial Sequence
  derived and/or modified CDS sequence (opt5) from DENV-1__KJ189358__SS-prME
agcgugaccaugcugcucaugcugcuucccacaguccuggccuuccaccucacgaccagaggcggggagccucauaugaucguuuccaagcaggaacggggaaaaucucugcuuuuuaagacaagcgcuggcgugaacaugugcacccugauugccauggaccucggggagcugugugaagauacaaugaccuacaaaugcccgcgcaucacagaggcggaacccgacgauguggacuguuggugcaaugcuaccgauacgugggucaccuauggaacauguucccaaaccggcgagcacagacgggagaagcgcucuguggcccuggccccucauguugggcucggacuggaaacaagaaccgagacguggaugagcuccgaaggcgcuuggaaacagauucagcggguggagacaugggcccuucgccaccccggcuucaccgucaucgcuuuuuuccuggcccaugcgauugggacaucuaucacccagaagggaaucauuuuuauccuccugaugcuugugaccccuagcauggccaugagaugcguuggcauugggaaccgggacuucguggagggacuguccggcgcuacaugggucgauguggugcucgaacacgggagcugugucacgaccauggccaagaauaaacccacacuggacaucgagcugcucaagaccgaaguuacaaacccugcugugcugcgcaaacuuugcauugaggccaagaucucuaauaccacgacagauuccagauguccgacccaaggagaagcgacccugguggaggagcaggacgccaacuuugucugccggcgcacauucguggauagaggcuggggcaauggguguggacucuuuggcaaagggagccugcuuaccugcgcuaaguucaagugcguuacaaaacuggaaggaaagauugugcaguacgagaaccucaaauauucugucaucgugacgguucacaccggcgaccagcaucaaguggggaaugaaacaaccgagcacggaacaaucgccaccauuacgccccaggcuccuaccuccgaaauccagcugacagauuacggcgcccugacccucgacuguagcccccggacaggccuggacuuuaacgagaugguccuucugaccaugaaggagaaaucuuggcucgugcauaagcagugguuccuggaucuuccucugcccuggacguccggggccagcacaucccaagaaaccuggaaucgccaggaccuccuggucacauuuaaaaccgcucacgcgaagaagcaggaggugguugugcugggaucucaagaaggcgccaugcacaccgcucucacaggggccacggagauucagaccagcggaacaaccacaaucuucgccggccaucugaaaugcagacuuaagauggauaaacugacccucaaggggauguccuaugucauguguacgggcagcuucaaacuggaaaaggagguggcugagacacagcacggaaccguucuggugcaggucaaguacgaaggcaccgacgccccgugcaaaauuccuuuuucuacacaagaugagaagggggugacccagaacggacggcuuaucacagcgaaucccaucgugacggacaaagaaaagccuguuaacauugagaccgagccccccuucggcgaauccuauaucgucgugggggcuggagagaaagcccucaagcugagcugguuuaagagaggcucuagcauugggaaaauguucgaagccacagcucgcggcgcccggagaauggcuauccugggagauaccgccugggacuuuggcuccauugggggaguguucacaucugucggcaagcucgugcaucagguuuuugggaccgcguacggagugcuguucagcggcgucuccuggacgaugaaaaucgggaucggcauucuucugaccuggcucggacugaauagccgcucuacaucccugagcaugaccuguaucgccgugggcaugguuacacuuuaccucggggugaugguccaggcugauucuggaugcgugauuaacuggaagggccgggagcugaaauguggguccggaaucuuuguuaccaacgaagugcacacauggaccgagcaauauaaguuccaggccgacagcccuaagagacuguccgcugccauuggcaaagcgugggaggaaggggucugcggcauccgcucugccacgcggcucgagaauauuauguggaagcagaucagcaacgaacugaaucauauccuucuggagaacgauaugaaauuuacagugguggucggagacgcuaauggcauucucgcccaggggaagaaaaugaucagaccgcaacccauggaacacaaguacuccuggaaaucuuggggaaaggcuaagauuaucggcgccgacauucagaacaccaccuucaucaucgaugggccugacacacccgaguguccugauggacagcgcgccuggaauauuugggagguugaagacuauggcuuuggcguguucaccacgaacaucuggcugaaacugcgggauagcuacacacagaugugcgaccacagacuuauguccgcugcgauuaaggauagcaaagccgugcaugcugacaugggguauuggaucgagucugaaaagaaugagaccuggaaacucgcccgcgccuccuucauugaagucaagacauguaccuggcccaagagccacacacuguggucuaacggagugcuggaguccgagaugaucaucccgaaaauuuacggcgggccuaucagccaacauaauuaucggcccggauacuuuacccagacggcuggcccuuggcaccucgggaagcuggaacuugauuucgaccugugcgagggaaccacaguuguggucgaugaacacugcggcaacagaggccccucucuccggaccacaaccgugacggggaaaauuauccaugagugguguugccgcagcuguacacugccuccccugagauuucggggagaggacggcugcugguacgggauggaaauuagaccgguuaaggagaaagaagagaaucuugugcgcuccauggucagcgccggaucuggcgaaguggauuccuucagccucgggauccuguguguuuccaucaugauugaggaggugaugcggucuagauggagccgcaagaugcugaugaccggaacacucgcggucuuucugcuucugaucaugggccagcucaccuggaacgaccugauuagacugugcaucauggugggcgcuaaugccuccgaccggauggggaugggaaccacacaccuugcccugauggcuacguucaagaugcgcccuauguuugccgugggccuccuguucagacggcucaccucucgcgaaguccugcuucugacaauugggcucagccugguugcguccguggagcugcccaacucucuugaagagcugggagauggccucgcuauggggaucaugaugcugaaacuccugaccgaauuucaacccuaucagcuuuggacaacccugcucagccugacguucgugaagacaacccugucccuugacuacgccuggaaaaccacagccauggcucugagcauugucucucucuuuccucugugucucuccaccacaagccagaagacgaccuggcugccggugcuucugggaucuuucggcugcaaaccccugacaauguuucucaucaccgagaacaagaucuggggcagaaaguccuggccucugaaugaggggauuauggccaucggaauuguuagcauccuucugucuucccuccugaaaaacgaugugccccucgcuggcccucugauugccgggggaaugcuuaucgcguguuaugucaucagcggcuccagcgccgaccugucucuggaaaaggcugccgaggugagcugggaacaggaggcugaacauuccggggccucucacagcauucucguugaggugcaagaugacggaacaaugaaaaucaaggaugaggaacgggacgauacccugacgauucuucugaaagccacccuccuggcugucuccggcguguaccccaugucuaucccugcgacacucuucgucugguauuucuggcagcgcaagaaacagagaagcggcgugcugugggacacccccuccccgccugagguugaacgggccgugcuugauaaugggauuuaccgcauccugcagagaggacugcucggccggucucaagucggggugggaguuuuucaggacggcguguuccauacaauguggcacgucaccagaggggcugugcugauguaucagggaaagcgccuugagcccagcugggccuccgugaagaaagaucugaucagcuacggcggcggguggcgguuucagggaucuuggaacacaggcgaggaaguucaagucauugccguggagccugggaagaaucccaaaaacgugcagacgaccccgggaacauucaagaccccugaaggcgaggucggggcuaucgcccucgacuuuaaacccggaaccuccggcagcccuauugugaauagagaaggcaagaucguugggcuguacggaaacggcguggucacaacgucugggaccuauguguccgcgauugcucaggccaaggccagccaagagggaccccuccccgagaucgaagacgagguuuucaaaaagcgcaaucugacaauuauggaucuucacccuggcuccgggaaaacccggaaguaccugccggcuaucgugagagaagccaucaaacgcaagcugcggacacucauucuggcgcccaccagagucguggcuucugagauggccgaagcccuuaagggcaugccuauccgcuaucagacgacagcuguuaaaagcgagcauaccggacgggagauuguggaccugaugugccacgccaccuuuacaaugagacuccugucccccguccgggugccuaacuacaauaugaucauuauggaugaagcucauuucaccgaccccgccagcaucgcggcccgcggcuauaucucuacaagaguggggaugggagaggcugccgcuauuuuuaugaccgccacgccuccgggcuccgucgaagccuucccccagagcaacgcuguuauccaggaugaggaacgggacauuccugagcgcucuuggaauagcggguacgauuggaucacagacuuucccggaaagaccgugugguucgugccuuccauuaaaucuggcaacgauaucgcgaauugucugagaaagaacgggaaacgggucauccaacucagcagaaagacauucgacaccgaguaucagaagacgaaaaacaaugauugggacuacgugguuaccacagacauuuccgaaaugggcgccaacuuucgcgcugaucgggugaucgaccccagacgcugccuuaagccggucauucugaaagauggaccugagcgggugauccuggccggccccaugcccguuaccguggccucugcugcccagagacgcgggcggauuggaagaaaucagaacaaggaaggcgaccaauacgucuauauggggcagccucucaauaacgaugaggaccacgcgcauuggacagaggcuaaaaugcugcuugauaauaucaacacccccgaaggaauuaucccugcccuguucgagccggaacgcgagaagagcgccgcuaucgacggcgaauacagacuccggggggaggcccgcaagacauuuguggagcugaugagacggggcgaucugcccgucuggcucuccuauaaaguggcgagcgaaggauuccaguacucugaccgcagauggugcuuugauggcgagcggaauaaccagguucuugaagagaauauggacguggaaauuuggaccaaggagggggagagaaaaaagcugcgcccucgguggcuggaugccagaacguauuccgacccccucgcucugcgcgaauucaaagaguuugccgcuggacggagaagcguguccggcgaccuuauccuggaaauugggaagcucccucaacaccugacacugcgggcccagaacgcucucgauaaucuugucaugcugcacaacucugagcagggaggcaaagccuaccgccaugcgauggaagagcugcccgacaccaucgagacccucaugcugcuugcccugauugcuguucucacaggcggggugacccuguucuuucugagcggaaagggccucgggaagacauccaucggacuucugugugugacggccucuagcgcucugcucuggauggccuccgucgaaccgcacuggaucgccgcuagcauuauccuggaguucuuucuuauggugcugcucauuccugaacccgauagacagcggaccccucaagacaaucagcuggcguauguugugaucggccugcucuucaugauucuuacagucgccgcuaacgagauggggcugcuggagaccacaaaaaaggaucucggaaucggcuacguggccgccgaaaaccaucagcacgcuaccaugcuggacgucgaucuucaccccgccucugcguggacgcuguacgccguggcuaccacaguuaucaccccuaugaugcgccauacaauugagaauaccacggccaacaucucccucacagcuauugccaaucaagcggccauccugaugggccuggacaaaggguggcccauuagcaagauggauaucggagugccgcuccuugcucugggcugcuauucucaggucaacccucugacccucacagccgcugugcugaugcuuguugcccacuacgcuauuaucgggcccggacugcaggccaaagcgaccagagaagcccagaagcggaccgcugccggcaucaugaagaaucccacaguggacgggauugucgcuaucgaucucgacccugugguguaugaugccaaauuugagaagcaacugggacagauuaugcugcucauccuuuguacgucccagauucugcugaugcgcaccacaugggcccucugcgaaagcaucacccuggcgacaggcccgcuuaccacgcugugggagggcucucccgggaaauucuggaacacaaccaucgcuguuagcauggccaauauuuucagaggauccuaccucgcuggcgccgggcuggccuuuucucugaugaagagccucggaggcgggcggcgcggaaccggcgcucagggcgagacacuuggggaaaaauggaagagacaacugaaccagcuguccaagagcgaguucaauaccuauaaacgguccggaaucauggaagucgacagaucugaggccaaggaaggccucaaacgcggggagacaacgaagcaugcggugagccggggaaccgccaaacugagaugguuuguggagcgcaaccuugucaagccugaaggcaagguuauugaccugggguguggacggggcggcugguccuacuauugcgcugggcucaaaaaggugacagaggugaaaggauacaccaagggcgggcccggacacgaagagccuauccccauggccacauacggcuggaaucuggucaaacugcauucugggaaggauguguucuuuaugccuccggaaaaaugugacacccuccuuugcgauauuggagagagcucccccaacccuacgaucgaggaaggcagaacccugcgcguucugaagaugguggagcccuggcuccggggcaaucaguucuguaucaagauucugaacccuuauaugcccucugucguggaaacacuugagagaaugcagcgcaaacacgggggaaugcugguucggaauccgcucagcagaaacuccacccacgagauguacugggugagcugcggcacagggaauaucgucucugcugugaacaugaccucccgcaugcugcugaaccgguuuacaauggcccauagaaagccuaccuaugaacgcgacguggaucucggagcgggcacgagacacgucgccguugagcccgaaguggcuaaucuggacauuaucgggcaacggauugagaacaucaaaaaugaacauaagagcacauggcacuacgaugaggacaaccccuauaaaaccugggccuaccacggaucuuaugaggugaagccuuccggcagcgcuucuuccauggucaauggcgugguucgccuucugaccaagcccugggaugugauuccuauggucacacagaucgccaugacggacaccacaccguucgggcagcaaagaguguuuaaagaaaagguugauacccggacacccagagcuaaacggggaaccacacagaucauggaggugaccgccaaguggcucuggggcuuccugagccgcaacaaaaagccuagaauuuguacgcgggaagaguuuacccgcaaggucagauccaaugcggccaucggggcuguguucguugacgaaaaccaguggaauagcgccaaagaggcuguggaggacgaacgguuuugggaucuuguccaucgcgagagagaacugcacaagcagggaaaaugcgccacaugcguguacaacaugaugggcaagcgggagaaaaagcucggggaauucggcaaggccaaaggaucucgcgcgauuugguacauguggcugggcgcuagauuccuggaguuugaggcccucggguucaugaaugaagaccauugguuuagccgggagaacucccugucuggagucgaaggcgaggggcuucacaagcugggauauauccuccgcgauauuagcaaaauccccggcgggaauauguacgccgacgauaccgcuggcugggacacaagaaucaccgaggaugaccugcaaaacgaagccaagauuacggauaucauggagccugaacaugcucagcuugccacauccauuuucaaacugaccuaucagaauaaggugguucgggugcagcgccccgcgaaaaacggaacagucauggacgugaucucuagacgggaucaaagaggcagcgggcaggugggaaccuacggccucaacacguuuaccaauauggagguucagcugauucgccagauggaauccgaggggaucuuccugccgucugagcucgaaacaccuaaccuggccgagcgggcucuugacuggcuggaaaagaauggagccgagagacucaagcgcauggcuaucagcggcgaugacuguguggucaaacccauugacgaucgguuugccaccgcgcugacagcccuuaacgacauggggaaggugagaaaagauaucccucaaugggaacccuccaagggcuggaaugacuggcagcagguuccuuucugcagccaccacuuucaucagcugauuaugaaagauggacgcgagaucgugguccccugucggaaccaagacgagcucgugggcagagcucgcgucucucagggggccggauggucccugcgggaaaccgcuugccugggcaagagcuaugcccagauguggcaacucauguacuuccacagacgcgaucugcggcuugcugccaaugcgauuuguucugccgugccgguugacugggugccuacauccagaaccacguggagcauccaugcucaccaccaguggaugacaaccgaggauaugcuguccgucuggaaccggguguggaucgaagagaaucccuggauggaagacaagacccauguuucuagcugggaggaggugcccuaucucgggaaaagagaagaucaguggugcggaucccugauuggccuuacagcccgcgccaccugggcuacaaacauccaggucgccauuaaucaagugcggagacugaucgggaacgagaauuaccucgacuacaugacgagcaugaagcgcuuuaaaaacgaaucugacuccgagggcgcgcugugguga

SEQ ID NO: 18722 - RNA, 9879 nt, Artificial Sequence
  derived and/or modified CDS sequence (opt5) from DENV-1__KJ189359__SS-prME
agcgugaccaugcugcucaugcugcuucccacaguccuggccuuccaccucacgaccagaggcggggagccucauaugaucguuuccaagcaggaacggggaaaaucucugcuuuuuaagacaagcgcuggcgugaacaugugcacccugauugccauggaccucggggagcugugugaagauacaaugaccuacaaaugcccgcgcaucacagaggcggaacccgacgauguggacuguuggugcaaugcuaccgauacgugggucaccuauggaacauguucccaaaccggcgagcacagacgggagaagcgcucuguggcccuggccccucauguugggcucggacuggaaacaagaaccgagacguggaugagcuccgaaggcgcuuggaaacagauucagcggguggagacaugggcccuucgccaccccggcuucaccgucaucgcuuuuuuccuggcccaugcgauugggacaucuaucacccagaagggaaucauuuuuauccuccugaugcuugugaccccuagcauggccaugagaugcguuggcauugggaaccgggacuucguggagggacuguccggcgcuacaugggucgauguggugcucgaacacgggagcugugucacgaccauggccaagaauaaacccacacuggacaucgagcugcucaagaccgaaguuacaaacccugcugugcugcgcaaacuuugcauugaggccaagaucucuaauaccacgacagauuccagauguccgacccaaggagaagcgacccugguggaggagcaggacgccaacuuugucugccggcgcacauucguggauagaggcuggggcaauggguguggacucuuuggcaaagggagccugcuuaccugcgcuaaguucaagugcguuacaaaacuggaaggaaagauugugcaguacgagaaccucaaauauucugucaucgugacgguucacaccggcgaccagcaucaaguggggaaugaaacaaccgagcacggaacaaucgccaccauuacgccccaggcuccuaccuccgaaauccagcugacagauuacggcgcccugacccucgacuguagcccccggacaggccuggacuuuaacgagaugguccuucugaccaugaaggagaaaucuuggcucgugcauaagcagugguuccuggaucuuccucugcccuggacguccggggccagcacaucccaagaaaccuggaaucgccaggaccuccuggucacauuuaaaaccgcucacgcgaagaagcaggaggugguugugcugggaucucaagaaggcgccaugcacaccgcucucacaggggccacggagauucagaccagcggaacaaccacaaucuucgccggccaucugaaaugcagacuuaagauggauaaacugacccucaaggggauguccuaugucauguguacgggcagcuucaaacuggaaaaggagguggcugagacacagcacggaaccguucuggugcaggucaaguacgaaggcaccgacgccccgugcaaaauuccuuuuucuacacaagaugagaagggggugacccagaacggacggcuuaucacagcgaaucccaucgugacggacaaagaaaagccuguuaacauugagaccgagccccccuucggcgaauccuauaucgucgugggggcuggagagaaagcccucaagcugagcugguuuaagagaggcucuagcauugggaaaauguucgaagccacagcucgcggcgcccggagaauggcuauccugggagauaccgccugggacuuuggcuccauugggggaguguucacaucugucggcaagcucgugcaucagguuuuugggaccgcguacggagugcuguucagcggcgucuccuggacgaugaaaaucgggaucggcauucuucugaccuggcucggacugaauagccgcucuacaucccugagcaugaccuguaucgccgugggcaugguuacacuuuaccucggggugaugguccaggcugauucuggaugcgugauuaacuggaagggccgggagcugaaauguggguccggaaucuuuguuaccaacgaagugcacacauggaccgagcaauauaaguuccaggccgacagcccuaagagacuguccgcugccauuggcaaagcgugggaggaaggggucugcggcauccgcucugccacgcggcucgagaauauuauguggaagcagaucagcaacgaacugaaucauauccuucuggagaacgauaugaaauuuacagugguggucggagacgcuaauggcauucucgcccaggggaagaaaaugaucagaccgcaacccauggaacacaaguacuccuggaaaucuuggggaaaggcuaagauuaucggcgccgacauucagaacaccaccuucaucaucgaugggccugacacacccgaguguccugauggacagcgcgccuggaauauuugggagguugaagacuauggcuuuggcguguucaccacgaacaucuggcugaaacugcgggauagcuacacacagaugugcgaccacagacuuauguccgcugcgauuaaggauagcaaagccgugcaugcugacaugggguauuggaucgagucugaaaagaaugagaccuggaaacucgcccgcgccuccuucauugaagucaagacauguaccuggcccaagagccacacacuguggucuaacggagugcuggaguccgagaugaucaucccgaaaauuuacggcgggccuaucagccaacauaauuaucggcccggauacuuuacccagacggcuggcccuuggcaccucgggaagcuggaacuugauuucgaccugugcgagggaaccacaguuguggucgaugaacacugcggcaacagaggccccucucuccggaccacaaccgugacggggaaaauuauccaugagugguguugccgcagcuguacacugccuccccugagauuucggggagaggacggcugcugguacgggauggaaauuagaccgguuaaggagaaagaagagaaucuugugcgcuccauggucagcgccggaucuggcgaaguggauuccuucagccucgggauccuguguguuuccaucaugauugaggaggugaugcggucuagauggagccgcaagaugcugaugaccggaacacucgcggucuuucugcuucugaucaugggccagcucaccuggaacgaccugauuagacugugcaucauggugggcgcuaaugccuccgaccggauggggaugggaaccacauaucuugcccugauggcuacguucaagaugcgcccuauguuugccgugggccuccuguucagacggcucaccucucgcgaaguccugcuucugacaauugggcucagccugguugcguccguggagcugcccaacucucuugaagagcugggagauggccucgcuauggggaucaugaugcugaaacuccugaccgaauuucaaccccaccagcuuuggacaacccugcucagccugacguucgugaagacaacccugucccuugacuacgccuggaaaaccacagccauggcucugagcauugucucucucuuuccucugugucucuccaccacaagccagaagacgaccuggcugccggugcuucugggaucuuucggcugcaaaccccugacaauguuucucaucaccgagaacaagaucuggggcagaaaguccuggccucugaaugaggggauuauggccaucggaauuguuagcauccuucugucuucccuccugaaaaacgaugugccccucgcuggcccucugauugccgggggaaugcuuaucgcguguuaugucaucagcggcuccagcgccgaccugucucuggaaaaggcugccgaggugagcugggaacaggaggcugaacauuccggggccucucacagcauucucguugaggugcaagaugacggaacaaugaaaaucaaggaugaggaacgggacgauacccugacgauucuucugaaagccacccuccuggcugucuccggcguguaccccaugucuaucccugcgacacucuucgucugguauuucuggcagcgcaagaaacagagaagcggcgugcugugggacacccccuccccgccugagguugaacgggccgugcuugauaaugggauuuaccgcauccugcagagaggacugcucggccggucucaagucggggugggaguuuuucaggacggcguguuccauacaauguggcacgucaccagaggggcugugcugauguaucagggaaagcgccuugagcccagcugggccuccgugaagaaagaucugaucagcuacggcggcggguggcgguuucagggaucuuggaacacaggcgaggaaguucaagucauugccguggagccugggaagaaucccaaaaacgugcagacgaccccgggaacauucaagaccccugaaggcgaggucggggcuaucgcccucgacuuuaaacccggaaccuccggcagcccuauugugaauagagaaggcaagaucguugggcuguacggaaacggcguggucacaacgucugggaccuauguguccgcgauugcucaggccaaggccagccaagagggaccccuccccgagaucgaagacgagguuuucaaaaagcgcaaucugacaauuauggaucuucacccuggcuccgggaaaacccggagauaccugccggcuaucgugcgcgaagccaucaagcggaaacugagaacacucauucuggcgcccacccgcgucguggcuucugagauggccgaagcccuuaagggcaugccuauccgguaucagacgacagcuguuaagagcgagcauaccggaagagagauuguggaccugaugugccacgccaccuuuacaaugcggcuccugucccccguccgcgugccuaacuacaauaugaucauuauggaugaagcucauuucaccgaccccgccagcaucgcggccagaggcuauaucucuacacggguggggaugggagaggcugccgcuauuuuuaugaccgccacgccuccgggcuccgucgaagccuucccccagagcaacgcuguuauccaggaugaggaacgcgacauuccugagagaucuuggaauagcggguacgauuggaucacagacuuucccggaaaaaccgugugguucgugccuuccauuaagucuggcaacgauaucgcgaauugucugcggaaaaacgggaagagagucauccaacucagccgcaaaacauucgacaccgaguaucagaagacgaagaacaaugauugggacuacgugguuaccacagacauuuccgaaaugggcgccaacuuucgggcugauagagugaucgacccccgccggugccuuaaaccggucauucugaaggauggaccugagagagugauccuggccggccccaugcccguuaccguggccucugcugcccagcgccgggggagaauuggacgcaaucagaacaaagaaggcgaccaauacgucuauauggggcagccucucaauaacgaugaggaccacgcgcauuggacagaggcuaagaugcugcuugauaauaucaacacccccgaaggaauuaucccugcccuguucgagccggaaagagagaaaagcgccgcuaucgacggcgaauaccggcuccgcggggaggccagaaagacauuuguggagcugaugcggcgcggcgaucugcccgucuggcucuccuauaagguggcgagcgaaggauuccaguacucugacagacgguggugcuuugauggcgagagaaauaaccagguucuugaagagaauauggacguggaaauuuggaccaaagagggggagcgcaagaaacugcggccuagauggcuggaugcccgcacguauuccgacccccucgcucugcgggaauucaaggaguuugccgcuggaagacggagcguguccggcgaccuuauccuggaaauugggaaacucccucaacaccugacacugcgcgcccagaacgcucucgauaaucuugucaugcugcacaacucugagcagggaggcaaggccuacagacaugcgauggaagagcugcccgacaccaucgagacccucaugcugcuugcccugauugcuguucucacaggcggggugacccuguucuuucugagcggaaaaggccucgggaagacauccaucggacuucugugugugacggccucuagcgcucugcucuggauggccuccgucgaaccgcacuggaucgccgcuagcauuauccuggaguucuuucuuauggugcugcucauuccugaacccgaucggcagcgcaccccucaagacaaucagcuggcguauguugugaucggccugcucuucaugauucuuacagucgccgcuaacgagauggggcugcuggagaccacaaagaaagaucucggaaucggcuacguggccgccgaaaaccaucagcacaccacgaugcuggacgucgaucuucaccccgcuucugccuggacccuguacgcgguggccacaaccguuaucacaccuaugaugagacauaccauugagaauacgacagcuaacaucucccucaccgccauugcuaaucaagccgcgauccugaugggccuggacaagggguggcccauuagcaaaaucgauauuggagugccgcuccuugcccugggcugcuauucucaggucaacccucugacacucaccgcugccgugcugaugcuuguugcucacuacgccaucaucgggcccggacugcaggcuaaggccacccgggaagcgcagaaacgcacagccgcuggcauuaugaagaaucccacgguggacgggaucgucgccauugaucucgacccugugguguaugaugcuaaguuugagaaacaacugggacagaucaugcugcucauucuuuguaccucccagauccugcugaugagaacaaccugggcccucugcgaaagcaucacacuggccaccggcccgcuuacgacacugugggagggcucucccgggaaguucuggaacaccaccauugcgguuagcauggcuaauaucuuccggggauccuaccucgccggcgcugggcuggccuuuucucugaugaaaagccucggaggcgggcgcagaggaacaggcgcccagggcgagacccuuggggaaaaguggaaacggcaacugaaccagcuguccaagagcgaguucaauacauauaagagauccggaauuauggaagucgaccgcucugaggcuaaagaaggccucaagcggggggagacgaccaaacaugccgugagcagaggaacagcgaagcugcgcugguuuguggagcggaaccuugucaaaccugaaggcaagguuaucgaccugggguguggaagaggcggcugguccuacuauugcgccgggcucaagaaagugaccgaggugaagggauacacaaaaggcgggcccggacacgaagagccuauucccauggcuaccuacggcuggaaucuggucaagcugcauucugggaaagauguguucuuuaugccuccggaaaagugugacacgcuccuuugcgauaucggagagagcucccccaacccuaccaucgaggaaggccgcacacugcggguucugaaaaugguggagcccuggcucagaggcaaucaguucuguauuaagauccugaacccuuauaugcccucugucguggaaacccuugagcgcaugcagcggaagcacgggggaaugcugguuagaaauccgcucagccgcaacuccacacacgagauguacugggugagcugcggcaccgggaauauugucucugccgugaacaugacaucccggaugcugcugaacagauuuaccauggcucaucgcaaaccuacguaugaaagagacguggaucucggagccggcacacggcacgucgcgguugagcccgaaguggccaaucuggacaucauugggcaacgcaucgagaacauuaagaaugaacauaaaagcaccuggcacuacgaugaggacaaccccuauaagaccugggcuuaccacggaucuuaugaggugaaaccuuccggcagcgccucuuccauggucaauggcgugguuagacuucugacaaagcccugggaugugaucccuauggucacgcagaucgcuaugaccgacacaaccccguucgggcagcaacggguguuuaaggaaaaaguugauacaagaaccccccgggccaagcgcggaacaacccagauuauggaggugacggcuaaauggcucuggggcuuccugagcagaaacaagaaaccucggaucuguacccgcgaagaguuuacaagaaagguccgguccaaugccgcgauuggggccguguucguugacgaaaaccaguggaauaccgcuaaggaggccguggaggacgaacgcuuuugggaucuuguccauagagagcgggaacugcacaaacagggaaagugcgcuacaugcguguacaacaugaugggcaaacgcgagaagaaacucggggaauucggcaaggccaagggaagcagagccaucugguacauguggcugggcgcgcgguuccuggaguuugaggcucucggguucaugaaugaagaccauugguuuucucgcgagaacagccuguccggagucgaaggcgaggggcuucacaaacugggauauauucucagagauaucucuaagauccccggcgggaauauguacgccgacgauaccgccggcugggacacgcggauuacagaggaugaccugcaaaacgaagcuaaaaucaccgauauuauggagccugaacaugcccuucuggcuacaagcaucuucaagcucaccuaucagaauaaagugguucgcgugcagagacccgccaagaacggaacggucauggacgugauuucccggagagaucagcgcggcucugggcaagugggaaccuacggccugaacacauuuaccaauauggagguucagcugauccggcagauggaaagcgaggggaucuuccucccguccgagcuggaaacaccuaaccuugcggagagagcccuggacuggcucgaaaaacacggagcugagcgccugaagcggauggccauuucuggcgaugacuguguggucaagcccaucgacgauagauuugcuaccgcccuuacagcgcugaaugacauggggaaagugcgcaaggauauuccucagugggaacccagcaaaggcuggaacgacuggcaacagguuccuuucugcucccaccauuuucaccagcucaucaugaaggauggacgggagauugugguccccuguagaaaucaggacgagcuggugggccgcgcccgggucagccaaggggcuggauggucucugagagaaaccgccugccucggcaaauccuaugcucagauguggcagcugauguacuuccaucgccgggaucuuagacuggccgcuaacgccaucuguagcgcggugccgguugacugggugccuacgucucggacaaccugguccauccacgcccaccaucaauggaugaccacagaggauaugcucagcgucuggaauagaguguggauugaagagaaccccuggauggaagacaagacccacguuuccucuugggaggaggugcccuaucuggggaagcgcgaagaucaguggugcggaagccuuaucggccugacagcucgggccacgugggccaccaauauucaggucgcuaucaaccaggugagacgccucauugggaaugagaacuaccuggacuacaugacauccaugaaaagauuuaagaaugaaagcgacucugagggcgcccugugguga

SEQ ID NO: 18723 - RNA, 9879 nt, Artificial Sequence
  derived and/or modified CDS sequence (opt5) from DENV-1__KJ189360__SS-prME
agcgugacaaugcugcucaugcugcuucccacagcccuggcuuuccaccucacgacccggggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuuagacaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccgcccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagaucuuugggaccgccuacggagugcuguucagcggcguuuccuggacgaugaaaaucgggauuggcauccuucugaccuggcucggacugaauagccgcucuacaucccugagcaugaccuguauugcugugggcauggucacacuuuaccucggggugaugguucaggccgauucuggaugcgugaucaacuggaagggccgggagcugaaauguggguccggaauuuuugucaccaacgaagugcacacauggaccgagcaauauaaguuccaggcugacagcccuaagagacuguccgccgcgaucggcaaagccugggaggaagggguuugcggcauucgcucugcuacgcggcucgagaauaucauguggaagcagaucagcaacgaacugaaucauauucuucuggagaacgauaugaaauuuacaguggucgugggagacgccaauggcauccucgcucaggggaagaaaaugauuagaccgcaacccauggaacacaaguacuccuggaaaucuuggggaaaggccaagaucauuggcgccgacauccagaacaccaccuucaucauugaugggccugacacacccgaguguccugauggacagcgcgcuuggaauaucugggagguggaagacuauggcuuuggcgucuucaccacgaacauuuggcugaaacugcgggauagcuacacacagaugugcgaccacagacuuauguccgcggccaucaaggauagcaaagcuguucaugccgacaugggguauuggauugagucugaaaagaaugagaccuggaaacucgcccgcgcuuccuucaucgaagugaagacauguaccuggcccaagagccacacacuguggucuaacggagugcuggaguccgagaugaucauuccgaaaaucuacggcgggccuauuagccaacauaauuaucggcccggauacuuuacccagacggccggcccuuggcaccucgggaagcuggaacuugauuucgaccugugcgagggaaccacagucgugguugaugaacacugcggcaacagaggccccucucuccggaccacaaccgugacggggaaaaucauucaugagugguguugccgcagcuguacacugccuccccugagauuucggggagaggacggcugcugguacgggauggaaaucagaccggucaaggagaaagaagagaaucuugugcgcuccaugguuagcgcgggaucuggcgaaguggauuccuucagccucgggauccugugugucuccauuaugaucgaggaggugaugcggucuagauggagccgcaagaugcugaugaccggaacacucgcuguuuuucugcuucugauuaugggccagcucaccuggaacgaccugaucagacugugcauuauggugggcgccaaugccuccgaccggauggggaugggaaccacauaucuugcucugauggccacguucaagaugcgcccuauguuugcggucggccuccuguucagacggcucaccucucgcgaagugcugcuucugacaaucgggcucagccugguggcuuccgucgagcugcccaacucucuugaagaacugggagauggccucgccauggggauuaugaugcugaaacuccugaccgaauuucaaccccaccagcuuuggacaacccugcucagccugacguucguuaagacaacccugucccuugacuacgccuggaaaaccacagcuauggcccugagcaucgugucucucuuuccucugugucucuccaccacaagccagaagacgaccuggcugccggugcuucugggaucuuucggcugcaaaccccugacaauguuucucaucaccgagaacaagauuuggggcagaaaguccuggccucugaaugaggggaucauggcuauuggaaucgucagcauucuucugucuucccuccugaaaaacgaugugccccucgccggcccucugaucgccgggggaaugcuuaucgccuguuauguuauuagcggcuccagcgcugaccugucucuggaaaaggccgcugaggugagcugggaacaggaggccgaacauuccggggccucucacagcauccucgucgaggugcaagaugacggaacaaugaaaauuaaggaugaggaacgggacgauacccugacgauccuucugaaagcuacccuccuggcgguuuccggcguguaccccaugucuauuccugccacacucuucgucugguauuucuggcagaagaaaaagcagcgcagcggcgugcugugggacacccccuccccgccugaggucgaaagagcugugcuugauaaugggaucuaccggauccugcagcgcggacugcucggcagaucucaaguuggggugggagucuuucaggacggcguguuccauacaauguggcacguuaccagaggggcggugcugauguaucagggaaagcggcuugagcccagcugggccuccgucaaaaaggaucugauuagcuacggcggcggguggcgcuuucagggaucuuggaacacaggcgaggaagugcaagugaucgcuguugagccugggaaaaaucccaagaacguccagacgaccccgggaacauucaaaaccccugaaggcgaggugggggccauugcgcucgacuuuaagcccggaaccuccggcagcccuaucgugaaucgggaaggcaagauugucgggcuguacggaaacggcgugguuacaacgucugggaccuauguguccgcuaucgcccaggccaaagcuagccaagagggaccccuccccgagauugaagacgaggucuucaagaaaagaaaucugacaaucauggaucuucacccuggcuccgggaagacccgccgguaccugccggccaucgugagagaagcgauuaaacgcaagcugcggacacucauccuggcucccaccagaguuguggccucugagauggccgaagcucuuaagggcaugccuauucgcuaucagacgacagccgucaaaagcgagcauaccggacgggagaucguggaccugaugugccacgcuaccuuuacaaugagacuccugucccccguucgggugccuaacuacaauaugauuaucauggaugaagcccauuucaccgaccccgcgagcaucgccgcucgcggcuauauuucuacaagagucgggaugggagaggccgcugccaucuuuaugaccgccacgccuccgggcuccguggaggcuuucccccagagcaacgcggugauucaggaugaggaacgggacaucccugagcgcucuuggaauagcggguacgauuggauuacagacuuucccggaaagaccgucugguucguuccuuccaucaaaucuggcaacgauaucgccaauugucugagaaagaacgggaaacgggugauucaacucagcagaaagacauucgacaccgaguaucagaagacgaaaaacaaugauugggacuacguggucaccacagacaucuccgaaaugggcgcuaacuuucgcgccgaucgggugauugaccccagacgcugccuuaagccgguuauccugaaagauggaccugagcgggugauucuggccggccccaugcccgucaccgcugccucugcggcucagagacgcgggcggaucggaagaaaucagaacaaggaaggcgaccaauacguguauauggggcagccucucaauaacgaugaggaccacgcccauuggacagaggccaaaaugcugcuugauaauauuaacacccccgaaggaaucaucccugcucuguucgagccggaacgcgaaaagagcgccgcgauugacggcgaauacagacucagaggggaagcccgcaagacauuuguugagcugaugagacggggcgaucugcccguguggcucuccuauaaagucgcuagcgaaggauuccaguacucugaccgcagauggugcuuugauggcgagcggaauaaccaggugcuugaagagaauauggacgucgaaaucuggaccaaggagggggagcgcaagaagcugcgcccucgguggcuggaugccagaacguauuccgacccccucgcucugcgcgaguucaaagaguuugccgcuggacggagaagcguguccggcgaccuuauucuggaaaucgggaagcucccucaacaccugacacugcgggcccagaacgcgcucgauaaucuuguuaugcugcacaacucugagcagggaggcaaagccuaccgccaugcuauggaggaacugcccgacaccauugagacccucaugcugcuugcccugaucgcugugcucacaggcggggugacccuguucuuucugagcggaaagggccucgggaagacauccaucggacuucugugugucacggccucuagcgcccugcucuggauggcuuccguugaaccgcacuggauugcggccagcaucauucuggaguucuuucuuauggugcugcucaucccugaacccgauagacagcggaccccucaagacaaucagcuggcuuauguggucauuggccuccuguucaugauccuuacaguggccgccaacgagauggggcugcuggagaccaccaaaaaggaucucggaaucggcuacguugcugccgaaaaccaucagcacgcgaccaugcuggacguggaucuucaccccgccucugcuuggacgcuguacgccgucgcuaccacagugauuaccccuaugaugcgccauacaaucgagaauaccacggccaacauuucccucacagcgaucgccaaucaagcugccauucugaugggccuggacaaaggguggcccaucagcaagauggauauuggagucccgcuccuugcucugggcugcuauucucaggugaacccucugacccucacagccgcuguucugaugcuuguggcccacuacgcgaucaucgggcccggacugcaggccaaagcuaccagagaagcccagaagcggaccgcugccggcauuaugaagaaucccacagucgacgggaucguggccauugaucucgacccuguuguguaugaugcgaaauuugagaagcaacugggacagaucaugcugcucauucuuuguacgucccagauccugcugaugcgcaccacaugggcucucugcgaaagcaucacccuggccacaggcccgcuuaccacgcugugggagggcucucccgggaaauucuggaacacaaccauugcugucagcauggccaauaucuucagaggauccuaccucgccggcgcugggcuggccuuuucucugaugaaaagccucggaggcgggcggcgcggaaccggcgcgcagggcgagacacuuggggaaaaauggaagagacaacugaaccagcuguccaagagcgaguucaauaccuauaaacgguccggaauuauggaaguggacagaucugaggccaaggaaggccucaaacgcggggagacaacgaagcaugcugugagccggggaaccgccaaacugagaugguuuguugagcgcaaccuugucaagccugaaggcaaggugaucgaccugggguguggacggggcggcugguccuacuauugcgcugggcucaaaaaggugacagaggucaaaggauacaccaagggcgggcccggacacgaggaaccuauucccauggccacauacggcuggaaucugguuaaacugcauucugggaaggauguguucuuuaugccuccggaaaaaugugacacccuccuuugcgauaucggagagagcucccccaacccuacgaucgaggaaggcagaacccugcgcgugcugaagauggucgagcccuggcuccggggcaaucaguucuguauuaagauccugaacccuuauaugcccucugugguugaaacacuugagagaaugcagcgcaaacacgggggaaugcuggugcggaauccgcucagcagaaacuccacccacgagauguacugggucagcugcggcacagggaauauugugucugcgguuaacaugaccucccgcaugcugcugaaccgguuuacaauggcccauagaaagccuaccuaugaacgcgacguggaucucggagcuggcacgagacacgucgccguggagcccgaaguggcuaaucuggacaucauugggcaacggaucgagaacauuaaaaaugaacauaagagcacauggcacuacgaugaggacaaccccuauaaaaccugggccuaccacggaucuuaugaggucaagccuuccggcagcgcuucuuccaugguuaauggcguggugcgccuucugaccaagcccugggaugucaucccuauggugacacagaucgccaugacggacaccacaccguucgggcagcaaagaguuuuuaaagaaaagguggauacccggacacccagagcgaaacggggaaccacacagauuauggaggucaccgccaaguggcucuggggcuuccugagccgcaacaaaaagccuagaaucuguacgcgggaagaguuuacccgcaaggugagauccaaugcugccauuggggcuguuuucguggacgaaaaccaguggaauagcgccaaagaggccgucgaggacgaacgguuuugggaucuugugcaucgcgagagagaacugcacaagcagggaaaaugcgcgacaugcguuuacaacaugaugggcaagcgggagaaaaagcucggggaguucggcaaggcuaaaggaucucgcgccaucugguacauguggcugggcgccagauuccuggaguuugaggcucucggguucaugaaugaagaccauugguuuagccgggagaacucccugucuggaguggaaggcgaggggcuucacaagcugggauauauucuccgcgauaucagcaaaauccccggcgggaauauguacgccgacgauaccgcuggcugggacacaagagucaccgaggaugaccugcaaaacgaagccaagauuacggauaucauggagccugaacaugcgcuucuggccacauccauuuucaaacucaccuaucagaauaaggugguccgggugcagcgccccgcuaaaaacggaacaguuauggacgugaucucuagacgggaucagagaggcagcgggcaagucggaaccuacggccugaacacguuuaccaauauggaggugcagcugauucgccagauggaauccgaggggaucuuccucccgucugagcuggaaacaccuaaccuugccgagcgggcucuggacuggcucgaaaagcacggagccgagagacugaagcgcauggcgaucagcggcgaugacugugugguuaaacccauugacgaucgguuugccaccgcucuuacagcccugaaugacauggggaaggugagaaaagauaucccucagugggaacccuccaagggcuggaacgacuggcaacaggucccuuucugcagccaccauuuucaccagcucauuaugaaagauggacgcgagaucgugguucccugucggaaucaggacgagcuggugggcagagcucgcgucucucaaggggccggauggucccugcgggaaaccgcuugccucggcaagagcuaugcccagauguggcagcugauguacuuccauagacgcgaucuucggcuggcggccaacgcuauuuguucugccgugccggucgacugggugccuacauccagaaccacguggagcauccacgcccaccaucaauggaugacaaccgaggauaugcucuccguuuggaaucggguguggaucgaagagaaccccuggauggaaaauaagacccacgucucuagcugggaggaggugcccuaucuggggaaaagagaagaccaguggugcggaucccuuauuggccugacagcucgcgccaccugggcgacaaacauccagguugcuauuaaucaggugcggagacucaucgggaacgagaauuaccuggauuacaugacgagcaugaagcgcuuuaaaaacgaaucugacuccgagggcgcccugugguga

SEQ ID NO: 18724 - RNA, 9879 nt, Artificial Sequence
  derived and/or modified CDS sequence (opt5) from DENV-1__KJ189361__SS-prME
agcgugacaaugcugcucaugcugcuucccacagccauggcuuuccaccugacgacccggggcggggagccucauaugaucguguccaagcaggaacggggaaagucucuccuguuuaagacaagcgccggcguuaacaugugcacccuuauugcgauggaccugggggagcucugugaagauacaaugaccuacaaaugccccagaaucacagaggcugaacccgacgauguggacuguuggugcaaugccaccgauacgugggugaccuauggaacauguucccaaaccggcgagcacagacgggagaagcgcucugucgcccuggcuccucauguggggcugggacucgaaacaagaaccgagacguggaugagcuccgaaggcgccuggaaacagauucagcggguugagacaugggcucugcgccaccccggcuucaccgugaucgccuuuuuccuugcgcaugccauugggacaucuaucacccagaagggaaucauuuuuauccugcucaugcuggucaccccuagcauggcuaugagaugcgugggcauugggaaccgggacuucguugagggacuuuccggcgccacauggguggaugucgugcuggaacacgggagcugugugacgaccauggcuaagaauaaacccacacucgacaucgagcugcugaagaccgaagucacaaacccugccguucuccgcaaacugugcauugaggcgaagaucucuaauaccacgacagauuccagauguccgacccaaggagaagccacccuuguggaggagcaggacgcuaacuuugugugccggcgcacauucgucgauagaggcuggggcaauggguguggacuguuuggcaaagggagccuccugaccugcgccaaguucaagugcgugacaaaacuugaaggaaagauuguucaguacgagaaccugaaauauucugugaucgucacggugcacaccggcgaccagcaucaaguugggaaugaaacaaccgagcacggaacaaucgcuaccauuacgccccaggccccuaccuccgaaauccagcucacagauuacggcgcccugacccuggacuguagcccccggacaggccucgacuuuaacgagauggugcugcuuaccaugaaggagaaaucuuggcugguccauaagcagugguuccucgaucugccucuucccuggacguccggggcuagcacaucccaagaaaccuggaaucgccaggaccugcucgugacauuuaaaaccgcgcacgccaagaagcaggaggucgugguucugggaucucaagaaggcgcuaugcacaccgcccugacaggggccacggagauucagaccagcggaacaaccacaaucuucgcuggccaucucaaaugcagacugaagauggauaaacuuacccugaaggggauguccuaugugauguguacgggcagcuucaaacucgaaaaggaggucgccgagacacagcacggaaccgugcugguucaggugaaguacgaaggcaccgacgcgccgugcaaaauuccuuuuucuacacaagaugagaagggggucacccagaacggacggcugaucacagcuaaucccaucgugacggacaaagaaaagccugugaacauugagaccgagccgcccuucggcgaauccuauaucguugucggggccggagagaaagcccuuaagcucagcugguuuaagagaggcucuagcauugggaaaauguucgaagcuacagcccgcggcgcucggagaauggccauccugggagauaccgcgugggacuuuggcuccauugggggaguguucacaucugugggcaagcugguccaucagaucuuugggaccgccuacggaguccuguucagcggcguuuccuggacgaugaaaaucgggauuggcauccugcuuaccuggcugggacucaauagccgcucuacaucccugagcaugaccuguauugcugugggcauggucacacuguaccuuggggugaugguucaggccgauucuggaugcgugaucaacuggaagggccgggagcucaaauguggguccggaauuuuugucaccaacgaagugcacacauggaccgagcaauauaaguuccaggcugacagcccuaagagacuguccgccgcgaucggcaaagccugggaggaagggguuugcggcauucgcucugcuacgcggcuggagaauaucauguggaagcagaucagcaacgaacucaaucauauucugcuugagaacgauaugaaauuuacaguggucgugggagacgccaauggcauccuggcucaggggaagaaaaugauuagaccgcaacccauggaacacaaguacuccuggaaaucuuggggaaaggccaagaucauuggcgccgacauccagaacaccaccuucaucauugaugggccugacacacccgaguguccugauggacagcgcgcuuggaauaucugggagguggaagacuauggcuuuggcgucuucaccacgaacauuuggcucaaacugcgggauagcuacacacagaugugcgaccacagacugauguccgcggccaucaaggauagcaaagcuguucaugccgacaugggguauuggauugagucugaaaagaaugagaccuggaaacuugcccgcgcuuccuucaucgaagugaagacauguaccuggcccaagagccacacacucuggucuaacggagugcuggaguccgagaugaucauuccgaaaaucuacggcgggccuauuagccaacauaauuaucggcccggauacuuuacccagacggccggcccuuggcaccuggggaagcucgaacuggauuucgaccuuugcgagggaaccacagucgugguugaugaacacugcggcaacagaggccccucucugcggaccacaaccgugacggggaaaaucauucaugagugguguugccgcagcuguacacucccuccccugagauuucggggagaggacggcugcugguacgggauggaaaucagaccggucaaggagaaagaagagaaucuggugcgcuccaugguuagcgcgggaucuggcgaaguggauuccuucagccuugggauccucugugucuccauuaugaucgaggaggugaugcggucuagauggagccgcaagaugcugaugaccggaacacuggcuguuuuucuccugcuuauuaugggccagcugaccuggaacgaccucaucagacugugcauuauggugggcgccaaugccuccgaccggauggggaugggaaccacauaucuggcucuuauggccacguucaagaugcgcccuauguuugcggucggccuccucuucagacggcugaccucucgcgaagugcuccugcuuacaaucgggcugagccucguggcuuccgucgagcugcccaacucucuggaagaacuuggagauggccuggccauggggauuaugaugcucaaacugcucaccgaauuucaaccccaccagcuguggacaacccuucugagccucacguucguuaagacaacccugucccuggacuacgccuggaaaaccacagcuauggcccuuagcaucgugucucuguuuccucucugucuguccaccacaagccagaagacgaccuggcucccggugcugcuuggaucuuucggcugcaaaccccugacaauguuucugaucaccgagaacaagauuuggggcagaaaguccuggccucucaaugaggggaucauggcuauuggaaucgucagcauucugcuuucuucccugcucaaaaacgaugugccccuggccggcccucucaucgccgggggaaugcugaucgccuguuauguuauuagcggcuccagcgcugaccuuucucuggaaaaggccgcugaggugagcugggaacaggaggccgaacauuccggggccucucacagcauccuggucgaggugcaagaugacggaacaaugaaaauuaaggaugaggaacgggacgauacccucacgauccugcuuaaagcuacccugcucgcgguuuccggcguguaccccaugucuauuccugccacacuguucgucugguauuucuggcagaagaaaaagcagcgcagcggcgugcucugggacacccccuccccgccugaggucgaaagagcugugcuggauaaugggaucuaccggauccuucagcgcggacugcugggcagaucucaaguuggggugggagucuuucaggacggcguguuccauacaauguggcacguuaccagaggggcggugcucauguaucagggaaagcggcuggagcccagcugggccuccgucaaaaaggaucuuauuagcuacggcggcggguggcgcuuucagggaucuuggaacacaggcgaggaagugcaagugaucgcuguugagccugggaaaaaucccaagaacguccagacgaccccgggaacauucaaaaccccugaaggcgaggugggggccauugcgcuggacuuuaagcccggaaccuccggcagcccuaucgugaaucgggaaggcaagauugucgggcucuacggaaacggcgugguuacaacgucugggaccuauguguccgcuaucgcccaggccaaagcuagccaagagggaccccugcccgagauugaagacgaggucuucaagaaaagaaaucucacaaucauggaucugcacccuggcuccgggaagacccgccgguaccuuccggccaucgugagagaagcgauuaaacgcaagcugcggacacugauccucgcucccaccagaguuguggccucugagauggccgaagcucugaagggcaugccuauucgcuaucagacgacagccgucaaaagcgagcauaccggacgggagaucguggaccuuaugugccacgcuaccuuuacaaugagacugcucucccccguucgggugccuaacuacaauaugauuaucauggaugaagcccauuucaccgaccccgcgagcaucgccgcucgcggcuauauuucuacaagagucgggaugggagaggccgcugccaucuuuaugaccgccacgccuccgggcuccguggaggcuuucccccagagcaacgcggugauucaggaugaggaacgggacaucccugagcgcucuuggaauagcggguacgauuggauuacagacuuucccggaaagaccgucugguucguuccuuccaucaaaucuggcaacgauaucgccaauugucugagaaagaacgggaaacgggugauucaacugagcagaaagacauucgacaccgaguaucagaagacgaaaaacaaugauugggacuacguggucaccacagacaucuccgaaaugggcgcuaacuuucgcgccgaucgggugauugaccccagacgcugccucaagccgguuauccuuaaagauggaccugagcgggugauucuggccggccccaugcccgucaccgcugccucugcggcucagagacgcgggcggaucggaagaaaucagaacaaggaaggcgaccaauacguguauauggggcagccucugaauaacgaugaggaccacgcccauuggacagaggccaaaaugcuccuggauaauauuaacacccccgaaggaaucaucccugcucuuuucgagccggaacgcgaaaagagcgccgcgauugacggcgaauacagacugagaggggaagcccgcaagacauuuguugagcucaugagacggggcgaucugcccguguggcuguccuauaaagucgcuagcgaaggauuccaguacucugaccgcagauggugcuuugauggcgagcggaauaaccaggugcucgaagagaauauggacgucgaaaucuggaccaaggagggggagcgcaagaaacuucgcccucgguggcuggaugccagaacguauuccgacccccuggcucuccgcgaguucaaagaguuugccgcuggacggagaagcguguccggcgaccugauucuugaaaucgggaagcugccucaacaccucacacugcgggcccagaacgcgcuggauaaucucguuaugcuucacaacucugagcagggaggcaaagccuaccgccaugcuauggaggaacugcccgacaccauugagacccugaugcuccuggcccuuaucgcugugcugacaggcggggugacccucuucuuucugagcggaaagggccuggggaagacauccaucggacuccuuugugucacggccucuagcgcccugcuguggauggcuuccguugaaccgcacuggauugcggccagcaucauucucgaguucuuucugauggugcuucugaucccugaacccgauagacagcggaccccucaagacaaucagcucgcuuauguggucauuggccugcuguucaugauccucacaguggccgccaacgagauggggcuucuggagaccaccaagaaggaucugggaaucggcuacguugcugccgaaaaccaucagcacgcgaccaugcucgacguggaucugcaccccgccucugcuuggacgcuuuacgccgucgcuaccacagugauuaccccuaugaugcgccauacaaucgagaauaccacggccaacauuucccugacagcgaucgccaaucaagcugccauucucaugggccuggacaaaggguggcccaucagcaagauggauauuggagucccgcugcucgcucuuggcugcuauucucaggugaacccucugacccugacagccgcuguucucaugcugguggcccacuacgcgaucaucgggcccggacuucaggccaaagcuaccagagaagcccagaagcggaccgcugccggcauuaugaagaaucccacagucgacgggaucguggccauugaucuggacccuguuguguaugaugcgaaauuugagaagcaacucggacagaucaugcugcugauucucuguacgucccagauccuucugaugcgcaccacaugggcucugugcgaaagcaucacccucgccacaggcccgcugaccacgcuuugggagggcucucccgggaaauucuggaacacaaccauugcugucagcauggccaauaucuucagaggauccuaccuggccggcgcugggcucgccuuuucucugaugaaaagccugggaggcgggcggcgcggaaccggcgcgcagggcgagacacucggggaaaaauggaagagacaacuuaaccagcuguccaagagcgaguucaauaccuauaaacgguccggaauuauggaaguggacagaucugaggccaaggaaggccugaaacgcggggagacaacgaagcaugcugugagccggggaaccgccaaacucagaugguuuguugagcgcaaccuggucaagccugaaggcaaggugaucgaccuuggguguggacggggcggcugguccuacuauugcgcugggcugaaaaaggugacagaggucaaaggauacaccaagggcgggcccggacacgaggaaccuauucccauggccacauacggcuggaaucucguuaaacugcauucugggaaggauguguucuuuaugccuccggaaaaaugugacacccugcucugcgauaucggagagagcucccccaacccuacgaucgaggaaggcagaacccuucgcgugcugaagauggucgagcccuggcugcggggcaaucaguucuguauuaagauccucaacccuuauaugcccucugugguugaaacacuggagagaaugcagcgcaaacacgggggaaugcuugugcggaauccgcugagcagaaacuccacccacgagauguacugggucagcugcggcacagggaauauugugucugcgguuaacaugaccucccgcaugcuccugaaccgguuuacaauggcccauagaaagccuaccuaugaacgcgacguggaucugggagcuggcacgagacacgucgccguggagcccgaaguggcuaaucucgacaucauugggcaacggaucgagaacauuaaaaaugaacauaagagcacauggcacuacgaugaggacaaccccuauaaaaccugggccuaccacggaucuuaugaggucaagccuuccggcagcgcuucuuccaugguuaauggcguggugcgccugcuuaccaagcccugggaugucaucccuauggugacacagaucgccaugacggacaccacaccguucgggcagcaaagaguuuuuaaagaaaagguggauacccggacacccagagcgaaacggggaaccacacagauuauggaggucaccgccaaguggcuguggggcuuccucagccgcaacaaaaagccuagaaucuguacgcgggaagaguuuacccgcaaggugagauccaaugcugccauuggggcuguuuucguggacgaaaaccaguggaauagcgccaaagaggccgucgaggacgaacgguuuugggaucuggugcaucgcgagagagaacuucacaagcagggaaaaugcgcgacaugcguuuacaacaugaugggcaagcgggagaaaaagcugggggaguucggcaaggcuaaaggaucucgcgccaucugguacauguggcucggcgccagauuccuggaguuugaggcucugggguucaugaaugaagaccauugguuuagccgggagaacucccucucuggaguggaaggcgaggggcugcacaaacuuggauauauucugcgcgauaucagcaaaauccccggcgggaauauguacgccgacgauaccgcuggcugggacacaagagucaccgaggaugaccuccaaaacgaagccaagauuacggauaucauggagccugaacaugcgcugcuugccacauccauuuucaaacugaccuaucagaauaaggugguccgggugcagcgccccgcuaaaaacggaacaguuauggacgugaucucuagacgggaucagagaggcagcgggcaagucggaaccuacggccucaacacguuuaccaauauggaggugcagcugauucgccagauggaauccgaggggaucuuccugccgucugagcucgaaacaccuaaccuggccgagcgggcucuugacuggcuggaaaagcacggagccgagagacucaagcgcauggcgaucagcggcgaugacugugugguuaaacccauugacgaucgguuugccaccgcucugacagcccuuaaugacauggggaaggugagaaaagauaucccucagugggaacccuccaagggcuggaacgacuggcaacaggucccuuucugcagccaccauuuucaccagcugauuaugaaagauggacgcgagaucgugguucccugucggaaucaggacgagcucgugggcagagcucgcgucucucaaggggccggauggucccugcgggaaaccgcuugccugggcaagagcuaugcccagauguggcagcucauguacuuccauagacgcgaucugcggcuugcggccaacgcuauuuguucugccgugccggucgacugggugccuacauccagaaccacguggagcauccacgcccaccaucaauggaugacaaccgaggauaugcuguccguuuggaaucggguguggaucgaagagaaccccuggauggaagacaagacccacgucucuagcugggaggaggugcccuaucucgggaaaagagaagaucaguggugcggaucccugauuggccuuacagcucgcgccaccugggcgacaaauauccagguugcuauuaaccaggugcggagacugaucgggaaugagaacuaccucgacuacaugacgagcaugaagcgcuuuaaaaaugaaucugacuccgagggcgcccugugguga

SEQ ID NO: 18725 - RNA, 9879 nt, Artificial Sequence
  derived and/or modified CDS sequence (opt5) from DENV-1__KJ189362__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacacucgucgauagaggcuggggcaauggguguggacuguucggcaaagggagccuucugaccugcgccaaguuuaagugcgugacaaaacucgaaggaaagauuguucaguacgagaaccugaaauauucugugaucgucacggugcacaccggcgaccagcaucaaguugggaaugaaacaaccgagcacggaacaaucgcuaccauuacgccccaggccccuaccuccgaaauccagcugacagauuacggcgcccucacccuggacuguagcccccggacaggccuugacuucaacgagauggugcugcucaccaugaaggagaaaucuuggcugguccauaagcagugguuucuugaucugccucuccccuggacguccggggcuagcacaucccaagaaaccuggaaucgccaggaccugcuggugacauucaaaaccgcgcacgccaagaagcaggaggucgugguucucggaucucaagaaggcgcuaugcacaccgcccugacaggggccacggagauucagaccagcggaacaaccacaaucuuugcuggccaucuuaaaugcagacugaagauggauaaacucacccugaaggggauguccuaugugauguguacgggcagcuucaaacuggaaaaggaggucgccgagacacagcacggaaccgugcuuguucaggugaaguacgaaggcaccgacgcgccgugcaaaauuccuuucucuacacaagaugagaaggggaugacccagaacggacggcucaucacagcuaaucccaucgucacggacaaagaaaagccugugaacauugagaccgagccccccuuuggcgaauccuauaucgugguuggggccggagagaaagcccugaagcugagcugguucaagagaggcucuagcauugggaaaauguuugaagcuacagcccgcggcgcucggagaauggccauccucggagauaccgcgugggacuucggcuccauugggggagucuuuacaucugugggcaagcuggugcaucagaucuucgggaccgccuacggaguccuuuuuagcggcguguccuggacgaugaaaaucgggauuggcauccugcucaccuggcugggacugaauagccgcucuacaucccuuagcaugaccuguauugcuguuggcauggugacacucuaccugggggucauggugcaggccgauucuggaugcguuaucaacuggaagggccgggagcugaaauguggguccggaauuuucgugaccaacgaaguccacacauggaccgagcaauauaaguuucaggcugacagcccuaagagacucuccgccgcgaucggcaaagccugggaggaaggggugugcggcauucgcucugcuacgcggcuggagaauaucauguggaagcagaucagcaacgaacuuaaucauauucugcucgagaacgauaugaaauucacaguuguggucggagacgccaauggcauccuggcucaggggaagaaaaugauuagaccgcaacccauggaacacaaguacuccuggaaaucuuggggaaaggccaagaucauuggcgccgacauccagaacaccaccuuuaucauugaugggccugacacacccgaguguccugauggacagcgcgcuuggaauaucugggagguggaagacuauggcuucggcguguuuaccacgaacauuuggcugaaacuucgggauagcuacacacagaugugcgaccacagacucauguccgcggccaucaaggauagcaaagcuguccaugccgacaugggguauuggauugagucugaaaagaaugagaccuggaaacuggcccgcgcuuccuucaucgaaguuaagacauguaccuggcccaagagccacacacuguggucuaacggagugcucgaguccgagaugaucauuccgaaaaucuacggcgggccuauuagccaacauaauuaucggcccggauacuucacccagacggccggcccuuggcaccuggggaagcuugaacuggauuuugaccucugcgagggaaccacaguggucguggaugaacacugcggcaacagaggccccucucugcggaccacaaccguuacggggaaaaucauucaugagugguguugccgcagcuguacacugccuccccuuagauuccggggagaggacggcugcugguacgggauggaaaucagaccggugaaggagaaagaagagaaucucguccgcuccauggugagcgcgggaucuggcgaaguugauuccuuuagccuggggauccuguguguguccauuaugaucgaggaggucaugcggucuagauggagccgcaagaugcucaugaccggaacacuggcuguguuccuucugcucauuaugggccagcugaccuggaacgaccugaucagacuuugcauuaugguuggcgccaaugccuccgaccggauggggaugggaaccacauaucuggcucucauggccacguuuaagaugcgcccuauguucgcggugggccugcucuuuagacggcugaccucucgcgaaguccuucugcucacaaucgggcugagccugguggcuuccguggagcuucccaacucucuggaagagcucggagauggccuggccauggggauuaugaugcucaaacugcuuaccgaauuccaaccccaccagcuguggacaacccuccugagccugacguuugucagaacaacccuuucccuggacuacgccuggaagaccacagcuauggcccucagcaucguuucucuguucccucucugucuguccaccacaagccagaaaacgaccuggcuuccggugcugcugggaucuuuuggcugcaagccccucacaauguuccugaucaccgagaacaaaauuuggggccggaaguccuggccucuuaaugaggggaucauggcuauuggaaucgugagcauucugcucucuucccugcucaagaacgaugucccccuggccggcccucuuaucgcggggggaaugcugaucgccuguuaugugauuagcggcuccagcgcugaccugucucucgaaaaagccgcugagguuagcugggaacaggaggccgaacauuccggggccucucacagcauccugguggagguccaagaugacggaacaaugaagauuaaagaugaggaacgcgacgauacccuuacgauccugcucaaggcuacccugcucgcgguguccggcguuuaccccaugucuauuccugccacacuguuugugugguauuucuggcagaaaaagaaacagagaagcggcguccuuugggacacccccuccccgccugagguggaacgggcuguccuggauaaugggaucuaccgcauccugcagagaggacuccugggccggucucaaguggggguuggaguguuccaggacggcgucuuucauacaauguggcacgugaccagaggggccguucuuauguaucagggaaagcgccuggagcccagcugggccuccgugaagaaagaucucauuagcuacggcggcggguggcgguuccagggaucuuggaacacaggcgaggaaguccaagugaucgcuguggagccugggaagaaucccaaaaacguucagacgaccccgggaacauuuaagaccccugaaggcgaggucggggccauugcgcuggacuucaaacccggaaccuccggcagcccuaucgugaauagagaaggcaagauuguggggcucuacggaaacggcgucgugacaacgucugggaccuauguuuccgcuaucgcccaggccaaggcuagccaagagggaccccugcccgagauugaagacgagguguuuaaaaagcgcaaucuuacaaucauggaucugcacccuggcuccgggaaaacccggagauaccugccggccaucguccgcgaagcgauuaagcggaaacucagaacacugauccuugcucccacccgcgugguugccucugagauggccgaagcucugaagggcaugccuauucgguaucagacgacagccgugaagagcgagcauaccggaagagagaucgucgaccucaugugccacgcuaccuucacaaugcggcugcugucccccgugcgcguuccuaacuacaauaugauuaucauggaugaagcccauuuuaccgaccccgcgagcaucgccgcuagaggcuauauuucuacacggguggggaugggagaggccgcugccaucuucaugaccgccacgccuccgggcuccgucgaagcuuuuccccagagcaacgcggugauucaggaugaggaacgcgacaucccugagagaucuuggaauagcggguacgauuggauuacagacuuccccggaaaaaccgugugguuugucccuuccaucaagucuggcaacgauaucgccaauugucuccggaaaaacgggaagagaguuauucaacuuagccgcaaaacauucgacaccgaguaucagaagacgaagaacaaugauugggacuacguggugaccacagacaucuccgaaaugggcgcuaacuuccgggccgauagagucauugacccccgccggugccugaaaccggugauccugaaggauggaccugagagaguuauucucgccggccccaugcccgugaccgcugccucugcggcucagcgccgggggagaaucggacgcaaucagaacaaagaaggcgaccaauacgucuauauggggcagccucugaauaacgaugaggaccacgcccauuggacagaggccaagaugcuucuggauaauauuaacacccccgaaggaaucaucccugcucucuuugagccggaaagagagaaaagcgccgcgauugacggcgaauaccggcugcgcggggaggccagaaagacauucguggagcugaugcggcgcggcgaucuccccguuuggcuuuccuauaagguggcuagcgaaggauuucaguacucugacagacgguggugcuucgauggcgagagaaauaaccagguccuggaagagaauauggacguggaaaucuggaccaaagagggggagcgcaagaaacugcggccuagauggcucgaugcccgcacguauuccgacccccuggcucuucgggaauuuaaggaguucgccgcuggaagacggagcgucuccggcgaccugauucucgaaaucgggaaacugccucaacaccugacacuccgcgcccagaacgcgcuugauaaucuggugaugcugcacaacucugagcagggaggcaaggccuacagacaugcuauggaagagcuccccgacaccauugagacccugaugcuucuggcccucaucgcuguucugacaggcggggugacccuguuuuuccucagcggaaaaggccuugggaagacauccaucggacugcugugugugacggccucuagcguccuccuguggauggccuccguugaaccgcacuggauugcugcgagcaucauucuugaguuuuuccugauggugcuccugaucccugaacccgaucggcagcgcaccccucaagacaaucagcuggccuauguggucauuggccuccuuuuuaugauccugacaguggcugccaacgagauggggcugcucgagaccacaaagaaagaucugggaaucggcuacguugccgcugaaaaccaucagcacgccaccaugcuugacguggaucugcaccccgcgucugccuggacgcucuacgcugucgccaccacagugauuaccccuaugaugagacauacaaucgagaauaccacggcuaacauuucccugacagccaucgcgaaucaagccgcuauucugaugggccucgacaagggguggcccaucagcaaaauggauauuggagucccgcuucuggcccugggcugcuauucucaggugaacccucucacccugacagcugccguucuuaugcugguggcucacuacgccaucaucgggcccggacuccaggcgaaggccacccgggaagcucagaaacgcaccgccgcuggcauuaugaagaaucccacagucgacgggaucguggccauugaucuggacccuguuguguaugaugccaaguucgagaaacaacugggacagaucaugcuccuuauucuguguacgucccagauccugcucaugagaaccacaugggcgcugugcgaaagcaucacccuugcuacaggcccgcugaccacgcucugggagggcucucccgggaaguuuuggaacacaaccauugccgucagcauggcuaauaucuuccggggauccuaccuggccggcgccgggcuggcuuucucucucaugaaaagccuuggaggcgggcgcagaggaaccggcgcccagggcgagacacugggggaaaaguggaaacggcaacugaaccagcucuccaagagcgaguuuaauaccuauaagagauccggaauuauggaaguggaccgcucugaggcgaaagaaggccugaagcggggggagacaacgaaacaugccgugagcagaggaaccgcuaagcuucgcugguucguugagcggaaccuggucaaaccugaaggcaaggugaucgaccucggguguggaagaggcggcugguccuacuauugcgccgggcugaagaaagugacagaggucaagggauacaccaaaggcgggcccggacacgaagagccuauucccauggcuacauacggcuggaaucugguuaagcuccauucugggaaagauguguuuuucaugccuccggaaaagugugacacccuucugugcgauaucggagagagcucccccaacccuacgaucgaggaaggccgcacccugcgggugcucaaaauggucgagcccuggcugagaggcaaucaguuuuguauuaagauccuuaacccuuauaugcccucugugguugaaacacuggagcgcaugcagcggaagcacgggggaaugcucgugagaaauccgcugagccgcaacuccacccacgagauguacugggucagcugcggcacagggaauauugugucugccguuaacaugaccucccggaugcugcucaacagauucacaauggcgcaucgcaaaccuaccuaugaaagagacguggaucugggagccggcacgcggcacgucgcuguggagcccgaaguggccaaucuugacaucauugggcaacgcaucgagaacauuaagaaugaacauaaaagcacauggcacuacgaugaggacaaccccuauaagaccugggcuuaccacggaucuuaugaggucaaaccuuccggcagcgccucuuccaugguuaauggcguggugagacugcucaccaagcccugggaugucaucccuauggugacacagaucgcuaugacggacaccacaccguuugggcagcaacggguuuucaaggaaaaaguggauaccagaacaccccgggccaagcgcggaaccacacagauuauggaggucaccgcgaaauggcuguggggcuuucuuagcagaaacaagaaaccucggaucuguacgcgcgaagaguucaccagaaaggugcgguccaaugccgcuauuggggccguuuuuguggacgaaaaccaguggaauagcgcuaaggaggccgucgaggacgaacgcuucugggaucuggugcauagagagcgggaacuccacaaacagggaaagugcgccacaugcguuuacaacaugaugggcaaacgcgagaagaaacugggggaauuuggcaaggcgaagggaucuagagcuaucugguacauguggcugggcgcccgguuccucgaguucgaggcccugggguuuaugaaugaagaccauugguucagccgcgagaacucccuuucuggaguggaaggcgaggggcugcacaaacucggauauauucugagagauaucagcaagauccccggcgggaauauguacgcugacgauaccgccggcugggacacacgggucaccgaggaugaccuucaaaacgaagcuaaaauuacggauaucauggagccugaacaugcccugcucgcgacauccauuuuuaagcugaccuaucagaauaaagugguccgcgugcagagacccgccaagaacggaacaguuauggacgugaucucucggagagaucagcgcggcagcgggcaagucggaaccuacggccugaacacguucaccaauauggaggugcagcucauucggcagauggaauccgaggggaucuuucugccgucugagcuugaaacaccuaaccuggcugagagagcccucgacuggcuggaaaaacacggagcugagcgccuuaagcggauggccaucagcggcgaugacugugugguuaagcccauugacgauagauucgcgaccgcccugacagcucucaaugacauggggaaagugcgcaaggauaucccucagugggaacccuccaaaggcuggaacgacuggcaacaggucccuuuuugcagccaccauuuccaccagcugauuaugaaggauggacgggagaucgugguucccuguagaaaucaggacgagcuggugggccgcgcccgggucucucaaggggcuggauggucccucagagaaaccgccugccugggcaaaagcuaugcucagauguggcagcuuauguacuuucaucgccgggaucugagacucgccgcgaacgccauuuguucugcugugccggucgacugggugccuacaucccggaccacguggagcauccacgcccaccaucaauggaugacaaccgaggauaugcuguccguuuggaauagaguguggaucgaagagaaccccuggauggaaaauaagacccacgucucuagcugggaggaggugcccuaucuugggaagcgcgaagaccaguggugcggaucccugauuggccucacagcccgggcuaccugggccacaaacauccagguugcgauuaaucaggugagacgccugaucgggaacgagaauuaccuggauuacaugacgagcaugaaaagauucaagaacgaaucugacuccgagggcgcucucugguga

SEQ ID NO: 18726 - RNA, 9879 nt, Artificial Sequence
  derived and/or modified CDS sequence (opt5) from DENV-1__KJ189363__SS-prME
agcgugaccaugcugcucaugcugcuucccaccgcccuggcuuuccaccucacgacccggggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuuagacaccccggcuucauggugaucgccuuuuuccuggcgcaugccauugggaccucuaucacacagaagggaaucauuuuuauccuccugaugcuugucaccccuagcauggcuaugagaugcgugggcauugggaaccgggacuucguugagggacuguccggcgccaccuggguggaugucgugcucgaacacgggagcugugugacaacgauggcuaagaauaaacccacccuggacaucgagcugcucaagacagaagucaccaacccugccguucugcgcaaacuuugcauugaggcgaagaucucuaauacaaccacggauuccagauguccgacacaaggagaagccacccugguggaggagcaggacgcuaacuuugugugccggcgcaccuucgucgauagaggcuggggcaauggguguggacucuuuggcaaagggagccugcuuacaugcgccaaguucaagugcgugaccaaacuggaaggaaagauuguucaguacgagaaccucaaauauucugugaucgucacagugcacacgggcgaccagcaucaaguugggaaugaaaccacagagcacggaaccaucgcuacaauuacaccccaggccccuacguccgaaauccagcugaccgauuacggcgcccugacacucgacuguagcccccggaccggccuggacuuuaacgagauggugcuucugacaaugaaggagaaaucuuggcucguccauaagcagugguuccuggaucuuccucugcccuggaccuccggggcuagcacgucccaagaaacauggaaucgccaggaccuccuggugaccuuuaaaacagcgcacgccaagaagcaggaggucgugguucugggaucucaagaaggcgcuaugcacaccgcccucaccggggccacagagauucagacgagcggaaccacaaccaucuucgcuggccaucugaaaugcagacuuaagauggauaaacugacacucaaggggauguccuaugugauguguaccggcagcuucaaacuggaaaaggaggucgccgagacgcagcacggaacagugcugguucaggugaaguacgaaggcaccgacgcgccgugcaaaauuccuuuuucuacccaagaugagaagggggucacacagaacggacggcuuaucaccgcuaaucccaucgugacagacaaagaaaagccugugaacauugagacggagccgcccuucggcgaauccuauaucguugucggggccggagagaaagcccucaagcugagcugguuuaagagaggcucuagcauugggaaaauguucgaagcuaccgcccgcggcgcucggagaauggccauccugggagauacagcgugggacuuuggcuccauugggggaguguucaccucugugggcaagcucguccaucagaucuuugggacagccuacggagugcuguucagcggcguuuccuggaccaugaaaaucgggauuggcauccuucugacguggcucggacugaauagccgcucuaccucccugagcaugacauguauugcugugggcauggucacccuuuaccucggggugaugguucaggccgauucuggaugcgugaucaacuggaagggccgggagcugaaauguggguccggaauuuuugucacaaacgaagugcacaccuggacagagcaauauaaguuccaggcugacagcccuaagagacuguccgccgcgaucggcaaagccugggaggaagggguuugcggcauucgcucugcuacccggcucgagaauaucauguggaagcagaucagcaacgaacugaaucauauucuucuggagaacgauaugaaauuuacgguggucgugggagacgccaauggcauccucgcucaggggaagaaaaugauuagaccgcaacccauggaacacaaguacuccuggaaaucuuggggaaaggccaagaucauuggcgccgacauccagaacacaaccuucaucauugaugggccugacacccccgaguguccugauggacagcgcgcuuggaauaucugggagguggaagacuauggcuuuggcgucuucacaaccaacauuuggcugaaacugcgggauagcuacacgcagaugugcgaccacagacuuauguccgcggccaucaaggauagcaaagcuguucaugccgacaugggguauuggauugagucugaaaagaaugagacauggaaacucgcccgcgcuuccuucaucgaagugaagaccuguacauggcccaagagccacacccuguggucuaacggagugcuggaguccgagaugaucauuccgaaaaucuacggcgggccuauuagccaacauaauuaucggcccggauacuuuacacagaccgccggcccuuggcaccucgggaagcuggaacuugauuucgaccugugcgagggaacgaccgucgugguugaugaacacugcggcaacagaggccccucucuccggacaaccacagugaccgggaaaaucauucaugagugguguugccgcagcuguacgcugccuccccugagauuucggggagaggacggcugcugguacgggauggaaaucagaccggucaaggagaaagaagagaaucuugugcgcuccaugguuagcgcgggaucuggcgaaguggauuccuucagccucgggauccugugugucuccauuaugaucgaggaggugaugcggucuagauggagccgcaagaugcugaugacaggaacccucgcuguuuuucugcuucugauuaugggccagcucacauggaacgaccugaucagacugugcauuauggugggcgccaaugccuccgaccggauggggaugggaaccaccuaucuugcucugauggccacauucaagaugcgcccuauguuugcggucggccuccuguucagacggcucacgucucgcgaagugcugcuucugaccaucgggcucagccugguggcuuccgucgagcugcccaacucucuugaagaacugggagauggccucgccauggggauuaugaugcugaaacuccugacagaauuucaaccccaccagcuuuggaccacacugcucagccugaccuucguuaagacgacacugucccuugacuacgccuggaaaaccaccgcuauggcccugagcaucgugucucucuuuccucugugucucuccacaaccagccagaagacaacguggcugccggugcuucugggaucuuucggcugcaaaccccugaccauguuucucaucacagagaacaagauuuggggcagaaaguccuggccucugaaugaggggaucauggcuauuggaaucgucagcauucuucugucuucccuccugaaaaacgaugugccccucgccggcccucugaucgccgggggaaugcuuaucgccuguuauguuauuagcggcuccagcgcugaccugucucuggaaaaggccgcugaggugagcugggaacaggaggccgaacauuccggggccucucacagcauccucgucgaggugcaagaugacggaaccaugaaaauuaaggaugaggaacgggacgauacacugaccauccuucugaaagcuacgcuccuggcgguuuccggcguguaccccaugucuauuccugccacccucuucgucugguauuucuggcagaagaaaaagcagcgcagcggcgugcugugggacacacccuccccgccugaggucgaaagagcugugcuugauaaugggaucuaccggauccugcagcgcggacugcucggcagaucucaaguuggggugggagucuuucaggacggcguguuccauaccauguggcacguuacaagaggggcggugcugauguaucagggaaagcggcuugagcccagcugggccuccgucaaaaaggaucugauuagcuacggcggcggguggcgcuuucagggaucuuggaacaccggcgaggaagugcaagugaucgcuguugagccugggaaaaaucccaagaacguccagacaacgccgggaaccuucaaaacaccugaaggcgaggugggggccauugcgcucgacuuuaagcccggaaccuccggcagcccuaucgugaaucgggaaggcaagauugucgggcuguacggaaacggcgugguuaccacaucugggacguauguguccgcuaucgcccaggccaaagcuagccaagagggaccccuccccgagauugaagacgaggucuucaagaaaagaaaucugaccaucauggaucuucacccuggcuccgggaagacacgccgguaccugccggccaucgugagagaagcgauuaaacgcaagcugcggacccucauccuggcucccacaagaguuguggccucugagauggccgaagcucuuaagggcaugccuauucgcuaucagaccacggccgucaaaagcgagcauacaggacgggagaucguggaccugaugugccacgcuaccuuuaccaugagacuccugucccccguucgggugccuaacuacaauaugauuaucauggaugaagcccauuucacagaccccgcgagcaucgccgcucgcggcuauauuucuaccagagucgggaugggagaggccgcugccaucuuuaugacagccaccccuccgggcuccguggaggcuuucccccagagcaacgcggugauucaggaugaggaacgggacaucccugagcgcucuuggaauagcggguacgauuggauuacggacuuucccggaaagacagucugguucguuccuuccaucaaaucuggcaacgauaucgccaauugucugagaaagaacgggaaacgggugauucaacucagcagaaagaccuucgacacagaguaucagaagaccaaaaacaaugauugggacuacguggucacgaccgacaucuccgaaaugggcgcuaacuuucgcgccgaucgggugauugaccccagacgcugccuuaagccgguuauccugaaagauggaccugagcgggugauucuggccggccccaugcccgucacagcugccucugcggcucagagacgcgggcggaucggaagaaaucagaacaaggaaggcgaccaauacguguauauggggcagccucucaauaacgaugaggaccacgcccauuggaccgaggccaaaaugcugcuugauaauauuaacacacccgaaggaaucaucccugcucuguucgagccggaacgcgaaaagagcgccgcgauugacggcgaauacagacucagaggggaagcccgcaagaccuuuguugagcugaugagacggggcgaucugcccguguggcucuccuauaaagucgcuagcgaaggauuccaguacucugaccgcagauggugcuuugauggcgagcggaauaaccaggugcuugaagagaauauggacgucgaaaucuggacaaaggagggggagcgcaagaagcugcgcccucgguggcuggaugccagaaccuauuccgacccccucgcucugcgcgaguucaaagaguuugccgcuggacggagaagcguguccggcgaccuuauucuggaaaucgggaagcucccucaacaccugacgcugcgggcccagaacgcgcucgauaaucuuguuaugcugcacaacucugagcagggaggcaaagccuaccgccaugcuauggaggaacugcccgacacaauugagacccucaugcugcuugcccugaucgcugugcucaccggcggggugacacuguucuuucugagcggaaagggccucgggaagaccuccaucggacuucugugugucacagccucuagcgcccugcucuggauggcuuccguugaaccgcacuggauugcggccagcaucauucuggaguucuuucuuauggugcugcucaucccugaacccgauagacagcggacgccucaagacaaucagcuggcuuauguggucauuggccuccuguucaugauccuuaccguggccgccaacgagauggggcugcuggagacaaccaaaaaggaucucggaaucggcuacguugcugccgaaaaccaucagcacgcgacaaugcuggacguggaucuucaccccgccucugcuuggacccuguacgccgucgcuacgaccgugauuacaccuaugaugcgccauaccaucgagaauacaaccgccaacauuucccucacggcgaucgccaaucaagcugccauucugaugggccuggacaaaggguggcccaucagcaagauggauauuggagucccgcuccuugcucugggcugcuauucucaggugaacccucugacacucaccgccgcuguucugaugcuuguggcccacuacgcgaucaucgggcccggacugcaggccaaagcuacaagagaagcccagaagcggaccgcugccggcauuaugaagaaucccaccgucgacgggaucguggccauugaucucgacccuguuguguaugaugcgaaauuugagaagcaacugggacagaucaugcugcucauucuuuguacaucccagauccugcugaugcgcacgaccugggcucucugcgaaagcaucacacuggccaccggcccgcuuacaacccugugggagggcucucccgggaaauucuggaacacgacaauugcugucagcauggccaauaucuucagaggauccuaccucgccggcgcugggcuggccuuuucucugaugaaaagccucggaggcgggcggcgcggaaccggcgcgcagggcgagacccuuggggaaaaauggaagagacaacugaaccagcuguccaagagcgaguucaauacauauaaacgguccggaauuauggaaguggacagaucugaggccaaggaaggccucaaacgcggggagaccacaaagcaugcugugagccggggaacggccaaacugagaugguuuguugagcgcaaccuugucaagccugaaggcaaggugaucgaccugggguguggacggggcggcugguccuacuauugcgcugggcucaaaaaggugaccgaggucaaaggauacacaaagggcgggcccggacacgaggaaccuauucccauggccaccuacggcuggaaucugguuaaacugcauucugggaaggauguguucuuuaugccuccggaaaaaugugacacacuccuuugcgauaucggagagagcucccccaacccuaccaucgaggaaggcagaacgcugcgcgugcugaagauggucgagcccuggcuccggggcaaucaguucuguauuaagauccugaacccuuauaugcccucugugguugaaacccuugagagaaugcagcgcaaacacgggggaaugcuggugcggaauccgcucagcagaaacuccacacacgagauguacugggucagcugcggcaccgggaauauugugucugcgguuaacaugacaucccgcaugcugcugaaccgguuuaccauggcccauagaaagccuacauaugaacgcgacguggaucucggagcuggcaccagacacgucgccguggagcccgaaguggcuaaucuggacaucauugggcaacggaucgagaacauuaaaaaugaacauaagagcacguggcacuacgaugaggacaaccccuauaaaacaugggccuaccacggaucuuaugaggucaagccuuccggcagcgcuucuuccaugguuaauggcguggugcgccuucugaccaagcccugggaugucaucccuauggugacccagaucgccaugacagacacgaccccguucgggcagcaaagaguuuuuaaagaaaagguggauacacggacccccagagcgaaacggggaacaacccagauuauggaggucacagccaaguggcucuggggcuuccugagccgcaacaaaaagccuagaaucuguacccgggaagaguuuacgcgcaaggugagauccaaugcugccauuggggcuguuuucguggacgaaaaccaguggaauagcgccaaagaggccgucgaggacgaacgguuuugggaucuugugcaucgcgagagagaacugcacaagcagggaaaaugcgcgaccugcguuuacaacaugaugggcaagcgggagaaaaagcucggggaguucggcaaggcuaaaggaucucgcgccaucugguacauguggcugggcgccagauuccuggaguuugaggcucucggguucaugaaugaagaccauugguuuagccgggagaacucccugucuggaguggaaggcgaggggcuucacaagcugggauauauucuccgcgauaucagcaaaauccccggcgggaauauguacgccgacgauacagcuggcugggacaccagagucacagaggaugaccugcaaaacgaagccaagauuaccgauaucauggagccugaacaugcgcuucuggccacguccauuuucaaacucacauaucagaauaaggugguccgggugcagcgccccgcuaaaaacggaaccguuauggacgugaucucuagacgggaucagagaggcagcgggcaagucggaacauacggccugaacaccuuuacgaauauggaggugcagcugauucgccagauggaauccgaggggaucuuccucccgucugagcuggaaaccccuaaccuugccgagcgggcucuggacuggcucgaaaagcacggagccgagagacugaagcgcauggcgaucagcggcgaugacugugugguuaaacccauugacgaucgguuugccacagcucuuaccgcccugaaugacauggggaaggugagaaaagauaucccucagugggaacccuccaagggcuggaacgacuggcaacaggucccuuucugcagccaccauuuucaccagcucauuaugaaagauggacgcgagaucgugguucccugucggaaucaggacgagcuggugggcagagcucgcgucucucaaggggccggauggucccugcgggaaacagcuugccucggcaagagcuaugcccagauguggcagcugauguacuuccauagacgcgaucuucggcuggcggccaacgcuauuuguucugccgugccggucgacugggugccuaccuccagaacaaccuggagcauccacgcccaccaucaauggaugacgacagaggauaugcucuccguuuggaaucggguguggaucgaagagaaccccuggauggaaaauaagacccacgucucuagcugggaggaggugcccuaucuggggaaaagagaagaccaguggugcggaucccuuauuggccugaccgcucgcgccacaugggcgaccaacauccagguugcuauuaaucaggugcggagacucaucgggaacgagaauuaccuggauuacaugacaagcaugaagcgcuuuaaaaacgaaucugacuccgagggcgcccugugguga

SEQ ID NO: 18727 - RNA, 9879 nt, Artificial Sequence
  derived and/or modified CDS sequence (opt5) from DENV-1__KJ189364__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaaggggaugacccagaacggacggcuuaucacagcuaaucccaucgucacggacaaagaaaagccugugaacauugagaccgagccccccuucggcgaauccuauaucgugguuggggccggagagaaagcccucaagcugagcugguuuaagagaggcucuagcauugggaaaauguucgaagcuacagcccgcggcgcucggagaauggccauccugggagauaccgcgugggacuuuggcuccauugggggagucuucacaucugugggcaagcucgugcaucagaucuuugggaccgccuacggaguccuguucagcggcguguccuggacgaugaaaaucgggauuggcauccuucugaccuggcucggacugaauagccgcucuacaucccugagcaugaccuguauugcuguuggcauggugacacuuuaccucggggucauggugcaggccgauucuggaugcguuaucaacuggaagggccgggagcugaaauguggguccggaauuuuugugaccaacgaaguccacacauggaccgagcaauauaaguuccaggcugacagcccuaagagacuguccgccgcgaucggcaaagccugggaggaaggggugugcggcauucgcucugcuacgcggcucgagaauaucauguggaagcagaucagcaacgaacugaaucauauucuucuggagaacgauaugaaauuuacaguuguggucggagacgccaauggcauccucgcucaggggaagaaaaugauuagaccgcaacccauggaacacaaguacuccuggaaaucuuggggaaaggccaagaucauuggcgccgacauccagaacaccaccuucaucauugaugggccugacacacccgaguguccugauggacagcgcgcuuggaauaucugggagguggaagacuauggcuuuggcguguucaccacgaacauuuggcugaaacugcgggauagcuacacacagaugugcgaccacagacuuauguccgcggccaucaaggauagcaaagcuguccaugccgacaugggguauuggauugagucugaaaagaaugagaccuggaaacucgcccgcgcuuccuucaucgaaguuaagacauguaccuggcccaagagccacacacuguggucuaacggagugcuggaguccgagaugaucauuccgaaaaucuacggcgggccuauuagccaacauaauuaucggcccggauacuuuacccagacggccggcccuuggcaccucgggaagcuggaacuugauuucgaccugugcgagggaaccacaguggucguggaugaacacugcggcaacagaggccccucucuccggaccacaaccguuacggggaaaaucauucaugagugguguugccgcagcuguacacugccuccccugagauuucggggagaggacggcugcugguacgggauggaaaucagaccggugaaggagaaagaagagaaucuuguccgcuccauggugagcgcgggaucuggcgaaguugauuccuucagccucgggauccuguguguguccauuaugaucgaggaggucaugcggucuagauggagccgcaagaugcugaugaccggaacacucgcuguguuucugcuucugauuaugggccagcucaccuggaacgaccugaucagacugugcauuaugguuggcgccaaugccuccgaccggauggggaugggaaccacauaucuugcucugauggccacguucaagaugcgcccuauguuugcggugggccuccuguucagacggcucaccucucgcgaaguccugcuucugacaaucgggcucagccugguggcuuccguggagcugcccaacucucuugaagagcugggagauggccucgccauggggauuaugaugcugaaacuccugaccgaauuucaaccccaccagcuuuggacaacccugcucagccugacguucgucagaacaacccugucccuugacuacgccuggaagaccacagcuauggcccugagcaucguuucucucuuuccucugugucucuccaccacaagccagaaaacgaccuggcugccggugcuucugggaucuuucggcugcaagccccugacaauguuucucaucaccgagaacaaaauuuggggccggaaguccuggccucugaaugaggggaucauggcuauuggaaucgugagcauucuucugucuucccuccugaagaacgaugucccccucgccggcccucugaucgcggggggaaugcuuaucgccuguuaugugauuagcggcuccagcgcugaccugucucuggaaaaagccgcugagguuagcugggaacaggaggccgaacauuccggggccucucacagcauccucguggagguccaagaugacggaacaaugaagauuaaagaugaggaacgcgacgauacccugacgauccuucugaaggcuacccuccuggcgguguccggcguuuaccccaugucuauuccugccacacucuucgugugguauuucuggcagaaaaagaaacagagaagcggcguccugugggacacccccuccccgccugagguggaacgggcuguccuugauaaugggaucuaccgcauccugcagagaggacugcucggccggucucaaguggggguuggaguguuucaggacggcgucuuccauacaauguggcacgugaccagaggggccguucugauguaucagggaaagcgccuugagcccagcugggccuccgugaagaaagaucugauuagcuacggcggcggguggcgguuucagggaucuuggaacacaggcgaggaaguccaagugaucgcuguggagccugggaagaaucccaaaaacguucagacgaccccgggaacauucaagaccccugaaggcgaggucggggccauugcgcucgacuuuaaacccggaaccuccggcagcccuaucgugaauagagaaggcaagauuguggggcuguacggaaacggcgucgugacaacgucugggaccuauguuuccgcuaucgcccaggccaaggcuagccaagagggaccccuccccgagauugaagacgagguguucaaaaagcgcaaucugacaaucauggaucuucacccuggcuccgggaaaacccggagauaccugccggccaucguccgcgaagcgauuaagcggaaacugagaacacucauccuggcucccacccgcgugguugccucugagauggccgaagcucuuaagggcaugccuauucgguaucagacgacagccgugaagagcgagcauaccggaagagagaucgucgaccugaugugccacgcuaccuuuacaaugcggcuccugucccccgugcgcguuccuaacuacaauaugauuaucauggaugaagcccauuucaccgaccccgcgagcaucgccgcuagaggcuauauuucuacacggguggggaugggagaggccgcugccaucuuuaugaccgccacgccuccgggcuccgucgaagcuuucccccagagcaacgcggugauucaggaugaggaacgcgacaucccugagagaucuuggaauagcggguacgauuggauuacagacuuucccggaaaaaccgugugguucgucccuuccaucaagucuggcaacgauaucgccaauugucugcggaaaaacgggaagagaguuauucaacucagccgcaaaacauucgacaccgaguaucagaagacgaagaacaaugauugggacuacguggugaccacagacaucuccgaaaugggcgcuaacuuucgggccgauagagucauugacccccgccggugccuuaaaccggugauccugaaggauggaccugagagaguuauucuggccggccccaugcccgugaccgcugccucugcggcucagcgccgggggagaaucggacgcaaucagaacaaagaaggcgaccaauacgucuauauggggcagccucucaauaacgaugaggaccacgcccauuggacagaggccaagaugcugcuugauaauauuaacacccccgaaggaaucaucccugcucuguucgagccggaaagagagaaaagcgccgcgauugacggcgaauaccggcuccgcggggaggccagaaagacauuuguggagcugaugcggcgcggcgaucugcccguuuggcucuccuauaagguggcuagcgaaggauuccaguacucugacagacgguggugcuuugauggcgagagaaauaaccagguccuugaagagaauauggacguggaaaucuggaccaaagagggggagcgcaagaaacugcggccuagauggcuggaugcccgcacguauuccgacccccucgcucugcgggaauucaaggaguuugccgcuggaagacggagcgucuccggcgaccuuauucuggaaaucgggaaacucccucaacaccugacacugcgcgcccagaacgcgcucgauaaucuugugaugcugcacaacucugagcagggaggcaaggccuacagacaugcuauggaagagcugcccgacaccauugagacccucaugcugcuugcccugaucgcuguucucacaggcggggugacccuguucuuucugagcggaaaaggccucgggaagacauccaucggacuucugugugugacggccucuagcgcccugcucuggauggcuuccgucgaaccgcacuggauugcggccagcaucauucuggaguucuuucuuaugguucugcucaucccugaacccgaucggcagcgcaccccucaagacaaucagcuggcuuauguggugauuggccugcucuucaugauccuuacagucgccgccaacgagauggggcugcuggagaccacaaagaaagaucucggaaucggcuacguggcugccgaaaaccaucagcacgcgaccaugcuggacguugaucuucaccccgccucugcuuggacgcuguacgccguggcuaccacagucauuaccccuaugaugagacauacaaucgagaauaccacggccaacauuucccucacagcgaucgccaaucaagcugccauucugaugggccuggacaagggguggcccaucagcaaaauggauauuggagugccgcuccuugcucugggcugcuauucucaggucaacccucugacccucacagccgcugugcugaugcuuguugcccacuacgcgaucaucgggcccggacugcaggccaaggcuacccgggaagcccagaaacgcaccgcugccggcauuaugaagaaucccacaguggacgggaucgucgccauugaucucgacccugugguuuaugaugcgaaguuugagaaacaacugggacagaucaugcugcucauucuuuguacgucccagauccugcugaugagaaccacaugggcucucugcgaaagcaucacccuggccacaggcccgcuuaccacgcugugggagggcucucccgggaaguucuggaacacaaccauugcugugagcauggccaauaucuuccggggauccuaccucgccggcgcugggcuggccuuuucucugaugaaaagccucggaggcgggcgcagaggaaccggcgcgcagggcgagacacuuggggaaaaguggaaacggcaacugaaccagcuguccaagagcgaguucaauaccuauaagagauccggaauuauggaagucgaccgcucugaggccaaagaaggccucaagcggggggagacaacgaaacaugcugugagcagaggaaccgccaagcugcgcugguuuguggagcggaaccuuguuaaaccugaaggcaaggucaucgaccugggguguggaagaggcggcugguccuacuauugcgcugggcucaagaaagugacagaggugaagggauacaccaaaggcgggcccggacacgaagagccuauucccauggccacauacggcuggaaucuggucaagcugcauucugggaaagauguuuucuuuaugccuccggaaaagugugacacccuccuuugcgauaucggagagagcucccccaacccuacgaucgaggaaggccgcacccugcgggugcugaaaaugguggagcccuggcucagaggcaaucaguucuguauuaagauccugaacccuuauaugcccucugucguggaaacacuugagcgcaugcagcggaagcacgggggaaugcugguuagaaauccgcucagccgcaacuccacccacgagauguacugggugagcugcggcacagggaauauugucucugcggugaacaugaccucccggaugcugcugaacagauuuacaauggcccaucgcaaaccuaccuaugaaagagacguugaucucggagcuggcacgcggcacguggccgucgagcccgaaguggcuaaucuggacaucauugggcaacgcaucgagaacauuaagaaugaacauaaaagcacauggcacuacgaugaggacaaccccuauaagaccugggccuaccacggaucuuaugaggugaaaccuuccggcagcgcuucuuccauggucaauggcguugugagacuucugaccaagcccugggaugugaucccuauggucacacagaucgccaugacggacaccacaccguucgggcagcaacggguguuuaaggaaaaaguugauaccagaacaccccgggcgaagcgcggaaccacacagauuauggaggugaccgccaaauggcucuggagcuuccuguccagaaacaagaaaccucggaucuguacgcgcgaagaguuuaccagaaagguccggagcaaugcugccauuggcgcuguguucguugacgaaaaccaguggaauucugccaaggaggccguggaggacgaacgcuuuugggaucuuguccauagagagcgggaacugcacaaacaggggaagugcgcgacaugcguguacaacaugaugggaaaacgcgagaagaaacucggcgaauucgggaaggcuaagggcagcagagccaucugguacauguggcugggagcccgguuccuggaguuugaggcucucggcuucaugaaugaagaccauugguuuucccgcgagaacucucugagcgggguugaaggagagggccuucacaaacugggguauauucucagagauaucuccaagauccccggaggcaauauguacgccgacgauaccgcugggugggacacacgggugaccgaggaugaccugcaaaacgaagccaaaauuacggauaucauggagccugaacaugcgcuucuggccacaucuauuuucaagcucaccuaucagaauaaagucgugcgcguccagagacccgcuaagaacggcacagugauggacguuaucagccggagagaucagcgcggauccggccaaguggggaccuacggacugaacacguuuaccaauauggagguccagcugauucggcagauggaaucugagggcaucuuccucccgagcgagcuggaaacaccuaaccuugccgagagagcucuggacuggcucgaaaaacacggggccgagcgccugaagcggauggcgaucuccggagaugacuguguggugaagcccauugacgauagauuugccaccgcucuuacagcccugaaugacaugggcaaaguucgcaaggauaucccucagugggaacccagcaaaggguggaacgacuggcaacaggugccuuucugcucucaccauuuucaccagcucauuaugaaggauggccgggagaucgucgugcccuguagaaaucaggacgagcugguuggacgcgcucgggugucccaaggcgccggguggagccugagagaaaccgcuugccucggaaaaucuuaugcccagauguggcagcugauguacuuccaucgccgggaucuuagacuggcggccaacgcuauuuguuccgccgucccgguggacugggucccuacaagccggaccacgugguccauccacgcccaccaucaauggaugacaaccgaggauaugcucucuguguggaauagaguuuggaucgaagagaaccccuggauggaaaauaagacccacgugagcuccugggaggagguccccuaucugggcaagcgcgaagaccaguggugcgggagccuuauuggacugacagcucgggccaccugggcgacaaacauccagguggcuauuaaucagguuagacgccucaucggcaacgagaauuaccuggauuacaugacgucuaugaaaagauuuaagaacgaauccgacagcgagggggcccugugguga

SEQ ID NO: 18728 - RNA, 9879 nt, Artificial Sequence
  derived and/or modified CDS sequence (opt5) from DENV-1__KJ189365__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccccccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagaucuuugggaccgccuacggagugcuguucagcggcguuuccuggacgaugaaaaucgggauuggcauccuucugaccuggcucggacugaauagccgcucuacaucccugagcaugaccuguauuguggucggcauggugacacuuuaccucgggguuauggugcaggcugauucuggaugcgucaucaacuggaagggccgggagcugaaauguggguccggaauuuuugugaccaacgaaguucacacauggaccgagcaauauaaguuccaggccgacagcccuaagagacuguccgcugccaucggcaaagcgugggaggaaggggugugcggcauucgcucugccacgcggcucgagaauaucauguggaagcagaucagcaacgaacugaaucauauucuucuggagaacgauaugaaauuuacagucguggugggagacgcuaauggcauccucgcccaggggaagaaaaugauuagaccgcaacccauggaacacaaguacuccuggaaaucuuggggaaaggcuaagaucauuggcgccgacauccagaacaccaccuucaucauugaugggccugacacacccgaguguccugauggacagcgcgccuggaauaucugggaggucgaagacuauggcuuuggcguuuucaccacgaacauuuggcugaaacugcgggauagcuacacacagaugugcgaccacagacuuauguccgcugcgaucaaggauagcaaagccgugcaugcugacaugggguauuggauugagucugaaaagaaugagaccuggaaacucgcccgcgccuccuucaucgaagugaagacauguaccuggcccaagagccacacacuguggucuaacggaguccuggaguccgagaugaucauuccgaaaaucuacggcgggccuauuagccaacauaauuaucggcccggauacuuuacccagacggcuggcccuuggcaccucgggaagcuggaacuugauuucgaccugugcgagggaaccacagugguuguggaugaacacugcggcaacagaggccccucucuccggaccacaaccgucacggggaaaaucauucaugagugguguugccgcagcuguacacugccuccccugagauuucggggagaggacggcugcugguacgggauggaaaucagaccggugaaggagaaagaagagaaucuuguucgcuccauggugagcgccggaucuggcgaagucgauuccuucagccucgggauccuguguguguccauuaugaucgaggagguuaugcggucuagauggagccgcaagaugcugaugaccggaacacucgcgguguuucugcuucugauuaugggccagcucaccuggaacgaccugaucagacugugcauuauggucggcgcuaaugccuccgaccggauggggaugggaaccacauaucuugcccugauggcuacguucaagaugcgcccuauguuugccgugggccuccuguucagacggcucaccucucgcgaagugcugcuucugacaaucgggcucagccuggucgcguccguugagcugcccaacucucuugaagagcugggagauggccucgcuauggggauuaugaugcugaaacuccugaccgaauuucaaccccaccagcuuuggacaacccugcucagccugacguucgugaagacaacccugucccuugacuacgccuggaaaaccacagccauggcucugagcaucgugucucucuuuccucugugucucuccaccacaagccagaagacgaccuggcugccgguccuucugggaucuuucggcugcaaaccccugacaauguuucucaucaccgagaacaagauuuggggcagaaaguccuggccucugaaugaggggaucauggccauuggaaucgugagcauucuucugucuucccuccugaaaaacgauguuccccucgcuggcccucugaucgccgggggaaugcuuaucgcguguuaugugauuagcggcuccagcgccgaccugucucuggaaaaggcugccgaggucagcugggaacaggaggcugaacauuccggggccucucacagcauccucguggagguucaagaugacggaacaaugaaaauuaaggaugaggaacgggacgauacccugacgauccuucugaaagccacccuccuggcuguguccggcgucuaccccaugucuauuccugcgacacucuucgugugguauuucuggcagaagaaaaagcagcgcagcggcguccugugggacacccccuccccgccugagguggaaagagccguucuugauaaugggaucuaccggauccugcagcgcggacugcucggcagaucucaagugggggucggaguguuucaggacggcguuuuccauacaauguggcacgugacccggggggcuguccugauguaucagggaaagagacuugagcccagcugggccuccgugaaaaaggaucugauuagcuacggcggcggguggcgcuuucagggaucuuggaacacaggcgaggaagugcaaguuaucgccgucgagccugggaaaaaucccaagaacgugcagacgaccccgggaacauucaaaaccccugaaggcgaggugggggcuauugcccucgacuuuaagcccggaaccuccggcagcccuaucgucaaucgggaaggcaagauuguggggcuguacggaaacggcguugugacaacgucugggaccuaugucuccgcgaucgcucaggccaaagccagccaagagggaccccuccccgagauugaagacgagguguucaagaaaagaaaucugacaaucauggaucuucacccuggcuccgggaagacccgccgguaccugccggcuaucguuagagaagccauuaaacgcaagcugcggacacucauccuggcgcccaccagaguggucgcuucugagauggccgaagcccuuaagggcaugccuauucgcuaucagacgacagcugugaaaagcgagcauaccggacgggagaucguugaccugaugugccacgccaccuuuacaaugagacuccugucccccgugcgggucccuaacuacaauaugauuaucauggaugaagcucauuucaccgaccccgccagcaucgcggcccgcggcuauauuucuacaagaguggggaugggagaggcugccgcuaucuuuaugaccgccacgccuccgggcuccguggaagccuucccccagagcaacgcugucauucaggaugaggaacgggacaucccugagcgcucuuggaauagcggguacgauuggauuacagacuuucccggaaagaccguuugguucgugccuuccaucaaaucuggcaacgauaucgcgaauugucugagaaagaacgggaaacgggugauucaacucagcagaaagacauucgacaccgaguaucagaagacgaaaaacaaugauugggacuacgucgugaccacagacaucuccgaaaugggcgccaacuuucgcgcugaucggguuauugaccccagacgcugccuuaagccggugauccugaaagauggaccugagcgggucauucuggccggccccaugcccgugaccgccgcuucugccgcgcagagacgcgggcggaucggaagaaaucagaacaaggaaggcgaccaauacguuuauauggggcagccucucaauaacgaugaggaccacgcucauuggacagaggccaaaaugcugcuugauaauauuaacacccccgaaggaaucaucccugcccuguucgagccggaacgcgagaagagcgcugccauugacggcgaauacagacuccggggggaggcgcgcaagacauuuguggagcugaugagacggggcgaucugcccgucuggcucuccuauaaaguggccagcgaaggauuccaguacucugaccgcagauggugcuuugauggcgagcggaauaaccagguccuugaagagaauauggacguggaaaucuggaccaaggagggggagagaaaaaagcugcgcccucgguggcuggaugcuagaacguauuccgacccccucgcccugcgcgaauucaaagaguuugcugccggacggagaagcguuuccggcgaccuuauucuggaaaucgggaagcucccucaacaccugacacugcgggcucagaacgcccucgauaaucuugugaugcugcacaacucugagcagggaggcaaagcguaccgccaugccauggaagagcugcccgacaccauugagacccucaugcugcuugcucugaucgccgugcucacaggcggggucacccuguucuuucugagcggaaagggccucgggaagacauccaucggacuucuguguguuacggcuucuagcgcccugcucuggauggccuccguggaaccgcacuggauugcugcgagcaucauucuggaguucuuucuuauggugcugcucaucccugaacccgauagacagcggaccccucaagacaaucagcuggccuaugucgugauuggccugcucuucaugauccuuacaguugcugccaacgagauggggcugcuggagaccacaaaaaaggaucucggaaucggcuacguggccgcugaaaaccaucagcacgccaccaugcuggacgucgaucuucaccccgcgucugccuggacgcuguacgcuguggccaccacagucauuaccccuaugaugcgccauacaaucgagaauaccacggcuaacauuucccucacagccaucgcgaaucaagccgcuauucugaugggccuggacaaaggguggcccaucagcaagauggauauuggagugccgcuccuugcccugggcugcuauucucagguuaacccucugacccucacagcugccgugcugaugcuugucgcucacuacgccaucaucgggcccggacugcaggcgaaagccaccagagaagcucagaagcggaccgccgcuggcauuaugaagaaucccacaguggacgggaucguugccauugaucucgacccuguggucuaugaugccaaauuugagaagcaacugggacagaucaugcugcucauucuuuguacgucccagauccugcugaugcgcaccacaugggcgcucugcgaaagcaucacccuggcuacaggcccgcuuaccacgcugugggagggcucucccgggaaauucuggaacacaaccauugccgugagcauggcuaauaucuucagaggauccuaccucgccggcgccgggcuggcuuuuucucugaugaagagccucggaggcgggcggcgcggaaccggcgcccagggcgagacacuuggggaaaaauggaagagacaacugaaccagcuguccaagagcgaguucaauaccuauaaacgguccggaauuauggaaguggacagaucugaggcgaaggaaggccucaaacgcggggagacaacgaagcaugccguuagccggggaaccgcuaaacugagaugguuugucgagcgcaaccuugugaagccugaaggcaaggugaucgaccugggguguggacggggcggcugguccuacuauugcgccgggcucaaaaaggucacagagguuaaaggauacaccaagggcgggcccggacacgaagagccuauucccauggcuacauacggcuggaaucuggugaaacugcauucugggaaggauguguucuuuaugccuccggaaaaaugugacacccuccuuugcgauaucggagagagcucccccaacccuacgaucgaggaaggcagaacccugcgcguccugaagaugguggagcccuggcuccggggcaaucaguucuguauuaagauccugaacccuuauaugcccucuguuguggaaacacuugagagaaugcagcgcaaacacgggggaaugcugguccggaauccgcucagcagaaacuccacccacgagauguacugggugagcugcggcacagggaauauuguuucugccgugaacaugaccucccgcaugcugcugaaccgguuuacaauggcgcauagaaagccuaccuaugaacgcgacgucgaucucggagccggcacgagacacguggcuguggagcccgaagucgccaaucuggacaucauugggcaacggaucgagaacauuaaaaaugaacauaagagcacauggcacuacgaugaggacaaccccuauaaaaccugggcuuaccacggaucuuaugagguuaagccuuccggcagcgccucuuccauggugaauggcgugguccgccuucugaccaagcccugggaugugaucccuaugguuacacagaucgcuaugacggacaccacaccguucgggcagcaaagaguguuuaaagaaaaggucgauacccggacacccagagccaaacggggaaccacacagauuauggaggugaccgcgaaguggcucuggggcuuccugagccgcaacaaaaagccuagaaucuguacgcgggaagaguuuacccgcaagguuagauccaaugccgcuauuggggccguguucgucgacgaaaaccaguggaauagcgcuaaagaggccguggaggacgaacgguuuugggaucuuguucaucgcgagagagaacugcacaagcagggaaaaugcgccacaugcguguacaacaugaugggcaagcgggagaaaaagcucggggaauucggcaaggcgaaaggaucucgcgcuaucugguacauguggcugggcgccagauuccuggaguuugaggcccucggguucaugaaugaagaccauugguuuagccgggagaacucccugucuggagucgaaggcgaggggcuucacaagcugggauauauucuccgcgauaucagcaaaauccccggcgggaauauguacgcugacgauaccgccggcugggacacaagagugaccgaggaugaccugcaaaacgaagcuaagauuacggauaucauggagccugaacaugcccuucuggcgacauccauuuucaaacucaccuaucagaauaaggucgugcggguucagcgccccgccaaaaacggaacagugauggacgucaucucuagacgggaucagagaggcagcgggcaagugggaaccuacggccugaacacguuuaccaauauggaggugcagcugauucgccagauggaauccgaggggaucuuccucccgucugagcuggaaacaccuaaccuugcugagcgggcccuggacuggcucgaaaagcacggagcugagagacugaagcgcauggccaucagcggcgaugacuguguugugaaacccauugacgaucgguuugcgaccgcccuuacagcucugaaugacauggggaaggucagaaaagauaucccucagugggaacccuccaagggcuggaacgacuggcaacaggugccuuucugcagccaccauuuucaccagcucauuaugaaagauggacgcgagaucguugugcccugucggaaucaggacgagcuggucggcagagcccgcgugucucaaggggcuggauggucccugcgggaaaccgccugccucggcaagagcuaugcucagauguggcagcugauguacuuccauagacgcgaucuucggcuggccgcgaacgccauuuguucugcugucccgguggacuggguuccuacauccagaaccacguggagcauccacgcccaccaucaauggaugacaaccgaggauaugcucuccguguggaaucgggucuggaucgacgaaaaccccuggauggagaauaagacccacgugucuagcugggaagagguucccuaucuggggaaaagagaggaucaguggugcggaucccuuauuggccugacagcccgcgcuaccugggccacaaacauccagguggcgauuaaucagguccggagacucaucgggaacgaaaauuaccuggacuacaugacgagcaugaagcgcuuuaaaaacgagucugacuccgaaggcgcucugugguga

SEQ ID NO: 18729 - RNA, 9879 nt, Artificial Sequence
  derived and/or modified CDS sequence (opt5) from DENV-1__KJ189366__SS-prME
agcgugaccaugcugcucaugcugcuucccaccgcccuggcuuuccaccucacgacccggggcggggagccucauaugaucgucuccaaacaggaacggggaaaaucucugcuuuuuaagacaagcgccggcguuaacaugugcacccugauugcgauggaccucggggagcugugugaagauacaaugaccuacaaaugccccagaaucgcugaggccgaacccgacgauguggacuguuggugcaaugccacagauaccugggugacguauggaaccuguucccaaacaggcgagcaccggcgggagaagcgcucugucgcucuggccccucauguggggcucggacuggaaaccagaacagagaccuggaugagcuccgaaggcgcuuggaaacagauucagcggguugagacgugggcccuucgccaccccggcuucacagugaucgcguuuuuccuggcccaugcuauugggaccucuaucacacagaagggaaucauuuuuauccuccugaugcuugucaccccuagcauggccaugagaugcgugggcauugggaaccgggacuucguugagggacuguccggcgcuaccuggguggaugucgugcucgaacacgggagcugugugacaacgauggccaagaauaaacccacccuggacaucgagcugcucaagacagaagucaccaacccugcgguucugcgcaaacuuugcauugaggccaagaucucuaauacaaccacggauuccagauguccgacacaaggagaagcuacccugguggaggagcaggacgccaacuuugugugccggcgcaccuucgucgauagaggcuggggcaauggguguggacucuuuggcaaagggagccugcuuacaugcgcuaaguucaagugcgugaccaaacuggaaggaaagauuguucaguacgagaaccucaaauauucugugaucgucacagugcacacgggcgaccagcaucaaguugggaaugaaaccacagagcacggaaccaucgccacaauuacaccccaggccccuacguccgaaauccagcugaccgauuacggcgcucugacacucgacuguagcccccggaccggccuggacuuuaacgagauggugcuucugacaaugaaggagaaaucuuggcucguccauaagcagugguuccuggaucuuccucugcccuggaccuccggggcgagcacgucccaagaaacauggaaucgccaggaccuccuggugaccuuuaaaacagcccacgcuaagaagcaggaggucgugguucugggaucucaagaaggcgccaugcacaccgcccucaccggggcuacagagauucagacgagcggaaccacaaccaucuucgccggccaucugaaaugcagacuuaagauggauaaacugacacucaaggggauguccuaugugauguguaccggcagcuucaaacuggaaaaggaggucgcggagacgcagcacggaacagugcugguucaggugaaguacgaaggcaccgacgcuccgugcaaaauuccuuuuucuacccaagaugagaagggggucacacagaacggacggcuuaucaccgccaaucccaucgugacagacaaagaaaagccugugaacauugagacggagccgcccuucggcgaauccuauaucguugucggggccggagagaaagcucucaagcugagcugguuuaagagaggcucuagcauugggaaaauguucgaagccaccgcucgcggcgcccggagaauggcgauccugggagauacagccugggacuuuggcuccauugggggaguguucaccucugugggcaagcucguccaucagaucuuugggacagcuuacggagugcuguucagcggcguuuccuggaccaugaaaaucgggauuggcauccuucugacguggcucggacugaauagccgcucuaccucccugagcaugacauguauugccgugggcauggucacccuuuaccucggggugaugguucaggcugauucuggaugcgugaucaacuggaagggccgggagcugaaauguggguccggaauuuuugucacaaacgaagugcacaccuggacagagcaauauaaguuccaggccgacagcccuaagagacuguccgcggccaucggcaaggcuugggaggaagggguuugcggcauucgcucugccacccggcucgagaauaucauguggaagcagaucagcaacgaacugaaucauauucuucuggagaacgauaugaaauuuacgguggucgugggagacgcuaauggcauccucgcccaggggaagaaaaugauuagaccgcaacccauggaacacaaguacuccuggaaaucuuggggaaaggccaagaucauuggcgcugacauccagaacacaaccuucaucauugaugggccugacacccccgaguguccugauggacagcgcgcguggaauaucugggagguggaagacuauggcuuuggcgucuucacaaccaacauuuggcugaaacugcgggauagcuacacgcagaugugcgaccacagacuuauguccgccgcuaucaaggauagcaaagccguucaugccgacaugggguauuggauugagucugaaaagaaugagacauggaaacucgcucgcgccuccuucaucgaagugaagaccuguacauggcccaagagccacacccuguggucuaacggagugcuggaguccgagaugaucauuccgaaaaucuacggcgggccuauuagccaacauaauuaucggcccggauacuuuacacagaccgcgggcccuuggcaccucgggaagcuggaacuugauuucgaccugugcgagggaacgaccgucgugguugaugaacacugcggcaacagaggccccucucuccggacaaccacagugaccgggaaaaucauucaugagugguguugccgcagcuguacgcugccuccccugagauuucggggagaggacggcugcugguacgggauggaaaucagaccggucaaggagaaagaagagaaucuugugcgcuccaugguuagcgcuggaucuggcgaaguggauuccuucagccucgggauccugugugucuccauuaugaucgaggaggugaugcggucuagauggagccgcaagaugcugaugacaggaacccucgccguuuuucugcuucugauuaugggccagcucacauggaacgaccugaucagacugugcauuauggugggcgccaaugcuuccgaccggauggggaugggaaccaccuaucuugcccugauggcgacauucaagaugcgcccuauguuugcugucggccuccuguucagacggcucacgucucgcgaagugcugcuucugaccaucgggcucagccugguggccuccgucgagcugcccaacucucuugaggaacugggagauggccucgccauggggauuaugaugcugaaacuccugacagaauuucaaccccaccagcuuuggaccacacugcucagccugaccuucguuaagacgacacugucccuugacuacgcuuggaaaaccaccgccauggcucugagcaucgugucucucuuuccucugugucucuccacaaccagccagaagacaacguggcugccggugcuucugggaucuuucggcugcaaaccccugaccauguuucucaucacagagaacaagauuuggggcagaaaguccuggccucugaaugaggggaucauggccauuggaaucgucagcauucuucugucuucccuccugaaaaacgaugugccccucgcgggcccucugaucgccgggggaaugcuuaucgcuuguuauguuauuagcggcuccagcgccgaccugucucuggaaaaggcugccgaggugagcugggaacaggaggccgaacauuccggggcuucucacagcauccucgucgaggugcaagaugacggaaccaugaaaauuaaggaugaggaacgggacgauacacugaccauccuucugaaagcgacgcuccuggccguuuccggcguguaccccaugucuauuccugcuacccucuucgucugguauuucuggcagaagaaaaagcagcgcagcggcgugcugugggacacacccuccccgccugaggucgaaagagccgugcuugauaaugggaucuaccggauccugcagcgcggacugcucggcagaucucaaguuggggugggagucuuucaggacggcguguuccauaccauguggcacguuacaagaggggccgugcugauguaucagggaaagagacuugagcccagcugggcuuccgucaaaaaggaucugauuagcuacggcggcggguggcgcuuucagggaucuuggaacaccggcgaggaagugcaagugaucgccguugagccugggaaaaaucccaagaacguccagacaacgccgggaaccuucaaaacaccugaaggcgaggugggggcgauugcucucgacuuuaagcccggaaccuccggcagcccuaucgugaaucgggaaggcaagauugucgggcuguacggaaacggcgugguuaccacaucugggacguauguguccgccaucgcccaggcuaaagccagccaagagggaccccuccccgagauugaagacgaggucuucaagaaaagaaaucugaccaucauggaucuucacccuggcuccgggaagacacgccgguaccugccggcgaucgugagagaagcuauuaaacgcaagcugcggacccucauccuggcccccacaagaguuguggccucugagauggcugaagcccuuaagggcaugccuauucgcuaucagaccacggcugucaaaagcgagcauacaggacgggagaucguggaccugaugugccacgccaccuuuaccaugagacuccugucccccguucgggugccuaacuacaauaugauuaucauggaugaagcgcauuucacagaccccgccagcaucgcugcccgcggcuauauuucuaccagagucgggaugggagaggcugccgccaucuuuaugacagcuaccccuccgggcuccguggaagcguucccccagagcaacgccgugauucaggaugaggaacgggacaucccugagcgcucuuggaauagcggguacgauuggauuacggacuuucccggaaagacagucugguucguuccuuccaucaaaucuggcaacgauaucgcuaauugucugagaaagaacgggaaacgggugauucaacucagcagaaagaccuucgacacagaguaucagaagaccaaaaacuccgauugggacuacguggucacgaccgacaucucugaaaugggcgccaauuuucgcgccgaucgggugauugaccccagacgcugccuuaagccgguuauccugaaagauggaccugagcgggugauucuggcuggccccaugcccgucacagccgcgagcgcugcccagagacgcgggcggaucggaagaaaccagaauaaggaaggcgaccaauacguguauauggggcagccucucaacaaugaugaggaccacgcccauuggaccgaggcuaaaaugcugcuugauaacauuaauacacccgaaggaaucaucccugcccuguucgagccggaacgcgagaaguccgcggccauugacggcgaauacagacucagaggggaagcucgcaagaccuuuguugagcugaugagacggggcgaucugcccguguggcucagcuauaaagucgccucugaaggauuccaguacuccgaccgcagauggugcuuugauggcgagcggaacaaucaggugcuugaagagaacauggacgucgaaaucuggacaaaggagggggagcgcaagaaacugcgcccucgguggcuggaugcuagaaccuauagcgacccccucgcccugcgcgaguucaaagaguuugcugccggacggagauccgugucuggcgaccuuauucuggaaaucgggaaacucccucaacaccugacgcugcgggcgcagaaugcccucgauaaccuuguuaugcugcacaauagcgagcagggaggcaaggcuuaccgccaugccauggaggaacugcccgacacaauugagacccucaugcugcuugcucugaucgccgugcucaccggcggggugacacuguucuuucuguccggaaagggccucgggaagaccucuaucggacuucugugugucacagccagcuccgcucugcucuggauggcgagcguugaaccgcacuggauugccgcuucuaucauucuggaguucuuucuuauggugcugcucaucccugaacccgauagacagcggacgccucaagacaaccagcuggccuauguggucauuggccuccuguucaugauccuuaccguggccgcuaaugagauggggcugcuggagacaaccaaaaaggaucucggaaucggcuacguugccgcggaaaaccaucagcacgugacaaugcuggacgucgaucuucaccccgccuccgcuuggacccuguacgccguggcuacgaccgucauuacaccuaugaugcgccauaccaucgagaacgccacagcgaauauuagccucaccgccaucgcuaaccaagccgcuauucugaugggccuggacaaaggguggcccaucucuaagauggauauuggagugccgcuccuugcccugggcugcuauucccagguuaauccucugacgcucacagcugccgugcugaugcuugucgcgcacuacgccaucaucgggcccggacugcaggcuaaagccaccagagaagcucagaagcggacagccgccggcauuaugaagaaccccaccguggacgggaucguugcgauugaucucgacccuguggucuaugaugcuaaauuugagaagcaacugggacagaucaugcugcucauucuuuguaccagccagauccugcugaugcgcacaacgugggcccucugcgaaucuaucacccuggcuacaggcccgcuuaccacacugugggagggcagccccgggaaauucuggaauaccacgauugccguguccauggccaacaucuucagaggaucuuaccucgcuggcgccgggcuggcguuuagccugaugaagucccucggaggcgggcggcgcggaacaggcgcccagggcgagacccuuggggaaaaauggaagagacaacugaaucagcugagcaaguccgaguucaacaccuauaaacggucuggaauuauggaaguggacagaagcgaggcuaaggaaggccucaaacgcggggagacaaccaagcaugccguuucccggggaacagcuaaacugagaugguuugucgagcgcaaucuugugaagccugaaggcaaggugaucgaccugggguguggacggggcggcuggucuuacuauugcgccgggcucaaaaaggucacggagguuaaaggauacaccaagggcgggcccggacacgaggaaccuauucccauggcgacauacggcuggaaccuggugaaacugcauagcgggaaggauguguucuuuaugccuccggaaaaaugugacacccuccuuugcgauaucggagaguccucucccaauccuacagucgaggaaggcagaacccugcgcgugcugaagaugguugagcccuggcuccggggcaaccaguucuguaucaagauucugaauccuuauaugcccagcguggucgaaacgcuugagagaaugcagcgcaaacacgggggaaugcuggugcggaacccgcucuccagaaauagcacccacgagauguacuggguuucuugcggcacagggaacaucguguccgccgucaauaugaccagccgcaugcugcugaaccgguuuacaauggcucauagaaagccuaccuaugaacgcgacguggaucucggagccggcacaagacacguggcugucgagcccgaaguugccaaccuggacauuaucgggcaacggauugagaauaucaaaaacgaacauaagucuaccuggcacuacgaugaggacaaucccuauaaaacgugggcuuaccacggauccuaugaggugaagccuagcggcucugccuccagcauggugaacggcgucgugcgccuucugacaaagcccugggauguuauuccuauggugacccagaucgcgaugaccgacacaacgccguucgggcagcaaagagucuuuaaagaaaagguggauacccggacacccagagccaaacggggaaccacacagaucauggagguuaccgcuaaguggcucuggggcuuccugucccgcaauaaaaagccuagaauuuguacacgggaagaguuuacccgcaaggugagaagcaacgccgcugucggggccguguucguugacgaaaaucaguggaacucugccaaagaggcgguggaggacgaacgguuuugggaucuuguccaucgcgagagagaacugcacaagcagggaaaaugcgcuacgugcguguacaauaugaugggcaagcgggagaaaaagcucggggaguucggcaaggccaaaggaagccgcgccaucugguacauguggcugggcgcuagauuccuggaguuugaggcccucggguucaugaacgaagaccauugguuuucccgggaaaauucucugagcggagucgaaggcgaggggcuucacaagcugggauauauucuccgcgauaucuccaaaauucccggcgggaacauguacgcugacgauaccgccggcugggacacaagagugaccgaggaugaccugcaaaaugaagcgaagaucacagauaucauggagccugaacaugcccuucuggcuaccucuauuuucaaacucacguaucagaacaagguugugcggguccagcgccccgccaaaaauggaacagugauggacgugaucagcagacgggaucagagaggcuccgggcaaguuggaaccuacggccugaacacauuuaccaacauggaggugcagcugauucgccagauggaaucugaggggaucuuccucccgagcgagcuggaaacgccuaaucuugcugagcgggcccuggacuggcucgaaaagcacggagcggagagacugaagcgcauggccauuuccggcgaugacugugucgugaaacccaucgacgaucgguuugcuaccgcccuuacagcucugaacgacauggggaagguuagaaaagauaucccucagugggaacccagcaagggcuggaaugacuggcaacaggugccuuucugcucucaccauuuucaccagcucauuaugaaagauggacgcgagaucgucgugcccugucggaaccaggacgagcuggucggcagagcccgcgugucccaaggggcuggauggagccugcgggaaaccgccugccucggcaagucuuaugcgcagauguggcagcugauguacuuccauagacgcgaucuucggcuggccgcuaaugccauuuguuccgccguuccgguggacugggucccuacaagcagaaccacaugguccauccacgcucaccaucaauggaugaccacggaggauaugcucucuguguggaaccggguuuggauugaagagaaucccuggauggaaaacaagacacacgugagcuccugggaggagguccccuaucuggggaaaagagaagaccaguggugcggaagccuuaucggccugaccgcccgcgcgaccugggcuacaaauauccagguggccauuaaccaggugcggagacucaucgggaaugagaacuaccuggauuacaugaccucuaugaagcgcuuuaaaaaugaauccgacagcgagggcgcccugugguga

SEQ ID NO: 18730 - RNA, 9879 nt, Artificial Sequence
  derived and/or modified CDS sequence (opt5) from DENV-1__JN819417__SS-prME
agcgugaccaugcugcucaugcugcuucccacagcucuggcuuuccaccucacgaccagaggcggggagccucauauggucguuuccaagcaggaacgggggaaaucucugcuuuuuaagacaagcgccggcgugaauaugugcacccugaucgcgauggaccucggggagcugugugaagauacaaugaccuacaaaugccccagaauuacagaggcugaacccgacgauguggacuguuggugcaaugccaccgauacgugggucaccuauggaacauguucccaaaccggcgagcacagacgggacaagcgcucuguggcccuggcuccucauguugggcucggacuggagacaagaaccgaaacguggaugagcuccgagggcgccuggaaacagauccagaagguggaaacaugggcccuucggcaccccggcuucaccgucauugcccuguuucucgcgcaugccaucgggacaucuauuacccagaagggaaucaucuucauucugcuuaugcuggugaccccuagcauggcuaugcgcugcguuggcaucgggaacagagauuuuguggagggacucuccggcgccacaugggucgacguggugcuggagcacgggagcugugucacgaccauggcuaaaaauaagcccacacuggauauugaacuccugaaaaccgagguuacaaacccugccauccuucggaagcugugcauugaagcgaaaaucucuaauaccacgacagacucccgcuguccgacccaaggagaggccacccucguggaagaacaagaugcuaacuucgugugcagacggacauuugucgaccgcggcuggggcaauggguguggacuguucggcaaggggagccuucugaccugcgccaaguuuaaaugcgugacaaagcucgagggaaaaauuguucagcacgaaaaccugaaguacucugugaucgucacggugcauaccggcgaucagcaccaaguugggaaugagacaaccgaacauggaacaaucgcuaccauuacgccccaggccccuaccuccgagauccagcugacagacuauggcgcccucacccuggacuguagccccagaacaggccuugauuucaacgaaauggugcugcucaccaugaaagagaagucuuggcugguccacaaacagugguuucuugaccugccucuccccuggacguccggggcuagcacaucccacgagaccuggaaucggcaagaucugcuggugacauucaagaccgcgcaugccaagaaacaggaagucgugguucucggaucucaggagggcgcuaugcacaccgcccugacaggggccacggaaauucaaaccagcggaacaaccacaaucuuugcuggccaucuuaagugccgccugaaaauggacaagcucacccugaaagggauguccuacgugauguguacgggcagcuucaagcuggagaaggaagucgccgagacacagcacggaaccgugcuuguucaggugaaauaugagggcaccgaugcgccgugcaagauuccuuucucuacacaggacgaaaaaggggucacccaaaacggaagacucaucacagcuaaucccaucgugacggauaaggagaaaccugugaacauugaaaccgagccgcccuuuggcgaguccuacaucguugucggggccggagaaaaggcccugaagcugagcugguucaaaaagggcucuagcauugggaaaauguuugaggcuacagcccggggcgcuagacgcauggccauccucggagacaccgcgugggauuucggcuccauugggggaguguuuacaucugugggcaagcugguccaucagguguucgggaccgccuauggaguucuuuuuagcggcguguccuggacgaugaaaaucgggaucggcauucugcucaccuggcugggacugaauagccggucuacaucccuuagcaugaccuguaucgcugucggcauggugacacucuaccuggggguuauggugcaggccgacucuggaugcgucauuaacuggaagggcagagaacugaaguguggguccggaaucuucgugaccaacgagguucacacauggaccgaacaguacaaauuucaagcugauagcccuaagcgccucuccgccgcgauuggcaaagccugggaggagggggugugcggcauccggucugcuacgagacuggaaaauauuauguggaagcagaucagcaacgagcuuaaucacauccugcucgaaaacgacaugaaauucacagucguggugggagacgccuccggcauucuggcucaggggaagaaaaugauccgcccgcagcccauggagcauaaguauucuuggaaaagcuggggaaaggccaagauuaucggcgccgauacccaaaauaccacauuuauuaucgacgggccugauacccccgaauguccugacgaucagcgggcuuggaacaucugggaggucgaggacuacggauucggcauuuuuacgacaaauaucuggcugaaacuuagagauuccuauacccagaugugcgaccaccgccucaugagcgcggccauuaaggauucuaaagcuguucaugccgacaugggcuacuggaucgaauccgagaagaacgaaacauggaagcuggcccgggcuagcuucauugaggugaaaaccuguaucuggcccaagucucacacacugugguccaauggggugcucgaaagcgagaugaucauuccgaaaaucuauggaggcccuauuucucagcacaacuacagacccggguauuucacccaaacggccggaccuuggcaucugggcaaacuugagcuggauuuugaccucugcgaagggaccacagucgugguugaugagcacugcggaaaucgcggccccagccugcggaccacaaccgugacgggcaaaaucauucaugaaugguguugcagauccuguacacugccuccccuucgguuccgcggggaggacggaugcugguacggcauggagaucagaccggucaaggaaaaggaggaaaaccucgugcggagcaugguuucugcgggguccggagagguggacagcuuuucccugggcauccugugugucucuauuaugaucgaagaggugaugagaagccgcuggucccggaaaaugcucaugaccgggacacuggcuguuuuccuucugcucauuaugggacagcugaccuggaaugaucugaucagacuuugcauuauggugggcgccaacgccucugaccgcaugggcauggggaccacauaccuggcucucaugggaacguuuaagaugagaccuauguucgccgucggccugcucuuucggcgccugaccagcagagaggugcuucugcucacaaucgggcugucccugguggcgucugucgaacuucccaauagccuggaggaacucggagauggccuggcuauggggauuaugaugcucaaacugcuuaccgaguuccagccccaccaacuguggacaacccuccugucccugacguuuaucaagacaacccuuagccuggacuaugccuggaaaaccauggccaugguucucucuaucgugucccuguucccucucugucugagcacaaccucucagaagacaacguggcuuccggugcugcugggauccuuuggcugcaagccccucaccauguuccugauuacagaaaacaaaaucuggggcagaaagagcuggccucuuaacgaggggauuauggcuaucggaauugucucuauccugcucuccagccugcucaaaaaugaugugccccuggccggcccucuuaucgcugggggaaugcugauugccuguuacguuaucuccggcagcucugcggaccugagccucgagaaggccgcugaaauuuccugggaggaagaggccgaacauucugggaccagccacaacauccugguggagguccaggaugacggaacaaugaaaauuaaggaugaggaacgcgacgauacccuuacgauccugcucaaagcuacccugcucgccguguccggcguuuaucccaugucuaucccugccacacuguuugugugguacuucuggcagaagaagaaacaaagaagcggcguccuuugggacacccccuccccgccugagguggaacgggcuguccuggaugacgggauuuaucgcauccugcagagaggacuccugggccggucucagguggggguuggaguguuccaggacggcgucuuucacacaauguggcaugugacccgcggggcgguucuuauguaccaaggaaagagacuggagcccagcugggccuccgugaaaaaggaucucauuagcuauggcggcggguggcgguuccagggaucuuggaauacaggcgaggaaguccaggugaucgcuguggagccugggaaaaaccccaagaauguucagacgaccccgggaacauuuaagaccccugaaggcgaggucggggccauugcccuggacuucaaacccggaaccuccggcagcccuaucgugaacagagaaggcaagauuguggggcucuacggaaauggcgucgugacaacgucugggaccuacguuuccgcuaucgcccaagcgaaagcuagccaggagggaccccugcccgagaucgaagaugagguguuuaagaaacgcaaccuuacaauuauggaccugcacccuggcuccgggaagacccggagauaucugccggccaucguccgcgaagccauuaagcggaaacucagaacacugauccuugcucccacccgcgugguugccucugagauggcggaagcucugaagggcaugccuauucgguaccagacgacagccgugaaaagcgagcauaccggaagagagaucgucgaucucaugugccacgccaccuucacaaugcgccugcugucccccgugcggguuccuaauuauaacaugaucauuauggacgaagcucauuuuaccgaucccgccagcaucgcugccagaggcuacauuucuacacggguggggaugggagaggcggccgcuaucuucaugaccgccacgccuccgggcuccgucgaggcuuuuccccaaagcaaugccgugauucaggacgaggaacgcgauaucccugagagaucuuggaacagcggguaugacuggaucacagauuuccccggaaagaccauuugguuugugccuuccaucaaaucuggcaaugacauugccaacugucuccggaagaaugggaagcgcgucauccagcuuagcagaaaaacauucgacaccgaguaccagaagacgaaaaacaacgauugggacuauguugugaccacagauauuuccgaaaugggcgcuaauuuccgggcggacagagugaucgauccccgccggugccugaagccggucauucugaaagacggaccugagagagugauccucgccggccccaugcccguuaccguggcuucugccgcccaacgccgggggagaaucggacgcaaccagaauaaggaaggcgaucaguacgucuacauggggcagccucugaacaaugacgaggaucacgcucacuggacagaggccaagaugcuucuggacaacauuaauacccccgaaggaaucauuccugcgcucuuugagccggaacgggagaaaagcgcugccaucgauggcgaauauagacugcgcggggaggccagaaagacauucguggagcugaugcggcgcggcgaccuccccguuuggcuuuccuacaaaguggcuagcgaaggauuucaauauucugauagacgguggugcuucgacggcgagcgcaacaaucagguccuggaagagaacauggacguggaaauuuggaccaaggagggggagcgcaagaagcugcggccuagauggcucgaugcccgcacguacuccgacccccuggcgcuucgggaauuuaaagaguucgccgcuggaagacgcagcaucuccggcgaucugauccucgaaauugggaagcugccucagcaucugacacuccgggcccagaaugcucuugacaaccuggucaugcugcacaauucugagcaaggaggcaaggccuauagacaugcuauggaggaacuccccgauaccaucgagacccugaugcuucuggcccucauugcggugcugacaggcgggguuacccuguuuuuccucagcggaaaaggccuugggaagacauccaucggacugcugugugugauggccucuagcgcucuccuguggauggccaacguggaaccgcacuggauugcugccuccaucauccuugaguuuuuccugaugguccuccugauuccugaacccgaccggcagcgcacgccucaggauaaucagcuggccuacguugugaucggccuccuuuuuaugauucugaccguggcugcgaacgagauggggcugcucgagacaaccaaaaaggaccugggaaucggccacgucgccgcugaaaaccaucaccaugccacaaugcuugauguggaccugagacccgccagcgcuuggacccucuaugccguugcgacgaccgugauuacaccuaugaugcggcacaccaucgagaauacaaccgccaacauuucucugacggcuaucgccaaucaagcugccauccugaugggccucgauaaaggguggcccauuuccaagauggacaucggagucccgcuucuggcgcugggcugcuacagccaggugaacccucucacacugaccgccgcuguccuuaugcugguggcccauuacgcuauuaucgggcccggacuccaggccaaggcuacacgcgaagcccagaagcggaccgcggccggcauuaugaagaaucccaccguugaugggaucguggcuaucgaccuggacccugucguguaugaugccaaauucgagaagcagcugggacagauuaugcuccuuauccuguguacaucucagauucugcucaugcggacgaccugggcucugugcgaauccaucacacuugccaccggcccgcugacaacccucugggagggcagccccgggaaauuuuggaacacgacaauugccguuucuauggcgaauaucuuccgcggaagcuaccuggcuggcgccgggcuggcuuucucccucaugaagucucuuggaggcgggagacggggaaccggcgcccaaggcgagacccugggggaaaaguggaaacgccagcugaaccagcucagcaaguccgaguuuaauacauauaaaagaagcggaaucauggaaguggaccgguccgaggccaaggaaggccugaaaagaggggagaccacaaagcacgcugucucucgcggaacggccaaacuucggugguucguggagagaaaccuggugaaaccugaaggcaagguuauugaucucggguguggacgcggcggcuggagcuacuauugcgcggggcugaaaaaggucaccgaggugaaaggauacacaaagggcgggcccggacacgaggaaccuauccccauggccaccuauggcuggaaucuggugaaacuccauuccgggaaggacgucuuuuucacaccuccggaaaagugugauacccuucugugcgacauuggagagucuagccccaacccuacgaucgaggaaggccggacccugagaguucucaaaaugguggagcccuggcugcgcggcaaucaguuuuguauuaagauccuuaacccuuacaugcccuccguggucgaaacacuggagcaaaugcagcggaaacacgggggaaugcucgugagaaauccgcugucucgcaacagcacccaugagauguacuggguuuccugcggcacagggaauauugugagcgcugucaacaugaccucucggaugcugcucaacagauucacaauggcccaccgcaagccuaccuaugaaaaagauguggaccugggagcuggcacgcggcacguugccguggagcccgaagucgcgaaucuugauaucaucgggcagagaauugagaacaucaagaaugaacauaaguccacauggcacuacgacgaggauaaccccuauaaaaccugggccuaccauggaagcuaugaggugaagccuucuggcuccgcuagcucuauggugaauggcgucguucgccugcucaccaaacccugggacgugauuccuauggugacacagaucgccaugacggacaccacaccguuugggcaacagagagucuucaaggaaaaaguggauacccggacaccccgcgcuaagagaggaaccgcccagauuauggagguuacagcuaaguggcuguggggcuuucuuucccggaacaaaaagccuagaaucuguacccgggaagaguucacgaaaaaggugcgcagcaaugccgcgaucggggccgucuuuguggacgaaaaccaauggaacuccgcuaaagaggccguugaggaugaaagauucugggaccuggugcaccgggagcgcgaacuccauaagcagggaaagugcgcuaccugcgucuacaacaugaugggcaaaagagagaagaaacugggggaauuuggcaaggccaaaggaagccgggccauuugguauauguggcugggcgcgcgcuuccucgaguucgaggcucugggguuuaugaaugaagaucacugguucucuagagagaacagccuuuccggaguggaaggcgaggggcugcacaagcucggauacauccugcgggacauuucuaaaauccccggcgggaauauguacgccgaugacacagccggcugggauacccgcauuacagaggacgaucuucagaacgaagcuaagaucaccgacaucauggagccugaacaugcccugcucgcuacgagcauuuuuaagcugacauaucagaauaaaguugugagaguccaacggcccgccaagaacggaaacgugauggaugucaucucccgcagagaccagcggggcucuggacaggugggaaccuacggccugaauacauucaccaacauggagguucagcucauucgccaaauggaaagcgaggggaucuuucugccguccgagcuugaaacgccuaaucuggcggagagagugcucgacuggcuggaaaaacacggagccgagcggcuuaagagaauggcuauuucuggcgaugacugugucgugaaacccaucgaugaccgcuucgccaccgcucugaucgcccucaacgauauggggaaggugcggaaggacauuccucagugggaacccagcaaaggcuggaaugauuggcagcagguuccuuuuugcucccaucacuuccaccaacugaucaugaaggacggaagagagauugugguccccugucgcaaccaggaugagcuggugggccgggcgagaguuagccagggggccggauggucucuccgcgaaacagcuugccugggcaaauccuaugcccagauguggcaacuuauguacuuucaucggagagaccugcgccucgcugccaaugcuaucuguagcgccgugccggucgauugggugccuaccucucggacaaccugguccauucacgcgcaucaccaguggaugacaaccgaggacaugcugagcgucuggaacagaguguggaucgaagagaaucccuggauggaagacaagacgcauguuuccucuugggaggaggugcccuaucuugggaaacgcgaagaucaguggugcggaagccugauuggccucacagcccgggcuaccugggccaccaacauccaagucgccaucaaucaggugagacggcugauugggaacgagaauuaccuggacuauaugacauccaugaagagauucaagaacgaaagcgauccugagggcgcucucugguga

SEQ ID NO: 18731 - RNA, 9879 nt, Artificial Sequence
  derived and/or modified CDS sequence (opt5) from DENV-1__FJ687426__SS-prME
agcgugaccaugcugcugaugcugaugcccacagcccuugcuuuccaccugacgacccggggcggggaaccucauaugaucguguccaagcaggaacggggaaagucucuccuguuuaagaccagcgccggcguuaacaugugcacccuuauugccauggaccugggggaacucugugaagauacaaugaccuacaaaugcccgcgcaucacagaggcugaacccgacgauguggacuguuggugcaaugccaccgauacgugggugaccuauggaacauguucccagaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccagggagaggccacccugguggaagaacaggacgcuaacuucgugugccggcgcacauuugucgauagaggcuggggcaauggguguggacucuucggcaaagggucucugcuuaccugcgccaaguuuaagugcgugacaaaacuggagggaaagauuguucaguacgaaaaccucaaauauuccgugaucgucacggugcacaccggcgaccagcaucaaguugggaaugagagcacagaacacggaaccacagcuaccaucacgccccaggccccuaccacagagauucagcugaccgacuacggcgcccugacacucgauuguucuccccggaccggccuggacuucaacgaaauggugcuucugacgaugaaggagaaauccuggcucguccauaagcagugguuucuggaucuuccucugcccuggacaagcggggcuuccaccucucaagagacauggaaucgccaggaccuccuggugaccuucaaaaccgcgcacgccaagaagcaggaagucgugguucugggaagccaagagggcgcuaugcacacagcccucacgggggccaccgaaauccagacauccggaaccacaaccauuuuugcuggccaucugaaaugcagacuuaagauggauaaacugacgcucaaggggaugagcuaugugauguguacaggcucuuucaaacuggagaaggaagucgccgagacccagcacggaaccgugcugguucagaucaaguacgagggcacagacgcgccgugcaaaauuccuuucuccacccaagaugaaaagggggugacacagaacggacggcuuaucacggcuaaucccaucgucaccgacaaagagaagccugugaacauugaagccgagccgcccuuuggcgagagcuauaucgugauuggggccggagaaaaagcucucaagcugucuugguucaagaaaggcagcuccaucgggaagauguuugaggccacagcuagaggcgcccgccggauggcgauucugggagauaccgccugggacuucggcucuaucgggggaguuuuuacaagcgucggcaaacucgugcaucagaucuucgggaccgcuuacggagugcuguuuuccggcgucagcuggacgaugaagauugggaucggcgugcuucugaccuggcucggacucaauucuagauccacaagccugucuaugaccuguauugccguuggccuugugacacucuaccugggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcucucugcggccaucggcaaggcuugggaggagggggugugcggcauuagaagcgccacgcgccuggaaaacaucauguggaaacagaucuccaacgagcuuaaucauauucugcucgaaaacgacaugaaguucacaguuguggucggagauguggcuggcauccuggcccaggggaaaaagaugauucggccgcaacccauggaguacaaauauucuuggaaaagcuggggaaaggccaagaucauuggcgcugacgugcaaaauuccaccuuuaucaucgaugggccuaacacccccgaauguccugacgaucagagagcguggaauauuugggaggucgaggacuacggauucggcaucuuuacaaccaacauuuggcugaaacuucgcgauagcuauacgcagguuugcgaccaccggcucaugucugccgcuaucaaagauuccaaggccgugcacgccgacaugggcuacuggauugaaagcgagaaaaaugaaacauggaagcuggcuggggccucuuucaucgaggugaagaccuguaucuggcccaaaucccauacacuguggagcaacggaguccucgaaucugagaugauuaucccgaagauuuauggcgggccuaucagccaacacaauuacagacccggauacuucacccagacagcgggcccuuggcaucuggggaaacuugagcuggauuuugaccucugcgaaggaaccacggugguuguggaugagcacugcggcaaccgcggccccucccugcggaccacaaccgucacagggaagauuauccacgaaugguguugcagaagcuguacccugccuccccuucgguuccgcggagaggacggcugcugguaugggauggagaucagaccggugaaagaaaaggaggaaaaucucguuaagucuaugguguccgcuggaagcggcgaggucgacuccuuuucucuggggcugcucuguauuagcaucaugauugaagaggugaugcgguccagauggucucgcaaaaugcugaugacgggaacacuugccguuuucuuucugcucaucaugggccagcugaccuggaacgaucugauucggcuuugcaucauggugggcgccaaugcuagcgacagaauggggaugggaacaaccuaccuggcccucauggcgaccuucaagaugcgcccuauguuugcugucggccugcuguucagacggcugacaucccgcgaggugcuucugcucacgauugggcugucucugguggccagcgucgaacuucccaacucccuggaggaacucggagauggccuggccauggggaucaugauccucaaacugcuuaccgacuuucaaagccaucagcugugggcuacacuccugucucugaccuucauuaagacaacccuuucccugcacuaugccuggaaaacgauggcuaugguucucagcaucgugucucuguuuccccucugucuguccacaaccagccagaagaccacauggcuuccugugcugcugggaucucucggcugcaagccgcugaccauguuccuuauugccgagaauaaaaucuggggcagaaaguccuggccccugaacgaagggauuauggcggucggaaucgugagcauccuccuguccagccuccugaaaaacgauguuccucuugccggcccccugauugcugggggaaugcugaucgccuguuacgugauuucuggcagcuccgcugaccucucucuggagaaggccgccgaggucagcugggaagaggaagcugagcauuccggggcgucucacaauauccuuguggaaguucaggaugacggaacaaugaaaauuaaggaugaggagcgggacgauacgcugaccauccuccugaaagccacacuccuggcugugagcggcgucuauccucuuuccauccccgccacccuguuugugugguacuucuggcaaaagaagaaacagcgcucuggcguccugugggacacaccuagcccucccgaaguggagagagccguucucgaugacgggauuuaucggaucaugcagcgcggacugcuuggcagaucccaggugggggucggaguguuccaagaaaacguuuuucauaccauguggcacgugacgcggggcgcuguccugauguaccaggggaagcgccucgagcccagcugggccucugugaaaaaggaccugauuuccuacggaggcggcuggagacuccaggggagcuggaauaccggagaggaagugcagguuaucgcggucgagcccggcaaaaacccuaagaaugugcaaacagcucccgggaccuucaagacaccggaaggagaggugggcgccauugcccuggauuuuaaaccugggaccucuggaucccccaucgucaaccgggaaggcaagauugugggccuuuaugggaauggaguugugacaacgagcggcaccuacgucuccgcuaucgcccaggcgaaggcuucucaggaggggccucugcccgagaucgaagacgagguguucagaaagcgcaaccugacaauuauggaucuccaccccggaagcggcaaaacccggagauaucugccugccaucguucgcgaagccauuaagcggaaacuuagaacccugauccucgcuccgacacgcguggucgccuccgagauggcugaagcccugaaagggaugcccauucgguaccaaacgaccgcggucaagagcgagcauacaggcaaagagaucguugaccugaugugccacgccaccuuuacaaugagacuccuuucuccugugcgcguccccaauuauaacaugaucauuauggaugaagcucauuucaccgacccuuccagcaucgccgcucggggauacauuucuacgagagugggcaugggggaggccgccgcuaucuuuaugacagcgacacccccuggaagcguggaagccuucccgcaguccaaugcugucauucaggaugaggaacgggacauccccgagcgcucuuggaacagcggcuaugaguggaucaccgauuuuccugggaagacaguuugguucgugcccuccauuaaagccggaaaugacaucgccaacugucugagaaagaauggcaagcgggugauucagcugucucgcaaaaccuuugauacagaauaccaaaagaccaaaaacaacgacugggacuacgucgugacgacagauaucagcgagaugggggcuaauuucagagccgaccggguuauugauccuagacgcugccucaagcccgugauccugaaagacggcccggaacgggucauucuugcgggaccuaugcccgugaccguugcuuccgccgcccagagacgcggccggaucgggagaaaccacaauaaggagggagaucaguauaucuacaugggccagccccugaacaaugacgaggaucaugcucacuggacagaagccaagaugcuccuggacaacauuaauaccccugaggggaucauucccgcgcuguucgaaccugagcgcgaaaagagcgccgcuaucgauggagaguaucggcucagaggcgaggcccgcaagacguuuguggaacuuaugagaagaggggaccugccggucuggcugucuuacaaaguggcuuccgagggcuuccaauauagcgaucgcagauggugcuuugacggagaacggaacaaucagguccucgaggaaaacauggauguggagauuuggaccaaggagggcgaacgcaaaaagcugagaccccgguggcuugacgccagaacauacuccgacccucuggcucuccgcgaguucaaagaauuugccgcggggcggagaucuguuagcggagaucugauccuggagaucggcaagcucccccagcaccuuacccagcgcgcccaaaaugcucuggacaaccuggugaugcuccauaauuccgaacaagggggacgggccuauagacacgcuauggaggagcugccugauacaauugaaacccuuaugcugcucgcccugaucgccgugcugacaggcggcgucacccucuucuuucuuucugggaagggacugggcaaaacgagcauugggcugcucuguguuauggcuuccagcgugcugcuuuggauggcgucuguggagccccauuggaucgccgcuuccauuauccuggaguucuuucucaugguccugcugaucccggagccugaccggcagcgcacaccccaggauaaccaacucgccuacgugguuauuggacuucuguucaugauccugaccguggccgcuaaugagaugggccuccuggaaaccacaaagaaagaccuugggauuggacacgucgccguggagaaccaccaucacgcggccaugcuggaugucgaccuccauccugcuagcgccuggacccuguacgcuguggccacaacgaucauuacccccaugaugagacacacaaucgaaaacaccacagcgaauauuucucugaccgccaucgcuaaccaggccgcuauccucaugggccuugauaagggcuggccuauuuccaaaauggacaucgggguuccccugcuggcccucggaugcuauagccaggugaauccgcugacgcuuaccgcugccguccugaugcucguggcgcauuacgccauuaucggcccugggcugcaagcuaaggccacacgggaggcucagaagcgcaccgccgccggaauuaugaaaaaccccacaaucgauggcaucguugcgauugaccuggaucccguggucuaugacgcuaaguuugaaaaacagcucgggcagaucaugcuucugauucuguguaccucucaaauccuccugaugagaacgacaugggcccuuugcgagagcauuacccuggcuacaggaccucucaccacccugugggagggcuccccgggcaaguucuggaauacaacgaucgccgugucuauggccaacaucuuucgggggagcuaccuggcuggagccggccucgcguucucccuuaugaaaagccucgggggaggccgcagagggaccggagcccagggcgaaacacugggcgagaaguggaagcggcagcucaaucagcuguccaaaucugaguucaacaccuauaagcgcagcgggauuauggagguggacagauccgaagcuaaagagggacuuaagcggggcgagacaaccaaacacgccguuucuagagggacggcuaagcugcgcugguuugucgaacggaaucucgugaagcccgagggaaaagugaucgaucugggcugugggagaggaggcuggagcuacuauugcgccggccugaagaaagucacagaaguuaagggguacaccaaaggaggcccugggcacgaggaacccauuccuauggcgaccuacggauggaaccucgugaaacuucauuccggcaaagacguguucuuuauucccccugagaagugugauacacugcugugcgacaucggggagucuagcccgaaucccaccaucgaagagggacgcacacuccggguccugaagaugguggaaccuuggcuuagaggcaaccaauucuguauuaaaauccugaaucccuauaugccuuccguuguggagacgcucgagcagaugcagcgcaagcacggcgggaugcugguccggaacccccugagcagaaauucuacccaugaaauguacuggguguccugcggaacaggcaacaucguuagcgccgugaauaugaccucucgcaugcuccugaaccgguuuacaauggcucacagaaaaccgaccuaugagcgcgaugucgaccuuggggccggaacgcggcacguggcuguggaaccugaggucgccaaccuggauauuaucggccagagaauugaaaauaucaagcaugagcacaaauccaccuggcauuacgacgaggauaaccccuauaagacaugggcuuaccacgggagcuaugaaguuaagcccucuggauccgccagcuccauggugaauggcguggucaaacuccugaccaagccuugggacgugauucccaugguuacacaaaucgcgaugaccgauacaaccccuuucggccagcagcgcguguuuaaagagaaggucgacacgagaacaccgaaagccaagcgggggaccgcucaaaucauggaagugaccgccaaguggcuuuggggauuccugagccgcaacaaaaagcccagaauuuguacacgggaggaauuuacgagaaaaguucggucuaaugcugccaucggcgccguguucgucgacgagaaccaguggaauagcgcgaaggaggcuguggaagaugaccgcuuuugggaucucguucauagagagcgggaacugcacaaacaggggaagugcgcgaccugcguguacaacaugaugggaaagcgcgagaaaaagcugggcgaguucgggaaagccaagggcuccagagcuauuugguacauguggcucggagcccgguuucuggaguucgaggcucuuggcuucaugaaugaagaccacugguuuucucgcgagaacagccuguccggggucgaaggagagggccuccauaaacugggguauauccuuagagauauuucuaagaucccuggaggcaauauguacgccgacgauacagcggggugggacacccggaucacagaggaugaccugcagaacgaagccaaaauuaccgauaucauggagcccgaacacgcucuccuggccaagagcauuuucaagcugacauaucaaaauaaagugguccgcgugcagagaccugcuaagaacggcaccguuauggacgugaucucccggcgcgaucagagaggaucuggccaggucgggacguacggacucaauaccuuuacaaacauggaggcccaacugauucggcagauggaaagcgagggcaucuucucccccaacgagcuugaaaccccgaaucuggcggagcgcgugcucgacuggcuggaaaaauaugggguggagagacuuaagcggauggccaucagcggagacgauuguguugugaaaccuauugacgauagauuugcuacagcccugaccgcucucaacgacaugggcaagguccgcaaggauaucccccagugggaaccuucuaaaggguggaaugacuggcagcaagugcccuucugcucccaucacuuucaccagcugauuaugaaggauggccgggagaucguugugccuuguagaaaccaggacgagcuggucggacgcgcccgggugagccagggcgcuggguggucucucagagaaacggccugccugggaaaauccuacgcgcaaauguggcagcuuauguauuuccaucgccgggaucugagacucgccgcuaaugccauuuguagcgccguccccguggacuggguuccgacaucccgcaccacauggucuauccacgcucaucaccaguggaugaccacggaggauaugcugagcguguggaaccgggucuggauugaagagaauccuuggauggaagacaagaccagaaucuccagcugggaggacgugcccuaccuuggcaaacgcgaggaucaauggugcgggucucugaucggacucacagcccgggcgaccugggcuacaaacauucagguugccaucaaucaggugagacggcugauuggcaacgaaaauuacuccgacuauaugaccagcaugaagagauuuaagaacgagucugaacccgagggggcccugugguga

SEQ ID NO: 18732 - RNA, 9879 nt, Artificial Sequence
  derived and/or modified CDS sequence (opt5) from DENV-1__FJ687428__SS-prME
agcgugaccaugcugcugaugcugaugcccacagcccuugcuuuccaccugacgacccggggcggggaaccucauaugaucguguccaagcaggaacggggaaagucucuccuguuuaagaccagcgccggcguuaacaugugcacccuuauugccauggaccugggggagcucugugaagauacaaugaccuacaaaugcccgcgcaucacagaggcugaacccgacgauguggacuguuggugcaaugccaccgauacgugggugaccuauggaacauguucccagaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccagggagaggccacccugguggaagaacaggacgcuaacuucgugugccggcgcacauuugucgauagaggcuggggcaauggguguggacucuucggcaaagggucucugcuuaccugcgccaaguuuaagugcgugacaaaacuggagggaaagauuguucaguacgaaaaccucaaauauuccgugaucgucacggugcacaccggcgaccagcaucaaguugggaaugagagcacagaacacggaaccacagcuaccaucacgccccaggccccuaccacagagauucagcugaccgacuacggcgcccugacacucgauuguucuccccggaccggccuggacuucaacgaaauggugcuucugacgaugaaggagaaauccuggcucguccauaagcagugguuucuggaucuuccucugcccuggacaagcggggcuuccaccucucaagagacauggaaucgccaggaccuccuggugaccuucaaaaccgcgcacgccaagaagcaggaagucgugguucugggaagccaagagggcgcuaugcacacagcccucacgggggccaccgaaauccagacauccggaaccacaaccauuuuugcuggccaucugaaaugcagacuuaagauggauaaacugacgcucaaggggaugagcuaugugauguguacaggcucuuucaaacuggagaaggaagucgccgagacccagcacggaaccgugcugguucagaucaaguacgagggcacagacgcgccgugcaaaauuccuuucuccacccaagaugaaaagggggugacacagaacggacggcuuaucacggcuaaucccaucgucaccgacaaagagaagccugugaacauugaagccgagccgcccuuuggcgagagcuauaucgugauuggggccggagaaaaagcucucaagcugucuugguucaagaaaggcagcuccaucgggaagauguuugaggccacagcuagaggcgcccgccggauggcgauucugggagauaccgccugggacuucggcucuaucgggggaguuuuuacaagcgucggcaaacucgugcaucagaucuucgggaccgcuuacggagugcuguuuuccggcgucagcuggacgaugaagauugggaucggcgugcuucugaccuggcucggacucaauucuagauccacaagccugucuaugaccuguauugccguuggccuugugacacucuaccugggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcucucugcggccaucggcaaggcuugggaggagggggugugcggcauuagaagcgccacgcgccuggaaaacaucauguggaaacagaucuccaacgagcuuaaucauauucugcucgaaaacgacaugaaguucacaguuguggucggagauguggcuggcauccuggcccaggggaaaaagaugauucggccgcaacccauggaguacaaauauucuuggaaaagcuggggaaaggccaagaucauuggcgcugacgugcaaaauuccaccuuuaucaucgaugggccuaacacccccgaauguccugacgaucagagagcguggaauauuugggaggucgaggacuacggauucggcaucuuuacaaccaacauuuggcugaaacuucgcgauagcuauacgcagguuugcgaccaccggcucaugucugccgcuaucaaagauuccaaggccgugcacgccgacaugggcuacuggauugaaagcgagaaaaaugaaacauggaagcuggcuggggccucuuucaucgaggugaagaccuguaucuggcccaaaucccauacacuguggagcaacggaguccucgaaucugagaugauuaucccgaagauuuauggcgggccuaucagccaacacaauuacagacccggauacuucacccagacagcgggcccuuggcaucuggggaaacuugagcuggauuuugaccucugcgaaggaaccacggugguuguggaugagcacugcggcaaccgcggccccucccugcggaccacaaccgucacagggaagauuauccacgaaugguguugcagaagcuguacccugccuccccuucgguuccgcggagaggacggcugcugguaugggauggagaucagaccggugaaagaaaaggaggaaaaucucguuaagucuaugguguccgcuggaagcggcgaggucgacuccuuuucucuggggcugcucuguauuagcaucaugauugaagaggugaugcgguccagauggucucgcaaaaugcugaugacgggaacacuugccguuuucuuucugcucaucaugggccagcugaccuggaacgaucugauucggcuuugcaucauggugggcgccaaugcuagcgacagaauggggaugggaacaaccuaccuggcccucauggcgaccuucaagaugcgcccuauguuugcugucggccugcuguucagacggcugacaucccgcgaggugcuucugcucacgauugggcugucucugguggccagcgucgaacuucccaacucccuggaggaacucggagauggccuggccauggggaucaugauccucaaacugcuuaccgacuuucaaagccaucagcugugggcuacacuccugucucugaccuucauuaagacaacccuuucccugcacuaugccuggaaaacgauggcuaugguucucagcaucgugucucuguuuccccucugucuguccacaaccagccagaagaccacauggcuuccugugcugcugggaucucucggcugcaagccgcugaccauguuccuuauugccgagaauaaaaucuggggcagaaaguccuggccccugaacgaagggauuauggcggucggaaucgugagcauccuccuguccagccuccugaaaaacgauguuccucuugccggcccccugauugcugggggaaugcugaucgccuguuacgugauuucuggcagcuccgcugaccucucucuggagaaggccgccgaggucagcugggaagaggaagcugagcauuccggggcgucucacaauauccuuguggaaguucaggaugacggaacaaugaaaauuaaggaugaggagcgggacgauacgcugaccauccuccugaaagccacacuccuggcugugagcggcgucuauccucuuuccauccccgccacccuguuugugugguacuucuggcaaaagaagaaacagcgcucuggcguccugugggacacaccuagcccucccgaaguggagagagccguucucgaugacgggauuuaucggaucaugcagcgcggacugcuuggcagaucccaggugggggucggaguguuccaagaaaacguuuuucauaccauguggcacgugacgcggggcgcuguccugauguaccaggggaagcgccucgagcccagcugggccucugugaaaaaggaccugauuuccuacggaggcggcuggagacuccaggggagcuggaauaccggagaggaagugcagguuaucgcggucgagcccggcaaaaacccuaagaaugugcaaacagcucccgggaccuucaagacaccggaaggagaggugggcgccauugcccuggauuuuaaaccugggaccucuggaucccccaucgucaaccgggaaggcaagauugugggccuuuaugggaauggaguugugacaacgagcggcaccuacgucuccgcuaucgcccaggcgaaggcuucucaggaggggccucugcccgagaucgaagacgagguguucagaaagcgcaaccugacaauuauggaucuccaccccggaagcggcaaaacccggagauaucugccugccaucguucgcgaagccauuaagcggaaacuuagaacccugauccucgcuccgacacgcguggucgccuccgagauggcugaagcccugaaagggaugcccauucgguaccaaacgaccgcggucaagagcgagcauacaggcaaagagaucguugaccugaugugccacgccaccuuuacaaugagacuccuuucuccugugcgcguccccaauuauaacaugaucauuauggaugaagcucauuucaccgacccuuccagcaucgccgcucggggauacauuucuacgagagugggcaugggggaggccgccgcuaucuuuaugacagcgacacccccuggaagcguggaagccuucccgcaguccaaugcugucauucaggaugaggaacgggacauccccgagcgcucuuggaacagcggcuaugaguggaucaccgauuuuccugggaagacaguuugguucgugcccuccauuaaagccggaaaugacaucgccaacugucugagaaagaauggcaagcgggugauucagcugucucgcaaaaccuuugauacagaauaccaaaagaccaaaaacaacgacugggacuacgucgugacgacagauaucagcgagaugggggcuaauuucagagccgaccggguuauugauccuagacgcugccucaagcccgugauccugaaagacggcccggaacgggucauucuugcgggaccuaugcccgugaccguugcuuccgccgcccagagacgcggccggaucgggagaaaccacaauaaggagggagaucaguauaucuacaugggccagccccugaacaaugacgaggaucaugcucacuggacagaagccaagaugcuccuggacaacauuaauaccccugaggggaucauucccgcgcuguucgaaccugagcgcgaaaagagcgccgcuaucgauggagaguaucggcucagaggcgaggcccgcaagacguuuguggaacuuaugagaagaggggaccugccggucuggcugucuuacaaaguggcuuccgagggcuuccaauauagcgaucgcagauggugcuuugacggagaacggaacaaucagguccucgaggaaaacauggauguggagauuuggaccaaggagggcgaacgcaaaaagcugagaccccgguggcuugacgccagaacauacuccgacccucuggcucuccgcgaguucaaagaauuugccgcggggcggagaucuguuagcggagaucugauccuggagaucggcaagcucccccagcaccuuacccagcgcgcccaaaaugcucuggacaaccuggugaugcuccauaauuccgaacaagggggacgggccuauagacacgcuauggaggagcugccugauacaauugaaacccuuaugcugcucgcccugaucgccgugcugacaggcggcgucacccucuucuuucuuucugggaagggacugggcaaaacgagcauugggcugcucuguguuauggcuuccagcgugcugcuuuggauggcgucuguggagccccauuggaucgccgcuuccauuauccuggaguucuuucucaugguccugcugaucccggagccugaccggcagcgcacaccccaggauaaccaacucgccuacgugguuauuggacuucuguucaugauccugaccguggccgcuaaugagaugggccuccuggaaaccacaaagaaagaccuugggauuggacacgucgccguggagaaccaccaucacgcggccaugcuggaugucgaccuccauccugcuagcgccuggacccuguacgcuguggccacaacgaucauuacccccaugaugagacacacaaucgaaaacaccacagcgaauauuucucugaccgccaucgcuaaccaggccgcuauccucaugggccuugauaagggcuggccuauuuccaaaauggacaucgggguuccccugcuggcccucggaugcuauagccaggugaauccgcugacgcuuaccgcugccguccugaugcucguggcgcauuacgccauuaucggcccugggcugcaagcuaaggccacacgggaggcucagaagcgcaccgccgccggaauuaugaaaaaccccacaaucgauggcaucguugcgauugaccuggaucccguggucuaugacgcuaaguuugaaaaacagcucgggcagaucaugcuucugauucuguguaccucucaaauccuccugaugagaacgacaugggcccuuugcgagagcauuacccuggcuacaggaccucucaccacccugugggagggcuccccgggcaaguucuggaauacaacgaucgccgugucuauggccaacaucuuucgggggagcuaccuggcuggagccggccucgcguucucccuuaugaaaagccucgggggaggccgcagagggaccggagcccagggcgaaacacugggcgagaaguggaagcggcagcucaaucagcuguccaaaucugaguucaacaccuauaagcgcagcgggauuauggagguggacagauccgaagcuaaagagggacuuaagcggggcgagacaaccaaacacgccguuucuagagggacggcuaagcugcgcugguuugucgaacggaaucucgugaagcccgagggaaaagugaucgaucugggcugugggagaggaggcuggagcuacuauugcgccggccugaagaaagucacagaaguuaagggguacaccaaaggaggcccugggcacgaggaacccauuccuauggcgaccuacggauggaaccucgugaaacuucauuccggcaaagacguguucuuuauucccccugagaagugugauacacugcugugcgacaucggggagucuagcccgaaucccaccaucgaagagggacgcacacuccggguccugaagaugguggaaccuuggcuuagaggcaaccaauucuguauuaaaauccugaaucccuauaugccuuccguuguggagacgcucgagcagaugcagcgcaagcacggcgggaugcugguccggaacccccugagcagaaauucuacccaugaaauguacuggguguccugcggaacaggcaacaucguuagcgccgugaauaugaccucucgcaugcuccugaaccgguuuacaauggcucacagaaaaccgaccuaugagcgcgaugucgaccuuggggccggaacgcggcacguggcuguggaaccugaggucgccaaccuggauauuaucggccagagaauugaauccaucaagcaugagcacaaaagcaccuggcauuacgacgaggauaaucccuauaagacaugggcuuaccacgggucuuaugaaguuaagcccuccggaagcgccuccagcauggugaacggcguggucaaacuccugaccaagccuugggacgugauucccaugguuacacaaaucgcgaugaccgauacaaccccuuucggccagcagcgcguguuuaaagagaaggucgacacgagaacaccgaaagccaagcgggggaccgcucaaaucauggaagugaccgccaaguggcuuuggggauuccugucucgcaauaaaaagcccagaauuuguacacgggaggaauuuacgagaaaaguucggagcaacgcugccaucggcgccguguucgucgacgagaaucaguggaacuccgcgaaggaggcuguggaagaugaccgcuuuugggaucucguucauagagagcgggaacugcacaaacaggggaagugcgcgaccugcguguacaauaugaugggaaagcgcgagaaaaagcugggcgaguucgggaaagccaagggcucuagagcuauuugguacauguggcucggagcccgguuucuggaguucgaggcucuuggcuucaugaacgaagaccacugguuuagccgcgaaaauucccugucuggggucgaaggagagggccuccauaaacugggguauauccuuagagauauuagcaagaucccuggaggcaacauguacgccgacgauacagcggggugggacacccggaucacagaggaugaccugcagaaugaagccaaaauuaccgauaucauggagcccgaacacgcucuccuggccaaguccauuuucaagcugacauaucaaaacaaagugguccgcgugcagagaccugcuaagaauggcaccguuauggacgugaucucucggcgcgaucagagaggaagcggccaggucgggacguacggacucaacaccuuuacaaauauggaggcccaacugauucggcagauggaauccgagggcaucuucagccccaacgagcuugaaaccccgaaccuggcggagcgcgugcucgacuggcuggaaaaauaugggguggagagacuuaagcggauggccaucucuggagacgauuguguugugaaaccuauugacgauagauuugcuacagcccugaccgcucucaaugacaugggcaagguccgcaaggauaucccccagugggaaccuuccaaaggguggaacgacuggcagcaagugcccuucugcagccaucacuuucaccagcugauuaugaaggauggccgggagaucguugugccuuguagaaaucaggacgagcuggucggacgcgcccgggugucucagggcgcuggguggucccucagagaaacggccugccugggaaaaagcuacgcgcaaauguggcagcuuauguauuuccaucgccgggaucugagacucgccgcuaacgccauuuguuccgccguccccguggacuggguuccgacaucucgcaccacauggagcauccacgcucaucaccaguggaugaccacggaggauaugcuguccguguggaaucgggucuggauugaagagaacccuuggauggaagacaagaccagaaucagcucuugggaggacgugcccuaccuuggcaaacgcgaggaucaauggugcgggucccugaucggacucacagcccgggcgaccugggcuacaaauauucagguugccaucaaccaggugagacggcugauuggcaaugaaaacuacagcgacuauaugaccucuaugaagagauuuaagaaugagagcgaacccgagggggcccugugguga

SEQ ID NO: 18733 - RNA, 9879 nt, Artificial Sequence
  derived and/or modified CDS sequence (opt5) from DENV-1__FJ687429__SS-prME
agcgugaccaugcugcucaugcugaugcccacggcccuugcuuuccaccugacgaccagaggaggggaaccucauaugauugucuccaagcaggaacggggaaaaucucuccuguuuaagaccagcgccggcguuaacaugugcacccuuauugccauggaccugggggaacucugugaagauacaaugaccuacaaaugcccgagaaucacagaggcugaacccgacgauguggacuguuggugcaaugccaccgauacgugggugaccuauggaacauguucccagaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggaucgacgugguccucgagcacgggucuuguauuacgaccauggcuaaggauaaacccacacuggacaucgaacugcucaagaccgaggugacaaacccugccgugcugcgcaaacuuugcauugaagcgaagaucuccaauaccacgacagauagcagauguccgacccaaggagaggccacccuggucgaagaacaggacgcuaacuucguuugccggcgcacauuuguggauagaggcuggggcaauggguguggacucuucggcaaagggucucugcuuaccugcgccaaguuuaagugcgugacaaaacuggagggaaagaucguccaguacgaaaaccucaaauauuccgugauuguuacggugcacaccggcgaccagcaucaagucgggaaugagagcacagaacacggaaccacagcuaccaucacgccccaggccccuaccacagagauucagcugaccgacuacggcgcccugacacucgauuguucuccccggaccggccuggacuucaacgaaauggugcuucugacgaugaaggagaaauccuggcucguucauaagcagugguuucuggaucuuccucugcccuggacaagcggggcuuccaccucucaagagacauggaaucgccaggaccuccuggugaccuucaaaaccgcgcacgccaagaagcaggaagucgugguccugggaagccaagagggcgcuaugcacacagcccucacgggggccaccgaaauccagacauccggaaccacaaccauuuuugcuggccaucugaaaugcagacuuaagauggauaaacugacgcucaaggggaugagcuaugugauguguacaggcucuuucaaacuggagaaggaaguugccgagacccagcacggaaccgugcugguccagaucaaguacgagggcacagacgcgccgugcaaaaucccuuucuccacccaagaugaaaagggggugacacagaacggacggcuuauuacggcuaaucccaucguuaccgacaaagagaagccugugaacauugaagccgagccgcccuuuggcgagagcuauaucgucauuggggccggagaaaaagcucucaagcugucuugguucaagaaaggcagcuccaucgggaagauguuugaggccacagcuagaggcgcccgccggauggcgauccugggagauaccgccugggacuucggcucuauugggggaguguuuacaagcgugggcaaacucguucaucagaucuucgggaccgcuuacggaguccuguuuuccggcgugagcuggacgaugaagauugggaucggcgugcuucugaccuggcucggacucaauucuagauccacaagccugucuaugaccuguauugccgucggccuugugacacucuaccuggggguuauggugcaggcugauuccggaugcgucaucaacuggaaaggccgcgaacugaagugugggagcggaauuuucgugaccaaugagguucacacauggaccgaacaauauaaguuucaggccgacuccccuaaacggcucucugcggccaucggcaaggcuugggaggagggggugugcggcaucagaagcgccacgcgccuggaaaacauuauguggaaacagaucuccaacgagcuuaaucauauucugcucgaaaacgacaugaaguucacagucgugguuggagauguggcuggcauccuggcccaggggaaaaagaugauucggccgcaacccauggaguacaaauauucuuggaaaagcuggggaaaggccaagaucaucggcgcugacguccaaaauuccaccuuuauuaucgaugggccuaacacccccgaauguccugacgaucagagagcguggaauauuugggagguggaggacuacggauucggcaucuuuacaaccaacauuuggcugaaacuucgcgauagcuauacacaggugugcgaccaccggcucaugucugccgcuaucaaagauuccaaggccguccacgccgacaugggcuacuggaucgaaagcgagaaaaaugaaacauggaagcuggcuagagccucuuucauugagguuaagaccuguaucuggcccaaaucccauacacuguggagcaacggggugcucgaaucugagaugauuaucccgaagauuuauggaggcccuaucagccaacacaauuaccgccccggguacuucacccagacagcgggaccuuggcaucugggcaaacuugagcuggauuuugaccucugcgaagggaccacgguggucguggaugagcacugcggaaaccggggccccucccugagaaccacaaccguuacaggcaagaucauucacgaaugguguugccggagcuguacccugccuccccuucgcuucagaggggaggacggaugcugguauggcauggagauccggccggugaaagaaaaggaggaaaaucucgucaagucuaugguguccgcugggagcggagagguugacuccuuuucucugggccugcucuguauuagcaucaugauugaagaggugaugagaucccgcuggucucggaaaaugcugaugacggggacacuugccgucuucuuucugcucaucaugggacagcugaccuggaacgaucugauuagacuuugcaucauggugggcgccaaugcuagcgaccgcaugggcauggggacaaccuaccuggcccucauggcgaccuucaagaugagaccuauguuugcuguuggacugcuguuccggcgccugacauccagagaggugcuucugcucacgaucggccugucucuggucgccagcguggaacuucccaacucccuggaggaacucggggauggacuggccaugggcauuaugauccucaaacugcuuaccgacuuucaaagccaucagcugugggcuacacuccugucucugaccuucauuaagacaaccuuuucccuucacuaugccuggaaaacgauggcuauggugcugagcaucgucucucucuucccccugugucucuccacaaccagccagaagaccacauggcugccuguucuucuggggucucugggaugcaagccgcucaccauguuucugauugccgagaauaaaaucuggggccggaaguccuggccccuuaacgaaggcaucauggcgguggggauugugagcauccugcucuccagccugcucaaaaacgaugucccucuggccggaccccuuauugcuggcgggaugcugaucgccuguuacgugauuucuggaagcuccgcugaccugucucucgagaaggccgccgagguuagcugggaagaggaagcugagcauuccggcgcgucucacaauauccugguggaaguccaggaugacgggacaaugaaaaucaaggaugaggagcgcgacgauacgcuuaccauucugcucaaagccacacugcucgcugugagcggaguuuauccucuguccauccccgccacccuuuucgugugguacuucuggcaaaagaagaaacagagaucuggcguccugugggacacaccuagcccucccgaaguggagcgggccguccuggaugacggcauuuaucgcaucaugcagagagggcuccugggacggucccaggugggcguugggguguuucaagaaaacgucuuccauaccauguggcacgugacgcgcggagcuguucuuauguaccagggcaagagacuggagcccagcugggccucugugaaaaaggaccucauuuccuacgggggaggcuggcggcugcagggcagcuggaauaccggggaggaaguccaggugaucgcgguggagcccggcaagaacccuaagaauguucaaacagcucccggcaccuuuaagacaccggaaggggaggucggagccauugcccucgauuucaaaccuggcaccucugggucccccaucgugaacagagaaggaaagaucgugggccuguauggcaauggggucgugacaacgagcggaaccuacguuuccgcuauugcccaggcgaaggcuucucaggagggcccucuucccgagaucgaagacgagguguuucgcaagcggaaccugacaauuauggaucugcaccccgggagcggaaaaaccagacgcuaucucccugccaucguccgggaagccauuaagagaaagcugcgcacccuuauccuggcuccgacacgggugguugccuccgagauggcugaagcccucaaaggcaugcccaucagauaccaaacgaccgcggugaaaagcgagcauacagggaaagagauugucgaccugaugugccacgccaccuucacaaugcgccugcucucuccugugcggguucccaauuauaacaugaucauuauggaugaagcucauuuuaccgacccuuccagcaucgccgcuagaggcuacauuucuacgcgggugggaaugggcgaggccgccgcuaucuucaugacagcgacacccccugggagcgucgaagccuuuccgcaguccaaugcugugauccaggaugaggaacgcgacauucccgagagaucuuggaacagcggauaugaguggaucaccgauuucccuggcaagacagugugguuuguccccuccauuaaagccgggaaugacaucgccaacugucuucggaagaauggaaagcgcguuauucagcugucuagaaaaaccuucgauacagaauaccaaaagaccaaaaacaacgacugggacuacguggugacgacagauaucagcgagaugggcgcuaauuuccgggccgacagagucauugauccucgccggugccugaagcccgugauccucaaagacgggccggaaagaguuauccuggcgggcccuaugcccgugaccgucgcuuccgccgcccagcgccggggaagaauuggccgcaaccacaauaaggagggggaucaguauaucuacaugggacagccccuuaacaaugacgaggaucaugcucacuggacagaagccaagaugcugcucgacaacauuaauaccccugagggcaucauucccgcgcuguuugaaccugagcgggaaaagagcgccgcuaucgauggggaguauagacugcgcggagaggccagaaagacguucguggagcucaugcggcgcggcgaccuuccgguuuggcugucuuacaaaguggcuuccgagggguuucaauauagcgauagacgguggugcuucgacggcgaacgcaacaaucagguccuggaggaaaacauggauguggagaucuggaccaaggagggagaacgcaaaaagcuccggcccagauggcuggacgcccgcacauacuccgacccucuugcucugcgggaguuuaaagaguucgccgcgggcagacgcucugucagcggggaucucauucuggagaucggaaagcugccccagcaccucacccagcgggcccaaaaugcucuugacaaccuggugaugcugcauaauuccgaacagggcgggagagccuaucggcacgcuauggaggagcucccugauacaauugaaacccugaugcuucuggcccucaucgccguucugacaggaggcgugacccuguuuuuccucucuggcaaggggcuuggaaaaacgagcauuggccugcugugugugauggcuuccagcguccuccuguggauggcgucuguugagccccauuggaucgccgcuuccaucauucuugaauuuuuccugauggugcuccugaucccggagccugaccgccagagaacaccccaggauaaccaacuggccuacguggucauugggcuccuuuuuaugauccugaccguggccgcuaaugagaugggacugcucgaaaccacaaagaaagaccugggcauugggcacguugccguggagaaccaccaucacgcggccaugcuugaugucgaccugcauccugcuagcgccuggacccucuacgcuguggccacaacgaucauuacccccaugaugcggcacacaaucgaaaacaccacagcgaauaucucucugaccgccauugcuaaccaggccgcuauccugaugggacucgauaagggcuggccuauuuccaaaauggacaucggcgucccccuucuggcccuggggugcuauagccaggugaauccgcucacgcugaccgcugccguucuuaugcugguggcgcauuacgccauuaucggaccuggccuccaagcuaaggccacacgcgaggcucagaagagaaccgccgccgggaucaugaaaaaccccacaauugauggaaucgucgcgauugaccuggaucccgugguuuaugacgcuaaguucgaaaaacagcugggccagaucaugcuccuuauucuguguaccucucaaauccugcucaugcggacgacaugggcccugugcgagagcaucacccuugcuacagggccucugaccacccucugggagggauccccgggcaaguuuuggaauacaacgauugccgugucuauggccaacaucuuccgcggcagcuaccuggcuggggccggacuggcguucucccucaugaaaagccuuggcgggggaagacggggcaccggggcccagggagaaacacugggcgagaaguggaagcgccagcugaaucagcucuccaaaucugaauuuaacaccuauaagagaagcggcauuauggaggucgaccgguccgaagcuaaagaggggcugaagagaggagagacaaccaaacacgccgugucucgcggcacggcuaaacuucggugguucguggaaagaaaucugguuaagcccgaggggaaagucaucgaucucggauguggccgcgggggauggagcuacuauugcgccggccugaagaaagugacagaagugaagggcuacaccaaagggggaccuggccacgaggaacccauuccuauggcgaccuacggguggaaccuggucaagcuccauuccggaaaagacguguuuuucauucccccugagaagugugauacacuucugugcgacaucggcgagucuagcccgaaucccaccaucgaagaggggcggacacugagaguucucaagaugguggaaccuuggcugcgcggaaaccaauuuuguaucaaaauucuuaaucccuauaugccuuccgucguggagacgcuggagcagaugcagcggaagcacggcggcaugcucguuagaaacccccugagccgcaauucuacccaugaaauguacuggguguccugcgggacaggaaacaucgucagcgccgugaauaugaccucucggaugcugcucaacagauucacaauggcucaccgcaaaccgaccuaugagcgggauguugaccugggcgccgggacgagacacguggcugucgaaccugagguggccaaccuugauauuaucggacagcgcauugaaaauaucaagcaugagcacaaauccaccuggcauuacgacgaggauaaccccuauaagacaugggcuuaccacggcagcuaugaagugaagcccucuggguccgccagcuccauggucaauggaguugugaaacugcucaccaagccuugggacgugauccccauggucacacaaauugcgaugaccgauacaaccccuuuuggccagcagagaguguucaaagagaagguugacacgcggacaccgaaagccaagcgcggcaccgcucaaaucauggaagugaccgccagauggcuguggggguuucuuagccggaacaagaaacccagaauuuguacacgggaggaguucacgcgcaaggucagaucuaaugcugccaucggagccguguuuguugacgagaaccaguggaauagcgcgaaagaggcuguggaagaugaccgguucugggaucugguccaucgcgagagagaacuccacaagcagggcaaaugcgcgaccugcguguacaacaugauggggaagcgggagaagaaacugggagaauuuggcaaggccaaagggucccgcgcuauuugguacauguggcugggcgccagauuccucgaguucgaggcucugggauuuaugaaugaagaccacugguucucucgggagaacagccuuuccggcguugaaggggagggacugcauaagcucggcuauauccugcgcgauaucucuaaaauuccugggggaaauauguacgccgacgauacagcgggcugggacaccagaaucacagaggaugaccuucagaacgaagccaagauuaccgauaucauggagcccgaacacgcucugcucgccaaaagcauuuuuaagcugacauaucaaaauaaggugguccgggugcagcgcccugcuaaaaacgggaccgucauggacgugaucuccagacgggaucagcgcggcucuggacagguuggcacguacgggcugaauaccuucacaaacauggaggcccaacucaucagacagauggaaagcgagggaaucuuuucccccaacgagcuggaaaccccgaaucuugcggagcgggugcuggacuggcucgaaaaguauggcgucgagagacugaaacgcauggccaucagcggggacgauuguguggugaagccuauugacgaucgguucgcuacagcccuuaccgcucugaacgacaugggaaaaguuagaaaggauaucccccagugggaaccuucuaagggcuggaaugacuggcagcaagugcccuuuugcucccaucacuuccaccagcucauuaugaaagaugggcgcgagaucgucgugccuugucggaaccaggacgagcugguuggcagagcccgcgugagccagggagcuggcuggucucugcgggaaacggccugccucgggaaguccuacgcgcaaauguggcagcugauguauuuucauagacgcgaucuucggcuggccgcuaaugccauuuguagcgccguccccguggacugggucccgacauccagaaccacauggucuauccacgcucaucaccaguggaugaccacggaggauaugcucagcguguggaaccgcguuuggaucgaagagaauccuuggauggaagacaaaacccggauuuccagcugggaggacgugcccuaccugggaaagagagaggaucaauggugcggcucucuuaucgggcugacagcccgggcgaccugggcuacaaacauucaggucgccaucaaucaggugagacgccucauuggaaacgaaaauuacuccgacuauaugaccagcaugaaacgguucaagaacgagucugaacccgagggcgcccugugguga

SEQ ID NO: 18734 - RNA, 9879 nt, Artificial Sequence
  derived and/or modified CDS sequence (opt5) from DENV-1__FJ850068__SS-prME
agcgugaccaugcugcucaugcugaugcccacagcccuugcuuuccaccugacgacccggggcggggaaccucauaugaucguguccaagcaggaacggggaaaaucucuccuguuuaagaccagcgccggcguuaacaugugcacccuuauugccauggaccugggggaacucugugaagauacaaugaccuacaaaugcccgcgcaucacagaggcugaacccgacgauguggacuguuggugcaaugccaccgauacgugggugaccuauggaacauguucccagaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccagggagaggccacccugguggaagaacaggacgcuaacuucgugugccggcgcacauuugucgauagaggcuggggcaauggguguggacucuucggcaaagggucucugcuuaccugcgccaaguuuaagugcgugacaaaacuggagggaaagauuguucaguacgaaaaccucaaauauuccgugaucgucacggugcacaccggcgaccagcaucaaguugggaaugagagcacagaacacggaaccacagcuaccaucacgccccaggccccuaccacagagauucagcugaccgacuacggcgcccugacacucgauuguucuccccggaccggccuggacuucaacgaaauggugcuucugacgaugaaggagaaauccuggcucguccauaagcagugguuucuggaucuuccucugcccuggacaagcggggcuuccaccucucaagagacauggaaucgccaggaccuccuggugaccuucaaaaccgcgcacgccaagaagcaggaagucgugguucugggaagccaagagggcgcuaugcacacagcccucacgggggccaccgaaauccagacauccggaaccacaaccauuuuugcuggccaucugaaaugcagacuuaagauggauaaacugacgcucaaggggaugagcuaugugauguguacaggcucuuucaaacuggagaaggaagucgccgagacccagcacggaaccgugcugguucagaucaaguacgagggcacagacgcgccgugcaaaauuccuuucuccacccaagaugaaaagggggugacacagaacggacggcuuaucacggcuaaucccaucgucaccgacaaagagaagccugugaacauugaagccgagccgcccuuuggcgagagcuauaucgugauuggggccggagaaaaagcucucaagcugucuugguucaagaaaggcagcuccaucgggaagauguuugaggccacagcuagaggcgcccgccggauggcgauucugggagauaccgccugggacuucggcucuaucgggggaguuuuuacaagcgucggcaaacucgugcaucagaucuucgggaccgcuuacggagugcuguuuuccggcgucagcuggacgaugaagauugggaucggcgugcuucugaccuggcucggacucaauucuagauccacaagccugucuaugaccuguauugccguuggccuugugacacucuaccugggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcucucugcggccaucggcaaggcuugggaggagggggugugcggcauuagaagcgccacgcgccuggaaaacaucauguggaaacagaucuccaacgagcuuaaucauauucugcucgaaaacgacaugaaguucacaguuguggucggagauguggcuggcauccuggcccaggggaaaaagaugauucggccgcaacccauggaguacaaauauucuuggaaaagcuggggaaaggccaagaucauuggcgcugacgugcaaaauuccaccuuuaucaucgaugggccuaacacccccgaauguccugacgaucagagagcguggaauauuugggaggucgaggacuacggauucggcaucuuuacaaccaacauuuggcugaaacuucgcgauagcuauacgcagguuugcgaccaccggcucaugucugccgcuaucaaagauuccaaggccgugcacgccgacaugggcuacuggauugaaagcgagaaaaaugaaacauggaagcuggcuggggccucuuucaucgaggugaagaccuguaucuggcccaaaucccauacacuguggagcaacggaguccucgaaucugagaugauuaucccgaagauuuauggcgggccuaucagccaacacaauuacagacccggauacuucacccagacagcgggcccuuggcaucuggggaaacuugagcuggauuuugaccucugcgaaggaaccacggugguuguggaugagcacugcggcaaccgcggccccucccugcggaccacaaccgucacagggaagauuauccacgaaugguguugcagaagcuguacccugccuccccuucgguuccgcggagaggacggcugcugguaugggauggagaucagaccggugaaagaaaaggaggaaaaucucguuaagucuaugguguccgcuggaagcggcgaggucgacuccuuuucucuggggcugcucuguauuagcaucaugauugaagaggugaugcgguccagauggucucgcaaaaugcugaugacgggaacacuugccguuuucuuucugcucaucaugggccagcugaccuggaacgaucugauucggcuuugcaucauggugggcgccaaugcuagcgacagaauggggaugggaacaaccuaccuggcccucauggcgaccuucaagaugcgcccuauguuugcugucggccugcuguucagacggcugacaucccgcgaggugcuucugcucacgauugggcugucucugguggccagcgucgaacuucccaacucccuggaggaacucggagauggccuggccauggggaucaugauccucaaacugcuuaccgacuuucaaagccaucagcugugggcuacacuccugucucugaccuucauuaagacaaccuuuucccuucacuaugccuggaaaacgauggcuaugguucugagcaucgugucucucuucccccugugucucuccacaaccagccagaagaccacauggcugccugugcuucugggaucucugggcugcaagccgcucaccauguuucugauugccgagaauaaaaucuggggcagaaaguccuggccccuuaacgaagggauuauggcggucggaaucgugagcauccugcucuccagccugcucaaaaacgauguuccucuggccggcccccuuauugcugggggaaugcugaucgccuguuacgugauuucuggcagcuccgcugaccugucucucgagaaggccgccgaggucagcugggaagaggaagcugagcauuccggggcgucucacaauauccugguggaaguucaggaugacggaacaaugaaaauuaaggaugaggagcgggacgauacgcuuaccauccugcucaaagccacacugcucgcugugagcggcgucuauccucuguccauccccgccacccuuuucgugugguacuucuggcaaaagaagaaacagcgcucuggcguccugugggacacaccuagcccucccgaaguggagagagccguucuggaugacgggauuuaucggaucaugcagcgcggacuccugggcagaucccaggugggggucggaguguuucaagaaaacguuuuccauaccauguggcacgugacgcggggcgcuguccuuauguaccaggggaagcgccuggagcccagcugggccucugugaaaaaggaccucauuuccuacggaggcggcuggagacugcaggggagcuggaauaccggagaggaagugcagguuaucgcggucgagcccggcaaaaacccuaagaaugugcaaacagcucccgggaccuuuaagacaccggaaggagaggugggcgccauugcccucgauuucaaaccugggaccucuggaucccccaucgucaaccgggaaggcaagauugugggccuguaugggaauggaguugugacaacgagcggcaccuacgucuccgcuaucgcccaggcgaaggcuucucaggaggggccucuucccgagaucgaagacgagguguuuagaaagcgcaaccugacaauuauggaucugcaccccggaagcggcaaaacccggagauaucucccugccaucguucgcgaagccauuaagcggaagcugagaacccuuauccuggcuccgacacgcguggucgccuccgagauggcugaagcccucaaagggaugcccauucgguaccaaacgaccgcggucaagagcgagcauacaggcaaagagaucguugaccugaugugccacgccaccuucacaaugagacugcucucuccugugcgcguccccaauuauaacaugaucauuauggaugaagcucauuuuaccgacccuuccagcaucgccgcucggggauacauuucuacgagagugggcaugggggaggccgccgcuaucuucaugacagcgacacccccuggaagcguggaagccuuuccgcaguccaaugcugucauucaggaugaggaacgggacauccccgagcgcucuuggaacagcggcuaugaguggaucaccgauuucccugggaagacaguuugguuugugcccuccauuaaagccggaaaugacaucgccaacugucuuagaaagaauggcaagcgggugauucagcugucucgcaaaaccuucgauacagaauaccaaaagaccaaaaacaacgacugggacuacgucgugacgacagauaucagcgagaugggggcuaauuucagagccgaccggguuauugauccuagacgcugccugaagcccgugauccucaaagacggcccggaacgggucauucuggcgggaccuaugcccgugaccguugcuuccgccgcccagagacgcggccggaucgggagaaaccacaauaaggagggagaucaguauaucuacaugggccagccccuuaacaaugacgaggaucaugcucacuggacagaagccaagaugcugcucgacaacauuaauaccccugaggggaucauucccgcgcuguuugaaccugagcgcgaaaagagcgccgcuaucgauggagaguaucggcugagaggcgaggcccgcaagacguucguggagcucaugagaagaggggaccuuccggucuggcugucuuacaaaguggcuuccgagggcuuucaauauagcgaucgcagauggugcuucgacggagaacggaacaaucagguccuggaggaaaacauggauguggagauuuggaccaaggagggcgaacgcaaaaagcucagaccccgguggcuggacgccagaacauacuccgacccucuugcucugcgcgaguuuaaagaguucgccgcggggcggagaucuguuagcggagaucucauccuggagaucggcaagcugccccagcaccucacccagcgcgcccaaaaugcucuugacaaccuggugaugcugcauaauuccgaacaagggggacgggccuauagacacgcuauggaggagcucccugauacaauugaaacccugaugcuucuggcccucaucgccgugcugacaggcggcgucacccuguuuuuccucucugggaagggacuuggcaaaacgagcauugggcugcuguguguuauggcuuccagcgugcuccuguggauggcgucuguggagccccauuggaucgccgcuuccauuauccuugaauuuuuccugaugguccuccugaucccggagccugaccggcagcgcacaccccaggauaaccaacuggccuacgugguuauuggacuccuuuuuaugauccugaccguggccgcuaaugagaugggccugcucgaaaccacaaagaaagaccuggggauuggacacgucgccguggagaaccaccaucacgcggccaugcuugaugucgaccugcauccugcuagcgccuggacccucuacgcuguggccacaacgaucauuacccccaugaugagacacacaaucgaaaacaccacagcgaauauuucucugaccgccaucgcuaaccaggccgcuauccugaugggccucgauaagggcuggccuauuuccaaaauggacaucgggguuccccuucuggcccugggaugcuauagccaggugaauccgcucacgcugaccgcugccguccuuaugcugguggcgcauuacgccauuaucggcccugggcuccaagcuaaggccacacgggaggcucagaagcgcaccgccgccggaauuaugaaaaaccccacaaucgauggcaucguugcgauugaccuggaucccguggucuaugacgcuaaguucgaaaaacagcuggggcagaucaugcuccuuauucuguguaccucucaaauccugcucaugagaacgacaugggcccugugcgagagcauuacccuugcuacaggaccucugaccacccucugggagggcuccccgggcaaguuuuggaauacaacgaucgccgugucuauggccaacaucuuccgggggagcuaccuggcuggagccggccuggcguucucccucaugaaaagccuugggggaggccgcagagggaccggagcccagggcgaaacacugggcgagaaguggaagcggcagcugaaucagcucuccaaaucugaauuuaacaccuauaagcgcagcgggauuauggagguggacagauccgaagcuaaagagggacugaagcggggcgagacaaccaaacacgccguuucuagagggacggcuaaacuucgcugguucgucgaacggaaucuggugaagcccgagggaaaagugaucgaucucggcugugggagaggaggcuggagcuacuauugcgccggccugaagaaagucacagaaguuaagggguacaccaaaggaggcccugggcacgaggaacccauuccuauggcgaccuacggauggaaccuggugaagcuccauuccggcaaagacguguuuuucauucccccugagaagugugauacacuucugugcgacaucggggagucuagcccgaaucccaccaucgaagagggacgcacacugcggguccucaagaugguggaaccuuggcugagaggcaaccaauuuuguauuaaaauccuuaaucccuauaugccuuccguuguggagacgcuggagcagaugcagcgcaagcacggcgggaugcucguccggaacccccugagcagaaauucuacccaugaaauguacuggguguccugcggaacaggcaacaucguuagcgccgugaauaugaccucucgcaugcugcucaaccgguucacaauggcucacagaaaaccgaccuaugagcgcgaugucgaccugggggccggaacgcggcacguggcuguggaaccugaggucgccaaccuugauauuaucggccagagaauugaaaauaucaagcaugagcacaaauccaccuggcauuacgacgaggauaaccccuauaagacaugggcuuaccacgggagcuaugaaguuaagcccucuggauccgccagcuccauggugaauggcguggucaaacugcucaccaagccuugggacgugauucccaugguuacacaaaucgcgaugaccgauacaaccccuuuuggccagcagcgcguguucaaagagaaggucgacacgagaacaccgaaagccaagcgggggaccgcucaaaucauggaagugaccgcccgcuggcuguggggauuucuuagcagaaacaagaaaccccggauuuguacaagagaggaguucacgcggaagguucgcucuaaugcugccaucggcgccguguuugucgacgagaaccaguggaauagcgcgaaagaggcuguggaagaugacagauucugggaucugguucaucgggagcgcgaacuccacaagcaggggaaaugcgcgaccugcguguacaacaugaugggaaagagagagaagaaacugggcgaauuugggaaggccaaaggcucccgggcuauuugguacauguggcugggagcccgcuuccucgaguucgaggcucugggcuuuaugaaugaagaccacugguucucuagagagaacagccuuuccggggucgaaggagagggccugcauaagcucggguauauccugcgggauauuucuaaaaucccuggaggcaauauguacgccgacgauacagcggggugggacacccgcaucacagaggaugaccuucagaacgaagccaagauuaccgauaucauggagcccgaacacgcucugcucgccaaaagcauuuuuaagcugacauaucaaaauaagguggucagagugcagcggccugcuaaaaacggcaccguuauggacgugaucucccgcagagaucagcggggaucuggccaggucgggacguacggacugaauaccuucacaaacauggaggcccaacucauucgccagauggaaagcgagggcaucuuuucccccaacgagcuggaaaccccgaaucuugcggagagagugcuggacuggcucgaaaaguaugggguggagcggcugaaaagaauggccaucagcggagacgauuguguugugaagccuauugacgaucgcuucgcuacagcccuuaccgcucugaacgacaugggcaaaguccggaaggauaucccccagugggaaccuucuaagggguggaaugacuggcagcaagugcccuuuugcucccaucacuuccaccagcucauuaugaaagauggcagagagaucguugugccuugucgcaaccaggacgagcuggucggacgggccagagugagccagggcgcuggguggucucugcgcgaaacggccugccucggaaaguccuacgcgcaaauguggcagcugauguauuuucaucggagagaucuucgccuggccgcuaaugccauuuguagcgccguccccguggacuggguuccgacaucccggaccacauggucuauccacgcucaucaccaguggaugaccacggaggauaugcucagcguguggaacagagucuggauugaagagaauccuuggauggaagacaaaacccgcaucuccagcugggaggacgugcccuaccugggcaagcgggaggaucaauggugcgggucucuuaucggacugacagccagagcgaccugggcuacaaacauucagguugccaucaaucaggugcggagacucauuggcaacgaaaauuacuccgacuauaugaccagcaugaaacgcuucaagaacgagucugaacccgagggggcccugugguga

SEQ ID NO: 18735 - RNA, 9879 nt, Artificial Sequence
  derived and/or modified CDS sequence (opt5) from DENV-1__FJ687430__SS-prME
agcgugaccaugcugcucaugcugaugcccaccgcccuugcuuuccaccugacgaccagaggcggggaaccucauaugaucguguccaagcaggaacggggaaagucucuccuguuuaagaccagcaccggcguuaauaugugcacacuuauugccauggaccugggggaacucugugaagauaccaugacauacaaaugcccccgcaucaccgaagcggaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagaagguugaaaccugggcccugcggcaccccggcuucacagugaucgcucuuuuucuggcccaugcgauugggaccucuaucacccagaagggaaucauuuucauccuccugaugcuugucacaccuagcauggccaugcgcugcgugggcauuggguccagagauuuuguugagggacugagcggcgcuacguggguggacgucgugcucgagcacgggucuugugugaccacaauggccaaagauaagcccacccuggacaucgaacugcucaaaacagaggucaccaacccugcuguucugcggaaacuuugcauugaagccaaaaucuccaauacgacaaccgauagccgcuguccgacccaaggagaggcgacacugguggaagaacaggacgccaacuucgugugcagacggaccuuugucgaucgcggcuggggcaauggguguggacucuucggcaaggggucucugauuacaugcgcuaaguuuaaaugcgugacgaaacuugagggaaaaaucguucaguacgaaaaccugaaguauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucucccagaacgggccucgacuucaacgaaauggugcugcuuacaaugaaagagaaguccuggcugguccauaaacagugguuucucgaucugccucuucccuggaccagcggggccuccacaucucaagagaccuggaaucggcaggaccugcucgugaccuucaagacagcucacgcgaagaaacaggaagucgugguucugggaagccaagagggcgccaugcacacggcucugaccggggccacagaaauucagaccuccggaacaaccacgaucuuugccggccaucucaagugccgccugaaaauggauaaacuuacacugaaagggaugagcuaugugauguguaccggcucuuucaagcucgagaaggaagucgcugagacccagcacggaacaauucuggugcagaucaaauacgagggcaccgacgccccgugcaagaucccuuucuccacacaagaugaaaaagggguuacgcagaacggaagacugauuaccgcgaaucccaucgugacagacaaggagaaaccugucaacauugaagcugagccgcccuuuggcgagagcuauaucgugauuggggccggagaaaaggcccuuaagcucucuugguucaaaaagggcagcuccaucgggaaaauguuugaggcuaccgcccggggcgcuagacgcauggccauccugggagauacagcgugggacuucggcucuauugggggaguguuuaccagcguuggcaagcugguccaucagaucuucgggacggccuacggagugcucuuuuccggcgugagcuggaccaugaaaauugggaucggcguccugcuuacauggcugggacucaauucucgguccaccagccugucuaugacauguauugcugugggccugguuacccuuuaccucggggugaugguccaggccgauuccggaugcgugaucaacuggaagggcagagaacugaagugugggagcggaauuuucguuacaaaugaggugcacaccuggacggaacaauauaaauuucaggcugacuccccuaagcgccugucugccgcgaucggcaaagccugggaggagggggucugcggcauccggagcgcuacaagacucgaaaacauuauguggaagcagaucuccaacgagcugaaucauauucuucuggaaaacgacaugaaauucaccgugguugugggagaugucgccggcauccucgcucaggggaagaaaaugauucgcccgcaacccauggaguacaaguauucuuggaaaagcuggggaaaggccaagaucaucggcgccgacgugcagaaugcuaccuuuauuaucgaugggccuaacacacccgaauguccugacgaucagcgggcguggaauauuugggagguggaggacuacggauucggcaucuuuaccacgaacauuuggcugaaacugagagauuccuauacacaggucugcgaccaccgccuuaugagcgccgcuaucaaggauucuaaagccguucacgccgacaugggcuacuggaucgaauccgagaagaaugaaaccuggaagcucgcucgggccagcuucauugaggugaaaacauguaucuggcccaagucucauacccugugguccaacggggugcuggaaagcgagaugauuaucccgaaaauuuauggaggcccuaucucucaacacaauuacagacccggguacuucacacagaccgcgggaccuuggcaucucggcaagcuggagcuugauuuugaccugugcgaagggacgaccgucgugguugaugagcacugcggaaaccgcggccccagccuccggacaaccacagugaccggcaaaaucauucacgaaugguguugcagauccuguacgcugccuccccugcgguuccgcggggaggacggaugcugguauggcauggagaucagaccggucaaggaaaaggaggaaaaucuugugaaaagcaugguuucugcuggguccggagagguggacagcuuuucccucggccugcuguguauuucuaucaugauugaagaggucaugcggagcagauggucccgcaagaugcucaugacagggacccuggccguguucuuucuucugaucaugggacagcucacauggaacgaucugauucggcugugcaucaugguuggcgccaaugcuucugacaaaaugggcauggggaccaccuaccuugcccugauggcgacauucaagaugagaccuauguuugcugugggacuccuguuccgcagacucacgagccgggagguccugcuucugaccaucggccucucccugguggccucuguggaacugcccaacagccuugaggaacugggggauggacucgccaugggcauuaugauccugaaacuccugacagacuuucaaucccaucagcuuugggcuacccugcucagccugacauucauuaagaccacguuuucucugcacuaugccuggaagacaauggcuaugguccuuuccaucguuagccuguucccccucugucugucuaccaccucccagaaaacaaccuggcucccugugcugcuugggagccugggaugcaagccgcugacaauguuucucauugccgagaauaaaaucuggggccgcaagucuuggccccugaacgaaggcaucauggcgguggggauugucuccauccuucugagcucccuccugaaaaacgaugugccucucgccggaccccugauugcuggcgggaugcuuaucgccuguuacguuauuagcggaucuagcgcugaccugucccuggagaaggccgccgaggugucuugggaagaggaagcugagcauagcggcgcgucccacaauauccucgucgaagugcaggaugacgggacgaugaaaaucaaggaugaggagagagacgauacccugacaauucuucugaaggccacccuccuggcuguuucuggaguguauccucucagcauccccgccacacuguucgucugguacuucuggcagaagaagaaacagcgguccggcgugcuuugggacaccccuucucccccggaagucgagcgcgccgugcuggaugacggcauuuauagaaucaugcagcgggggcugcucggacgcagccagguuggcgugggggucuuucaagaaaacguguuccauacgauguggcacguuaccagaggagcugugcugauguaccagggcaagcggcuugagccuuccugggccagcgucaaaaaggaccugauuucuuacgggggaggcuggcgccuccagggcuccuggaauacaggggaggaaguccaggugaucgcgguugagcccggaaagaacccuaaaaauguccaaaccgcucccggcacauuuaagaccccggaaggggaggugggagccauugcccuggauuucaaaccuggcacaagcgggucucccaucgugaacagagaaggaaagaucgucggccucuauggcaauggggugguuacgaccuccggaacauacgugagcgcuauugcccaggcgaaggcuucccaggagggcccucugcccgagaucgaagacgaggucuuucggaagagaaaccuuaccauuauggaucugcaccccgggucuggaaagacccgccgguaucugccugccaucgugagagaagccauuaaacgcaagcuccggacacugauccuugcuccgacgagaguuguggccagcgagauggcugaagcccugaaaggcaugcccauccgcuaccaaaccacagcggucaaguccgagcauaccgggaaagagauuguggaccucaugugccacgccacauucaccaugcggcugcugagcccuguuagagugcccaauuauaacaugaucauuauggaugaagcucauuuuacggacccuucuuccaucgccgcucgcggcuacauuagcacacgggucggaaugggcgaggccgccgcuaucuucaugaccgcgacacccccugggucuguggaagccuuuccgcagagcaaugcugugauccaggaugaggaaagagacauucccgagcgguccuggaacucuggauaugaguggaucacagauuucccuggcaagaccgucugguuuguucccagcauuaaguccgggaaugacaucgccaacugucuccgcaaaaauggaaagagagugauucagcuuucucggaaaacauucgauaccgaauaccaaaagacgaaaaacaacgacugggacuacguggucacaaccgauaucagcgagaugggcgccaauuuccgcgcugacagagugauugauccucggagaugccugaagcccguuauccugaaggacgggccggaacgcgugauccucgccggcccuaugcccgucacaguggcguccgcugcccagcggagaggacgcauuggccggaaccacaauaaagagggggaucaguauaucuacaugggacagccccugaacaaugacgaggaucaugcccacuggaccgaagcuaagaugcuucuggacaacauuaauacgccugagggcaucauucccgcccucuuugaaccugagagagaaaagagcgcggccaucgauggggaguaucgccugcggggagaggcuagaaagaccuucguugagcugaugcgcagaggcgaccucccgguguggcuuucuuacaaagucgccuccgagggguuucaauauagcgaucggcgcuggugcuucgacggcgaaagaaacaaucaggugcuggaggaaaacauggaugucgagaucuggacaaaggagggagaacggaaaaagcugcgccccagauggcucgacgcucggaccuacuccgacccucuggcccuuagagaguuuaaggaguucgcugccggccgccggucugugagcggggaucugauucucgagaucggaaaacugccccagcaccugacacagagagcgcaaaaugcccucgacaaccuuguuaugcugcauaauuccgaacagggcgggcgcgcuuaucggcacgcccuggaggagcucccugauaccauugaaacacugaugcuucuggcucucaucgccgugcugaccggaggcgugacgcuguuuuuccucucuggcagagggcuuggaaagacaagcauuggccugcugugugucauggccuccagcguucuccuguggauggcuucuguggagccccauuggaucgcggccuccaucauucuugaauuuuuccugauggugcuccugaucccggagccugaccggcagcgcacaccccaggauaaccaacuggcuuacgucgugauugggcuccuuuuuaugauccugaccguugccgccaaugagaugggacugcucgaaacaaccaaaaaggaccugggcauugggcacguggcugucgagaaccaccaucacgccagcaugcuugauguggaccugcauccugcgucugccuggacacucuacgcugucgccacgaccaucauuacacccaugaugagacacaccaucgaaaacacaaccgcuaauaucucccugacggccauugcgaaccaggccgcuauccugaugggacucgauaaaggcuggccuauuagcaagauggacaucggcgugccccuucuggcccuggggugcuauucucagguuaauccgcucacccugacagcugccgugcuuaugcuggucgcucauuacgccauuaucggaccuggccuccaagcgaaggccacccgggaggcucagaaacgcacagccgcugggaucaugaagaaccccaccguggauggaauuguugccaucgaccuggaucccguggucuaugacgccaaauucgaaaagcagcugggccagauuaugcuccuuauccuguguacgagccaaauucugcucaugagaacaaccugggcgcugugcgaguccaucacacuugcuaccgggccucugaccacacucugggagggaucuccgggcaaauuuuggaauacgaccaucgccgugagcauggcuaacauuuuccggggcuccuaccuggccggggccggacuggcuuucagccucaugaagucccuuggcgggggacgcagaggcacaggggcccagggagaaacccugggcgagaaguggaaacggcagcugaaucagcucucuaagagcgaauuuaacacauauaaacgcuccggcaucauggagguggacagaucugaagcgaaggaggggcugaaacggggagagaccacgaagcacgccguuagcagaggcacagcuaaacuucgcugguucgucgaacggaaucuggugaaacccgaggggaaggugauugaucucggauguggcagagggggaugguccuacuauugcgccggccugaaaaaggucaccgaaguuaaaggcuacaccaaagggggaccuggccacgaggaacccaucccuauggcuacauacggguggaaccuggugaaacuccauucuggaaaggacguguuuuucauucccccugagaagugugauacccuucugugcgacaucggcgagagcuccccgaaucccacaauugaagaggggcgcacgcugcggguccucaaaaugguggaaccuuggcugagaggaaaccaauuuuguaucaagauccuuaaucccuauaugccuagcguuguggagacccuggagcagaugcagcgcaaacacggcggcaugcucguccggaacccccugucuagaaauuccacacaugaaauguacugggugagcugcgggaccggaaacauuguuucugccgugaauaugacaucccgcaugcugcucaaccgguucaccauggcgcacagaaagccgacguaugagcgcgaugucgaccugggcgccgggacccggcacguggcuguggaaccugaggucgccaaccuugauaucauuggacagagaaucgaaaauauuaaacaugagcacaagagcacauggcauuacgacgaggauaaccccuauaagaccugggcuuaccacggcucuuaugaaguuaaacccuccgggagcgccuccagcauggugaauggaguggucaagcugcucacaaaaccuugggacgugauccccaugguuacccaaacagcuaugaccgauacgacaccuuuuggccagcagcgcguguucaaggagaaagucgacaccagaaccccgaaggccaagcggggcacagcgcaaaucauggaagugacggcccgcuggcuguggggguuucuuucuagaaacaaaaagccccggauuuguaccagagaggaguucacacggaaaguucgcagcaaugcugccaucggagcuguguuugucgacgagaaccaguggaacuccgccaaggaggccguggaagaugagagauucugggaccugguucaucgggaacgcgagcuccacaaacagggcaagugcgcgaccugcguguacaacaugauggggaagagagagaagaagcugggagaguuuggcaaagcuaaggggucucgggccauuugguacauguggcugggcgcccgcuuccucgaguucgaagcucugggauuuaugaaugaggaucacugguucagcagagaaaacucccuuucuggcgucgagggggagggacugcauaaacucggcuauauccugcgggacauuagcaagaucccugggggaaauauguacgccgaugacacagcuggcugggauacccgcaucacagaagacgaucuucagaacgaggccaaaauuaccgacaucauggaacccgagcacgcgcugcucgccaaguccauuuuuaagcugacguaucaaaauaaaguggucagagugcagcggccugcuaagaacgggaccguuauggaugugaucucucgcagagaccagcggggcagcggacaggucggcacauacgggcugaauaccuucacaaacauggaagcccaacucauucgccagauggaguccgagggaaucuuuagccccucugaacuggagaccccgaaccuugcugaaagagugcuggauuggcucgagaaauauggcguggaacggcugaagagaauggccaucuccggggacgacuguguugugaaaccuauugaugaccgcuucgcgacggcccuuacagcucugaaugauaugggaaagguccggaaggacaucccccagugggagccuagcaaaggcuggaacgauuggcagcaagugcccuuuugcucucaucacuuccaccagcucauuaugaaggacgggagagagaucguugugccuugucgcaaucaggaugaacuggucggccgggccagagugucccagggagcuggcuggagccugcgcgagaccgccugccucgggaaauccuacgcucaaauguggcagcugauguauuuucaucggagagaccuucgccuggccgcgaacgccauuuguucugcuguccccguggauuggguuccgacaagccggaccacgugguccauccacgcccaucaccaguggaugaccacagaagacaugcucagcguguggaauagagucuggauugaggaaaacccuuggauggaggauaagacccauaucucuuccugggaggacgugcccuaccugggaaaacgcgaagaccaauggugcggcagccuuaucgggcugacagcccgggcuaccugggccacaaauauucagguugcgaucaaccaggugagacggcucauuggaaaugagaacuaccuggauuauaugaccucuaugaagagauucaagaaugaaagcgaccccgagggcgcucugugguga

SEQ ID NO: 18736 - RNA, 9879 nt, Artificial Sequence
  derived and/or modified CDS sequence (opt5) from DENV-1__FJ687432__SS-prME
agcgugaccaugcugcucaugcugaugcccaccgcccuugcuuuccaccugacgaccagaggcggggaaccucauaugaucguguccaagcaggaacggggaaagucucuccuguuuaagaccagcaccggcguuaauaugugcacccuuauugccauggaccugggggagcucugugaagauaccaugacauacaagugcccccgcaucaccgaggcggaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaagcagauucagaagguugaaaccugggcccugcggcaccccggcuucacagugaucgcucuuuuucuggcccaugcgauugggaccucuaucacccagaagggaaucauuuucauccuccugaugcuugucacaccuagcauggccaugcgcugcgugggcauuggguccagagauuuuguugagggacugagcggcgcuacguggguggacgucgugcucgagcacgggucuugugugaccacaauggccaaagauaagcccacccuggacaucgaacugcucaaaacagaggucaccaacccugcuguucugcggaaacuuugcauugaagccaaaaucuccaauacgacaaccgauagccgcuguccgacccaaggagaggcgacacugguggaagaacaagacgccaacuucgugugcagacggaccuuugucgaucgcggcuggggcaauggguguggacucuucggcaaggggucucugauuacaugcgcuaaguuuaaaugcgugacgaaacuugagggaaaaaucguucaguacgaaaaccugaaguauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucucccagaacgggccucgacuucaacgaaauggugcugcuuacaaugaaagagaaguccuggcugguccauaaacagugguuucucgaucugccucuucccuggaccagcggggccuccacaucucaagagaccuggaaucggcaggaccugcucgugaccuucaagacagcucacgcgaagaaacaggaagucgugguucugggaagccaagagggcgccaugcacacggcucugaccggggccacagaaauucagaccuccggaacaaccacgaucuuugccggccaucucaagugccgccugaaaauggauaaacuuacacugaaagggaugagcuaugugauguguaccggcucuuucaagcucgagaaggaagucgcugagacccagcacggaacaauucuggugcagaucaaauacgagggcaccgacgccccgugcaagaucccuuucuccacacaagaugaaaaagggguuacgcagaacggaagacugauuaccgcgaaucccaucgugacagacaaggagaaaccugucaacauugaagcugagccgcccuuuggcgagagcuauaucgugauuggggccggagaaaaggcccuuaagcucucuugguucaaaaagggcagcuccaucgggaaaauguuugaggcuaccgcccggggcgcuagacgcauggccauccugggagauacagcgugggacuucggcucuauugggggaguguuuaccagcguuggcaagcugguccaucagaucuucgggacggccuacggagugcucuuuuccggcgugagcuggaccaugaaaauugggaucggcguccugcuuacauggcugggacucaauucucgguccaccagccugucuaugacauguauugcugugggccugguuacccuuuaccucggggugaugguccaggccgauuccggaugcgugaucaacuggaagggcagagaacugaagugugggagcggaauuuucguuacaaaugaggugcacaccuggacggaacaauauaaauuucaggcugacuccccuaagcgccugucugccgcgaucggcaaagccugggaggagggggucugcggcauccggagcgcuacaagacucgaaaacauuauguggaagcagaucuccaacgagcugaaucauauucuucuggaaaacgacaugaaauucaccgugguugugggagaugucgccggcauccucgcucaggggaagaaaaugauucgcccgcaacccauggaguacaaguauucuuggaaaagcuggggaaaggccaagaucaucggcgccgacgugcagaaugcuaccuuuauuaucgaugggccuaacacacccgaauguccugacgaucagcgggcguggaauauuugggagguggaggacuacggauucggcaucuuuaccacgaacauuuggcugaaacugagagauuccuauacacaggucugcgaccaccgccuuaugagcgccgcuaucaaggauucuaaagccguucacgccgacaugggcuacuggaucgaauccgagaagaaugaaaccuggaagcucgcucgggccagcuucauugaggugaaaacauguaucuggcccaagucucauacccugugguccaacggggugcuggaaagcgagaugauuaucccgaaaauuuauggaggcccuaucucucaacacaauuacagacccggguacuucacacagaccgcgggaccuuggcaucucggcaagcuggagcuugauuuugaccugugcgaagggacgaccgucgugguugaugagcacugcggaaaccgcggccccagccuccggacaaccacagugaccggcaaaaucauucacgaaugguguugcagauccuguacgcugccuccccugcgguuccgcggggaggacggaugcugguauggcauggagaucagaccggucaaggaaaaggaggaaaaucuugugaaaagcaugguuucugcuggguccggagagguggacagcuuuucccucggccugcuguguauuucuaucaugauugaagaggucaugcggagcagauggucccgcaagaugcucaugacagggacccuggccguguucuuucuucugaucaugggacagcucacauggaacgaucugauucggcugugcaucaugguuggcgccaaugcuucugacagaaugggcauggggaccaccuaccuugcccugauggcgacauucaaaaugcgcccuauguuugcugugggacuccuguucagacggcucacgagccgcgagguccugcuucugaccaucggccucucccugguggccucuguggaacugcccaacagccuugaggaacugggggauggacucgccaugggcauuaugauccugaagcuccugacagacuuucaaucccaucagcuuugggcuacccugcucagccugacauucauuaaaaccacguuuucucugcacuaugccuggaagacaauggcuaugguccuuuccaucguuagccuguucccccucugucugucuaccaccucccagaagacaaccuggcucccugugcugcuugggagccugggaugcaaaccgcugacaauguuucucauugccgagaauaagaucuggggcagaaaaucuuggccccugaacgaaggcaucauggcgguggggauugucuccauccuucugagcucccuccugaagaacgaugugccucucgccggaccccugauugcuggcgggaugcuuaucgccuguuacguuauuagcggaucuagcgcugaccugucccuggagaaagccgccgaggugucuugggaagaggaagcugagcauagcggcgcgucccacaauauccucgucgaagugcaggaugacgggacgaugaagaucaaagaugaggagcgggacgauacccugacaauucuucugaaggccacccuccuggcuguuucuggaguguauccucucagcauccccgccacacuguucgucugguacuucuggcaaaagaaaaagcagcgcuccggcgugcuuugggacaccccuucucccccggaagucgagagagccgugcuggaugacggcauuuaucggaucaugcagcgcgggcugcucggaagaagccagguuggcgugggggucuuucaagaaaacguguuccauacgauguggcacguuacccggggagcugugcugauguaccagggcaaacgccuugagccuuccugggccagcgucaagaaagaccugauuucuuacgggggaggcuggagacuccagggcuccuggaauacaggggaggaaguccaggugaucgcgguugagcccggaaagaacccuaagaauguccaaaccgcucccggcacauuuaaaaccccggaaggggaggugggagccauugcccuggauuucaagccuggcacaagcgggucucccaucgugaaccgggaaggaaaaaucgucggccucuauggcaauggggugguuacgaccuccggaacauacgugagcgcuauugcccaggcgaaggcuucccaggagggcccucugcccgagaucgaagacgaggucuuuagaaaacgcaaccuuaccauuauggaucugcaccccgggucuggaaagacccggagauaucugccugccaucgugcgcgaagccauuaagcggaaacucagaacacugauccuugcuccgacgcgcguuguggccagcgagauggcugaagcccugaagggcaugcccauccgguaccaaaccacagcggucaaauccgagcauaccgggaaggagauuguggaccucaugugccacgccacauucaccaugagacugcugagcccuguucgcgugcccaauuauaacaugaucauuauggaugaagcucauuuuacggacccuucuuccaucgccgcucggggcuacauuagcacaagagucggaaugggcgaggccgccgcuaucuucaugaccgcgacacccccugggucuguggaagccuuuccgcagagcaaugcugugauccaggaugaggaacgggacauucccgagcgcuccuggaacucuggauaugaguggaucacagauuucccuggcaaaaccgucugguuuguucccagcauuaaguccgggaaugacaucgccaacugucucagaaagaauggaaaacgggugauucagcuuucucgcaagacauucgauaccgaauaccagaagacgaagaacaacgacugggacuacguggucacaaccgauaucagcgagaugggcgccaauuucagagcugaccgggugauugauccuagacgcugccugaaacccguuauccugaaggacgggccggaacgggugauccucgccggcccuaugcccgucacaguggcguccgcugcccagagacgcggacggauuggcagaaaccacaauaaggagggggaucaguauaucuacaugggacagccccugaacaaugacgaggaucaugcccacuggaccgaagcuaaaaugcuucuggacaacauuaauacgccugagggcaucauucccgcccucuuugaaccugagcgcgaaaagagcgcggccaucgauggggaguaucggcugagaggagaggcucgcaaaaccuucguugaacugaugagacggggcgaccucccgguguggcuuucuuacaaggucgccuccgagggguuucaauauagcgaucgcagauggugcuucgacggcgaacggaacaaucaggugcuggaggaaaacauggaugucgagaucuggacaaaagagggagaacgcaagaaacugagaccccgguggcucgacgcuagaaccuacuccgacccucuggcccuucgcgaguuuaaggaguucgcugccggccggagaucugugagcggggaucugauucucgagaucggaaagcugccccagcaccugacacagcgcgcgcaaaaugcccucgacaaccuuguuaugcugcauaauuccgaacagggcgggcgggcuuauagacacgcccuggaggagcucccugauaccauugaaacacugaugcuucuggcucucaucgccgugcugaccggaggcgugacgcuguuuuuccucucuggccgggggcuuggaaaaacaagcauuggccugcugugugucauggccuccagcguucuccuguggauggcuucuguggagccccauuggaucgcggccuccaucauucuugaauuuuuccugauggugcuccugaucccggagccugaccgccagagaacaccccaggauaaccaacuggcuuacgucgugauugggcuccuuuuuaugauccugaccguugccgccaaugagaugggacugcucgaaacaaccaagaaagaccugggcauugggcacguggcugucgagaaccaccaucacgccagcaugcuugauguggaccugcauccugcgucugccuggacacucuacgcugucgccacgaccaucauuacacccaugaugcggcacaccaucgaaaacacaaccgcuaauaucucccugacggccauugcgaaccaggccgcuauccugaugggacucgauaagggcuggccuauuagcaaaauggacaucggcgugccccuucuggcccuggggugcuauucucagguuaauccgcucacccugacagcugccgugcuuaugcuggucgcucauuacgccauuaucggaccuggccuccaagcgaaggccacccgcgaggcucagaagagaacagccgcugggaucaugaaaaaccccaccguggauggaauuguugccaucgaccuggaucccguggucuaugacgccaaguucgaaaaacagcugggccagauuaugcuccuuauccuguguacgagccaaauucugcucaugcggacaaccugggcgcugugcgaguccaucacacuugcuaccgggccucugaccacacucugggagggaucuccgggcaaguuuuggaauacgaccaucgccgugagcauggcuaacauuuuccgcggcuccuaccuggccggggccggacuggcuuucagccucaugaaaucccuuggcgggggaagacggggcacaggggcccagggagaaacccugggcgagaaguggaagcgccagcugaaucagcucucuaaaagcgaauuuaacacauauaagagauccggcaucauggagguggaccggucugaagcgaaagaggggcugaagagaggagagaccacgaaacacgccguuagccgcggcacagcuaaacuucggugguucgucgaaagaaaucuggugaagcccgaggggaaagugauugaucucggauguggccgcgggggaugguccuacuauugcgccggccugaagaaagucaccgaaguuaagggcuacaccaaagggggaccuggccacgaggaacccaucccuauggcuacauacggguggaaccuggugaagcuccauucuggaaaagacguguuuuucauucccccugagaagugugauacccuucugugcgacaucggcgagagcuccccgaaucccacaauugaagaggggcggacgcugagaguccucaagaugguggaaccuuggcugcgcggaaaccaauuuuguaucaaaauccuuaaucccuauaugccuagcguuguggagacccuggagcagaugcagcggaagcacggcggcaugcucgucagaaacccccugucucgcaauuccacacaugaaauguacugggugagcugcgggaccggaaacauuguuucugccgugaauaugacaucccggaugcugcucaacagauucaccauggcgcaccgcaaaccgacguaugagcgggaugucgaccugggcgccgggaccagacacguggcuguggaaccugaggucgccaaccuugauaucauuggacagcgcaucgaaaauauuaagcaugagcacaaaagcacauggcauuacgacgaggauaaccccuauaagaccugggcuuaccacggcucuuaugaaguuaagcccuccgggagcgccuccagcauggugaauggaguggucaaacugcucacaaagccuugggacgugauccccaugguuacccaaacagcuaugaccgauacgacaccuuuuggccagcagagaguguucaaagagaaggucgacacccggaccccgaaagccaagcgcggcacagcgcaaaucauggaagugacggccagauggcuguggggguuucuuucucggaacaagaaacccagaauuuguacccgggaggaguucacacgcaagguuagaagcaaugcugccaucggagcuguguuugucgacgagaaccaguggaacuccgccaaagaggccguggaagaugagcgguucugggaccugguucaucgcgaaagagagcuccacaagcagggcaaaugcgcgaccugcguguacaacaugauggggaagcgggaaaagaaacugggagaguuuggcaaggcuaaagggucucgcgccauuugguacauguggcugggcgccagauuccucgaguucgaagcucugggauuuaugaaugaggaucacugguucagccgggaaaacucccuuucuggcgucgagggggagggacugcauaagcucggcuauauccugcgcgacauuagcaaaaucccugggggaaauauguacgccgaugacacagcuggcugggauaccagaaucacagaagacgaucuucagaacgaggccaagauuaccgacaucauggaacccgagcacgcgcugcucgccaaauccauuuuuaagcugacguaucaaaauaaggugguccgggugcagcgcccugcuaaaaacgggaccguuauggaugugaucucuagacgggaccagcgcggcagcggacaggucggcacauacgggcugaauaccuucacaaacauggaagcccaacucauuagacagauggaguccgagggaaucuuuagccccucugaacuggagaccccgaaccuugcugaacgggugcuggauuggcucgagaaguauggcguggaaagacugaaacgcauggccaucuccggggacgacuguguugugaagccuauugaugaccgguucgcgacggcccuuacagcucugaaugauaugggaaaagucagaaaggacaucccccagugggagccuagcaagggcuggaacgauuggcagcaagugcccuuuugcucucaucacuuccaccagcucauuaugaaagacgggcgcgagaucguugugccuugucggaaucaggaugaacuggucggcagagcccgcgugucccagggagcuggcuggagccugcgggagaccgccugccucgggaaguccuacgcucaaauguggcagcugauguauuuucauagacgcgaccuucggcuggccgcgaacgccauuuguucugcuguccccguggauuggguuccgacaagcagaaccacgugguccauccacgcccaucaccaguggaugaccacagaagacaugcucagcguguggaaucgcgucuggauugaggaaaacccuuggauggaggauaaaacccauaucucuuccugggaggacgugcccuaccugggaaagcgggaagaccaauggugcggcagccuuaucgggcugacagccagagcuaccugggccacaaauauucagguugcgaucaaccaggugcggagacucauuggaaaugagaacuaccuggauuauaugaccucuaugaaacgcuucaagaaugaaagcgaccccgagggcgcucugugguga

SEQ ID NO: 18737 - RNA, 9879 nt, Artificial Sequence
  derived and/or modified CDS sequence (opt5) from DENV-1__JQ922547__SS-prME
agcgugaccaugcugcucaugcugcuucccaccgcccuggcuuuccaccucacgacccggggaggggagccucauaugaucguguccaagcaggaacggggaaaaucucugcuuuuuaagacgagcgccggcguuaauaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagagccgaaaccuggaugagcuccgagggcgcuuggaaacagauucagaagguugaaacgugggcccuucggcaccccggcuucacagugaucgcgcuguuucucgcccaugcuauugggaccucuaucacacagaagggaaucauuuucauccugcuuaugcuggucaccccuagcauggccaugcgcugcgugggcauugggaacagagauuuuguugagggacucuccggcgcucccuggguggacgucgugcuggagcacgggagcugugugaccacaauggccaaaaauaagccuacgcuggauaucgaacuccugaaaaccgaggucacaaacccggcgguucuucggaagcugugcauugaagccaaaaucucuaauaccacaaccgacucccgcugucccacgcaaggagaggcuacacucguggaagaacaggaugccaacugcguguguagacggaccuucgucgaccgcggcuggggcaaugggugcggacuguuuggcaaggggagccuuauuaccugcgcuaaguucaaaugugugacaaagcuggagggaaaaaucguucaguacgaaaaccucaaguauucugugaucgucaccgugcacacaggcgaucagcaucaaguugggaaugagacgaccacacacggaaccacagccaccauuacgccucaggcccccaccuccgaaauccagcugacagacuacggcgcucugacccucgacugcagcccuagaacaggccuggauuuuaacgagauggugcuucugaccaugaaagaaaagucuuggcucguccauaaacagugguuccuggaccuuccccugccguggacguccggggcgagcacaucccaagagaccuggaaucggcaggaucuccuggugacauuuaagaccgcccacgcuaagaaacaggaggucgugguucugggaucucaagaaggcgccaugcacaccgcccucacaggggcuacggagauucagaccagcggaacaaccacaaucuucgccggccaucugaagugucgccuuaaaauggacaagcugacccucaaagggauguccuaugugaugugcacgggcagcuuuaagcuggaaaaggaggucgcggaaacacagcacggaaccgugcugguucaggugaaauacgagggcaccgaugcuccuuguaagauucccuucucuacacaagacgagaaaggggccacccagaacggaagacuuaucacagccaauccuaucgucacggauaaggaaaaacccgugaacauugaggcugaacccccuuucggcgaguccuauaucgugguuggggccggagagaaggcucucaagcugagcugguuuaaaaagggcucuagcauugggaaaaugcuggaagccaccgcgcggggcgccagacgcauggcuauccucggagacacagccugggauuucggcuccauugggggagucuuuaccucuaugggcaagcuggugcaucagguguucgggacagcuuacggaguccuuuuuagcggcguguccuggaccaugaaaaucgggaucggcauucugcucacguggcugggacugaauagccggaacaccucucuuuccaugaugugcaucgccguuggcauggugacacucuaccugggggucauggugcaggcggacagcggauguguuauuaacuggaagggcagagagcugcucugcgggaccggaaucuucgugacaaaugaaguccacaccuggacagauccguauaaguuucaagccgaccccucuaaccgccuguccccuauuaucggcaaggcuugugugauucggguuugcgggaucagaagcgccacccgccuugagaauaucauguggaagcagauuuccaacgaacugaaucauauccuccuggagaacgacaugaaauucacgguggucgugggcgaugugucuggcauucuggcucagggcgagaagaugauccggccccagccuauggaacacaaauacagcuggaaguccugggggaaagccaagauuaucggagccgacguccaaaauacaaccuuuaucauugauggccccaacaccccggaguguccugacaaucagagagcuuggaacaucugggaaguugaggauuauggguucggaauuuuuacaaccaauaucuggcuuaagcuccgcgacucuuacacacaggugugcgaucaccggcugaugagcgcggccauuaaagacuccaaggcugugcaugccgauaugggcuauuggaucgaaagcgagaaaaacgagacauggaagcuggccagagcuucuuucaucgaagucaaaaccugcacauggcccaagucccacacccucuggagcaauggcgugcuggagucugaaaugauuaucccuaagauuuacgggggacccaucucccagcauaacuaucgcccuggcuacuuuacacaaaccgccgggcccuggcaccuuggaaaacuggagcucgacuucgauuucugugaaggcacgaccguuguggucgacgagcacugcgggaaucggggaccgagccugagaacaaccacagugaccggcaagauuauccaugagugguguugccggucuuguacgcugccuccccuucgcuuuaaaggcgaagaugggugcugguacggaauggagaucagacccguuaaggacaaagaagagaaccucgugaaaagcauggucuccgcgggcagcggggagguggacucuuucucccugggacugcucuguauuagcaucaugauugaagagguuaugcgguccagauggucuaagaaaaugcugauggugggcacacuugcugucuuucugcuccugaucauggggcagcugaccuggagcgaucuuauucgccugugcaucauggugggagccaacgccuccgaccggaugggcaugggcacaaccuaucucgcucugauggccaccuucaagaugagaccuauguuugcgguggggcuccuguucccgaaacuuacaucucgcgaaguccugcuccugacgauuggacugagccuuguugcuuccguggagcugcccucuagccucgaagaacugggcgaugggcucgccaagggaaucaugaugcugaaacuucugaccgacuuucagucccaccaacucugggccacacugcugagccuuaccuucaucaagacaaccuuuucucugcauuacgcuuggaagacgauggccauggugcucuccauugucagccuguucccucucugucugucuacaaccucccagaaaaccacauggcuucccgugcugcugggcagccucgggugcaagccucugcccauguuucuuaucaccgagaauaaaauuuggggaagaaagucuuggccucugaacgaaggcaucauggcuguuggcauuguguccauccuccugagcucccuccugaaaaaugaugucccccuugccgggccgcugaucgcgggaggcaugcugguggccuguuauguuauuagcgggucuagcgcugaccucucccuggagaaggccgcugaagugucuugggaggaagaggccgagcacagcggagccucccauaacauccuugucgaagugcaggaugacggcacacggaaaauuaaggaugaggaacgcgacgauacgcugaccauccuccugaaggcuacacuccuggcggucucugggguguacccuaugagcauucccgccacccuuuucguuugguauuuuuggcagaaaaagaaucaaagauccggagugggccugaucacaccuucucccccggaggucgaacgggcugugcuggacgauggcaucuaccgcauucuccagagagggcugcuuggacggagccagguuggcgugggggucuuccaggagggaguguuccacaccauguggcacgugacgcgcggcgccguucugauguaucaagggaaaagacucgagccuuccugggccagcgucaagaaagaccugaucucuuacggaggcggcuggcgguuucagggguccuggaacaccggagaagagguccaggugauugcugucgaacccggccgcaauccuaagaacgugcagacagcccccgggaccuucaagacacccgagggagagguuggcgcgaucccucucgacuuuaaaccggggaccagcggaucucccauugugaauagagaaggcaagaucgucggccuguacgggaacggagugguuacaacguccggcaccuaugugagcgcuauugcccgggccaaggcuucccaagaggggccucuucccgaaaucgaggaugaagucuucagaaagcgcaaucugacaaucauggaccugcauccuggaucuggcaaaacccggagauaccuccccgccauugugcgcgaggcgaucaagcggaagcugagaacccuuauucuggcuccuacacgcguuguggccagcgagauggccgaagcucucaaaggggucccgauccgguaucagacgaccgccgugaaguccgagcacacaggcaaagaaauuguggaucugaugugccaugcuaccuuuacaaugagacugcucagccccguccgcguuccuaacuacaauaugaucaucauggacgaggcccacuucaccgaucccgcgucuauugccgcucggggauauaucuccacgagagugggcaugggggaagccgcugccauuuuuaugacagccaccccuaccggaagcguggaggcuuucccccagucuaacgcgaucauucaagacgaggaacgggauaucccggagcgcagcuggaacuccggcuacgacuggaucacagauuuuccugggaagaccgucugguucgugcccucuauuaaaagcggaaacgacaucgccaacugccuuaagaagaauggcaaaagaguuauucagcugucccggaagacauuugauaccgaauaucagaaaacgaagaacaaugacugggacuacguggucacaaccgauaucucugagaugggggcuaacuuccgcgccgacagagugauugauccccggagaugucugaaaccuguuauccucaaggacggccccgaacgcgugauucuggccggaccuaugccggucacaguggcuagcgccgcgcagcggagaggccgcaucgggcggaaucaaaacaaggagggagaucaguacaucuauaugggccagcccuccaauaacgacgaggaucaugcucacuggaccgaagccaaaaugcuucuggacaauauuaacacgccugaggggaucauucccgcccucuucgaaccugagagagagaaaagcgcugccaucgauggagaauaccgccugcggggcgaagcgagaaaaaccuuugucgaacugaugcgcagaggggaccuccccguguggcuuucuuauaagguugccuccgagggcuuccaguacagcgaucggcgcuggugcuuugacggagaaagaaauaaccaagugcuggaggagaauaaagauguggaaauuuggacaaaggagggcgaacggaaaaagcugcgcaccuguuggcucgacgcuagaacauauuccgacccgcuggcccuucgggaguucaaggaauuugcugccgggagacgcucugucagcggagaucugauccucgagaucggcaaacugccucagcaccugacccagaaggcucagaaagcccucgacaaccuuguuaugcugcauaauuccgagcaagggggaaaggcguaccggcacgccauggaagaacugcccgauacaauugaaacccucaugcugcuugcucugaucgccgugcucacgggcggcgugacacuguucuuucugucugggagaggacucggcaaaaccagcauugggcuucugugcgucauggcuuccagcgugcugcucuggauggccucuguugagccucauuggaucgccgcuuccauuauccuggaguucuuucuuauggugcugcucauccccgagccugaccgccagcggacaccccaggauaaccagcuggcguaugucgugauuggacuccuguucaugauccuuacagucgccgcuaacgagaugggccugcuggaaaccacaaagaaggaccucgggauuggacacguggccgccgagaaucaccaucacgcuacgaugcuggauguugaccuuagaccggccagcgcguggacccuguacgccguggcuacaaccaucauuacaccuaugaugcggcauaccaucgaaaacacgaccgccaauauuucucucacagcuaucgccaaccaagcggccauccugaugggccuggauaaaggcuggcccauuuccaagauggacaucggggucccccuccuugcucugggauguuacagccaggugaauccucugacccucacagccgcuguucugaugcuuguggcccacuaugcuauuaucggcccggggcugcaggccaaagcgacccgcgaggcccaaaagagaacggcugccggaauuaugaaaaaccccacagucgauggcaucguggcuaucgaccucgauccugugguuuacgacgccaaguuugagaagcagcuggggcagauuaugcugcucauccuuugcaccucucagauucugcugaugcggacaaccugggcccucugugaaagcaucacccuggcgacaggaccccuuacgacccugugggagggcuccccuggccgcuucuggaauacaaccauugcugucucuauggccaacaucuuuagagggagcuaucucgcuggagccggccuggccuucucccugaugaaaagccucgggggaggccggcgcgggacaggagcucaaggcgaaacccuuggcgagaaguggaaaagacagcugaaucagcuguccaagucugaguucaacacguacaaacggagcgggaucauggagguggaccgcuccgaggccaaggaaggacucaagagaggcgagacaaccaaacaugcggugucucgggggaccgccaagcugagaugguuugucgaacgcaaucuuguuaaacccgagggaaaggugauugaucugggcugcgggcggggaggcuggagcuauuacugugcuggccucaaaaaggugacagaagucaaaggguauaccaagggaggcccugggcacgaggagccgauccccauggccacauacggauggaaccuggugaagcugcacuccggcaaagacguuuucuuuauuccucccgaaaagugcgauacgcuccuuugugacaucggggagucuagcccuaaucccaccauugaagagggaagaacacugcgcgugcugaaaauggucgaaccguggcuccggggcaaccaguucugcaucaagauucugaauccuuacaugcccuccgugguugagacccuugagcaaaugcagagaaaacauggcgggaugcuggugcgcaacccccucagcagaaauucuacacacgaaauguauugggucuccugcggaaccggcaacaucgugagcgcugugaacaugacgucuagaaugcugcugaaucgcuuuaccauggcccaucggaagccuacauacgagagagaugucgaccucggggcgggaacccgccacguugccguggaacccgagguggcuaaccuggauaucauuggccagcggaucgagaauauuaagaacgaacacaaauccacauggcauuaugacgaggauaauccuuacaagaccugggccuaucacgggagcuacgaagucaaaccgucuggauccgcuagcuccauggugaacggcguugugagacuucugacaaagcccugggacgucaucccuauggugacccagauugccaugacggauacaacccccuucggccaacagcgcguuuuuaaagagaagguggacaccagaacaccuaaggcuaaacgggggacggcccagaucauggaagucaccgcgcgcuggcucuggggauuccugagcagaaauaagaaaccccggaucuguacaagagaggaguuuacccggaaggugcgcucuaacgccgcuauuggcgccguuuucguggacgaaaaucaauggaacagcgcuaaagaggccgucgaagaugagagauuuugggaccuugugcaucgggaacgcgagcugcacaagcaggggaagugcgccacaugugucuauaauaaaaugggaaagagagagaaaaagcucggcgaguucgggaaagcgaagggcucccgggcuaucugguacauguggcugggagcccgcuuucuggaguucgaagcccucggcuucaugaacgaggaucauugguuuucuagagaaaauagccuguccgggguggagggagagggccuucacaaacugggguacauucuccgggacaucucucgcauuccgggaggcaacauguaugcugaugacaccgccgggugggauacaagaaucaccgaagacgaucugcagaaugaggcuaagaucacggacauuauggaaccugagcacgcccuucuggcgaccagcaucuucaagcucacauaccagaacaaaguugugcggguccaacgccccgccaagaacggcaccgugauggaugcuauuuccagacgggaccagcgcggaucuggccagguggggacauauggacugaauaccuuucugcauaaagaggcccagcucaucagacaaauggaguucgagggcauuuuucugccuagcgaacuugagacgcccaaccuggcugggcggguucucgauuggcuggaacaguacggaguggagagacuuaagcgcauggccaucuccggcgacgacugcgucgugaaaccuaucgaugaccgguucgcgacagcccugaccgcucucaaugauauggggaagguuagaaaggacauuccccagugggagccgagcaaaggcuggggagauuggcagcaagugccuuuuuguucucaccauuuccaccagcugaucaugaaggacguccgcgaaauugugguccccugccggaaccaggaugagcuggugggcagagcccgcguuucccagggggcuggauggagccuccgggaaacagccugucugggcaaaucuuaugcucaaauguggcagcuuauguacuuucacagacgcgaccugcggcucgccgcgaaugccaucugcuccgcugugcccgucgauugggugccuaccagcagaacgaccugguccauucaugcccaccaucaguggaugacaaccgaggacaugcugucuguuuggaaccgcguguggaucgaagagaauccguggauggaggauaagacacacgucagcuccugggaagacgugcccuaucuugggaaacgggaggaccaaugguguggaagccugauuggccucaccgccagagcuacaugggccaccaacauccagguggcgaucaaucagguucggagacugauugggaacgaaaauuaccuggauuacaugacgucuaugaagcgcuucaagaacgaguccgacccugaaggcgcucucugguga

SEQ ID NO: 18738 - RNA, 9879 nt, Artificial Sequence
  derived and/or modified CDS sequence (opt5) from DENV-1__EU482567__SS-prME
agcgugaccaugcugcucaugcugcuucccaccgcucuggcuuuccaccucacgacccggggcggggagccucauaugaucgucuccaagcaggaacggggaaaaucucugcuuuuuaagacaagcgccggcauuaacaugugcacccugaucgcgauggaccucggggagcugugugaagauacaaugaccuacaaaugccccagaauuacagaggcugaacccgacgauguugacuguuggugcaaugccaccgauacgugggugaccuauggaacauguucccagaccggcgagcacagacgggacaagcgcucuguggcccuggcuccucaugucgggcucggacuggagacaagaaccgaaacguggaugagcuccgagggcgccuggaaacagauccagaagguggaaacaugggcccuucggcaccccggcuucaccguuacagcccuguuucucgcgcaugccauugggaccucuaucacccagaagggaaucauuuucauccugcuuauucuggugacaccuagcauggcuaugcgcugcgucggcaucgggaacagagauuuuguggagggacucuccggcgccacguggguugacgugguccuggagcacgggagcugugugaccacaauggcuaaagauaagcccacccuggacauugaacuccugaaaacagaggugaccaauccugccguccuucggaagcugugcaucgaagcgaaaauuucuaacacgacaaccgauucccgcuguccgacccaaggagaggccacacucguugaggaacaggacagcaauuucgugugcagacggaccuuuguggaucgcggcuggggcaacggguguggacuguucggcaaggggucucuucugacaugcgcuaaguuuaaaugcgucacgaagcucgagggaaaaaucgugcaguacgaaaaucugaaguauuccguuaucgugaccguccacacaggcgaccagcaucaaguggggaacgagaccacagaacacggaaccauugccacgaucacaccccaggcuccuacaagcgagauucagcugaccgacuacggcgcccucacacuggauuguucucccagaaccggccuugacuucaaugaaaugguucugcucacgaugaaagagaaguccuggcuggugcauaaacagugguuucuugaucugccucuccccuggacaagcggggccuccaccucucaagagacauggaaccggcaggaccugcuggucaccuucaagaccgcucacgcgaagaaacaggaaguggucgugcucggaagccaagagggcgccaugcacacagcucugacgggggccaccgaaauccagacauccggaaccacaaccauuuuugccggccaucuuaagugccgccugaaaauggauaagcucacgcugaaagggaugagcuauguuauguguacaggcucuuucaagcuggagaaggaaguggcugagacccagcacggaaccguccuugugcagguuaaauacgagggcacagacgccccgugcaagaucccuuucuccgcgcaagaugaaaaaggggugacccagaauggaagacucaucacagcuaaccccauugucacggacaaggagaaaccugugaauaucgaaaccgagccgcccuuuggcgagagcuauauugugguuggggccggagaaaaggcccugaagcugucuugguucaaaaagggcagcuccaucgggaaaauguuugaggcuacagcccggggcgcuagacgcauggccauucucggagauaccgcgugggacuucggcucuaucgggggagucuuuacaagcgccggcaagcuggugcaucagguguucggggcugccuacggaguccucuuuuccggcgugagcuggaccaugaaaaucgggauuggcauccugcucacguggcugggacugaacucucgguccaccagccuuucuaugacauguauugcuguuggcauggugacccucuaccugggggucgugguucaggccgauuccggaugcgugaucaauuggaagggcagagaacugaagugugggagcggaauuuucgucacaaacgaggugcacaccuggacagaacaauauaaauuucaggcggacuccccuaagcgccucucugccgcuaucggcaaagccugggaggaggggguuugcggcauucggagcgcuaccagacuggaaaacaucauguggaagcagaucuccaaugagcuuaaccauauucugcucgaaaaugacaugaaauucacgguggucgugggagaugccaacggcauccuggcccaggggaagaaaaugauucgcccgcaacccauggagcaccgguacucuuggaaaagcuggggaaaggcuaagaucauuggcgcggacauccagaaugccacauuuaucauugaugggccugacacccccgaauguccugaugaccagagagcuuggaacaucugggagguggaggauuauggauucggcauuuuuaccacaaauaucuggcugaaacuucgcgacuccuacacccagaugugcgaucaccggcucaugagcgccgccauuaaagacucuaaggcuguccaugccgauaugggcuauuggaucgaauccgagaaaaacgaaacguggaagcuggcgagagcuagcuucaucgagguuaagacauguauuuggcccaaaucucacacccugugguccaauggggugcucgaaagcgagaugaucauuccgaagaucuacggaggcccuauuucucaacauaacuaucgccccggguacuucacacagaccgccggaccuuggcaccugggcaaacuugagcuggacuuugaucucugcgaagggacaaccguggucguggacgagcacugcggaaaucggggccccagccugagaacgaccacaguuaccggcaagaucauccaugaaugguguugccgguccuguacacugccuccccuucgcuucagaggggaggacggaugcugguacggcauggagauucggccggugaaagaaaaggaggaaaaccucgucagaagcauggugucugccggguccggagagguugauagcuuuucccugggcauccugugugugucuauuaugaucgaagaggucaugcgcagccggugguccagaaagaugcucaugaccgggacgcuggcuguguuccuucugcucauuaugggacagcugacauggaaagaccugauccgccuuugcauuaugguuggcgccaaugcgucugauagaaugggcauggggaccacauaucuggcucucauggccaccuuuaagaugcggccuauguucgccgugggacugcucuuucgcagacugaccagccgggagguccuucugcucacaaucggccugucccugguggcuucuguggaacuucccaacagccuggaggaacucggggacggacuggccaugggcaucaugaugcucaaacugcuuacggaguuccaaccccaccagcuguggaccacacuccugucccugaccuuuauuaauacaacccuuagccuggauuacgcuuggcgcacgauggccaugguccucucuaucauuucccuguucccucucugucugagcacaaccucucagaagaccacauggcuuccgguucugcugggguccuuuggaugcaaaccccucaccauguuccugaucacagaaaacaagauuuggggcagaaagagcuggccucuuaacgagggcaucauggcgaucgggauugugucuauccugcucuccagccugcucaaaaaugacgugccccuggccggaccucuuauugcuggcgggaugcugaucgccuguuaugucauuuccggaagcucugcugaucugagccucgagaaggccgccgaaguguccugggaggaagaggcugaacauucuggcacgagccacaacauccugguugaggugcaggacgaugggaccaugaaaaucaaggacgaggaacgggaugacacacuuaccauucugcucaaagcgacacugcucgccgucuccggaguguaccccaugucuaucccugcuacccuguuuguuugguauuucuggcaaaagaaaaagcagcgcagcggcgugcuuugggauacgcccuccccgccugaggucgaaagagccgugcuggacgacggcauuuaccggauccugcagcgcgggcuccugggaagaucucaggucggcguggggguuuuccaagauggaguguuucauaccauguggcacgucacacggggcgccgugcuuauguaucaggggaagagacuggagcccagcugggcuuccguuaaaaaggaccucauuagcuacggaggcggcuggcgcuuccaggggucuuggaauaccggagaggaagugcaggucaucgccguggagccuggcaaaaaccccaagaaugugcaaacaaccccggggacauuuaaaacgccugaaggagagguuggcgcgauugcucuggauuucaagcccgggaccuccggaagcccuaucgucaaccgggaaggcaagaucgugggccucuacgggaauggaguggucacaaccucuggcaccuauguguccgccauugcccaggcuaaaacaagccaggaggggccccugcccgagaucgaagacgagguuuuuaagaaaagaaaccuuacgauuauggaucugcacccuggauccggcaagacccgccgguaccugccggccaucgugagagaagcgauuaaacgcaagcuccggacacugauccuugcucccaccagagucguggccucugagauggccgaagcucugaaggggaugccuauccgcuaucaaacaaccgccguuaaaagcgagcauacgggccgggagauuguggaccucaugugccacgcuacauucaccaugagacugcugucccccguccgggugccuaauuacaacaugaucauuauggaugaagcccauuuuaccgaccccgcgagcaucgccgcucgcggauauauuucuacaagaguuggcaugggggaggccgcugccaucuucaugaccgccacaccuccgggauccguggaggcuuuuccccagagcaaugcggucauccaggaugaggaacgggacauuccugagcgcucuuggaacagcggcuacgauuggaucaccgacuuccccgggaagacggugugguuugugccuuccauuaaaucuggaaaugacaucgccaacugucucagaaagaauggcaaacgggucauucagcuuagcagaaagacauucgauaccgaguaucaaaagaccaagaauaacgacugggauuacguugugaccacggacaucuccgaaaugggggcuaauuuccgcgccgaucgggugauugaccccagacgcugccugaagccggucauccugaaagauggcccugagcgggugauccucgccggacccaugcccguuaccguggcuucugccgcgcagagacgcggccggauugggagaaaccagaauaaggaaggagaccaguacgucuauaugggccaaccucugaacaaugaugaggaccacgcucauuggacagaggccaaaaugcuucuggauaacaucaauacccccgaagggauuaucccugcccucuuugagccggaacgcgaaaagagcgcugccauugacggagaauacagacugcggggcgaggcgcgcaagacauucguggagcugaugagaagaggggaucuccccguuuggcuuuccuauaaaguggccagcgaaggcuuucaguacucugaccgcagauggugcuucgacggagagcggaacaaucagguccuggaagagaacauggauguggaaaucuggaccaaggagggcgagcgcaagaagcugcgcccucgguggcucgacgcuagaacauauuccgauccccuggcccuucgcgaauuuaaagaguucgcugccgggcggagaagcgucuccggagaccugauccucgaaauuggcaagcugccucagcaccugacccuccgggcucaaaaugcccuugauaaccuggugaugcugcacaauucugagcaagggggaaaagcguaccgccaugccauggaagaacuucccgacacgaucgagacacugaugcuucuggcucucauugccguucugaccggcggcgugacccuguuuuuccucagcgggaagggacuuggcaagacauccaucgggcugcugugugugauggcuucuagcgcccuccuguggauggccaacgucgaaccgcacuggauugcugcguccaucauccuugaguuuuuccugaugguucuccugauuccugaacccgauagacagcggaccccucaggacaaucaacuggccuauguggugaucggacuccuuuuuaugauucugacagucgcugccaacgagaugggccugcucgagacgaccaaaaaggaucuggggaucggacauguggccgcugaaaaccaccaccaugccacaaugcuugacguugaucugcgccccgcgagcgccuggacccucuacgcuguggccacaaccgucauuacgccuaugaugagacacaccaucgagaauacaaccgcuaacauuucucugacagccaucgcgaaucaggccgcuauccugaugggccucgacaaaggcuggcccauuuccaagauggauaucggggugccgcuucuggcccugggaugcuacagccaggucaacccucucacccugacggcugccgugcuuaugcugguugcucauuaugccauuaucggccccgggcuccaagcgaaagccacacgggaagcucagaagcgcaccgccgcuggaauuaugaagaaucccacaguggacggcaucgucgccaucgaccuggauccugugguuuacgacgccaaauucgagaagcagcuggggcagauuaugcuccuuauccuguguaccucucaaauucugcucaugagaaccacaugggcgcugugcgaauccaucacgcuugcuaccggaccgcugacaacccucugggagggcagccccggcaaauuuuggaacacaaccauugccgugucuauggcuaauaucuuccgggggagcuaucuggccggagccggccuggcuuucucccucaugaagucucuugggggaggccgcagagggacgggagcccagggcgagacacugggcgaaaaauggaagcggcagcugaaccagcucagcaaguccgaguuuaauaccuacaaaagaagcgggaucauggaagucgaucgcuccgaggcgcgggaaggacugaagagaggcgagaccacaaaacacgccgugucucgcgggaccgcuaaacuucggugguucguggagagaaaccugguuaaaccugaaggaaaggucauugaccucggcugugggcgcggaggcuggagcuauuacugcgccggccugaagaaagugacagaggugaagggguauacgaaaggaggccccgggcaugaggagccuauccccauggcuaccuacggauggaaucuggucaagcucuacuccggcaaagauguguuuuucauuccuccggaaaagugugacacacuucugugcgauaucggggagucuagccccaacccuaccauugaggaaggacggacacugagaguucucaaaaugguggagcccuggcugcgcggcaaucaauuuuguaucaagauucuuaacccuuauaugcccuccgucguggaaacccuggagcagaugcagcggaagcacggcgggaugcucguuagaaauccgcugucucgcaacagcacgcacgagauguacuggguguccugcggaaccggcaauaucgucagcgccgugaacaugacaucucggaugcugcucaacagauucaccauggcgcaucgcaaaccuacauaugaaagagacguugaucugggggccggaacccggcacguggcugucgagcccgaaguggccaaucuugacaucauuggccagcgcaucgagaacauuaagaaugaacauaaauccacauggcacuacgaugaggacaaccccuauaagaccugggcuuaccacgggagcuaugaggugaaaccuucuggauccgccagcucuauggucaauggcguugugagacugcucacgaagcccugggacgugaucccuauggucacacaaauugcuaugaccgauaccacaccguuuggccagcagcggguguucaaggaaaaaguugacacgagaacaccccgggccaagcgcgggacagcgcaaaucauggaggugaccgccaaauggcuguggggauuucuuuccagaaacaagaaaccucggaucuguacacgcgaagaguucaccagaaagguccggagcaaugcugccauuggcgcuguguuuguugaugaaaaccaguggaacuccgccaaggaggccguggaggacgaacgcuucuggaaccugguccauagagagcgggaacuccacaaacaggggaagugcgcgacaugcguguacaauaugaugggaaaacgcgagaagaaacugggcgaauuugggaaggcuaagggcagcagagccaucugguacauguggcugggagcccgguuccucgaguucgaggcucugggcuuuaugaacgaagaucauugguucucucgcgagaauagcuuuuccgggguugaaggagagggccuucacaaacugggguauauucucagagacaucucuaagauucccggaggcaacauguacgccgaugacaccgcugggugggauacgcggaucaccgaggacgaucugcagaaugaagccaaaaucacagacauuauggagccugaacaugcgcuucuggccaccagcaucuucaagcucacauaucaaaacaaagugguccgcgugcagagacccgcuaagaacggcaccgucauggaugugauuucccggagagaccagcgcggaucuggccagguugggacguacggacugaauacauuuaccaacauggaggugcaacugauccggcagauggaaagcgagggcauuuuccucccguccgagcuggaaacaccuaaucuugccgagagaguccuggacuggcucgaaaaacacgggaccgagcgccugaagcggauggcuaucucuggagaugacuguguggugaagcccguugaugaaagauuugccacggcgcuuaucgcccugaacgacaugggcaaagugcgcaaggauauuccucagugggagcccagcaaaggguggaaugacuggcagcaagucccuuucugcucccaccauuuucaccagcucaucaugaaggauggccgggagauugugguucccuguagaaaccaggacgaacuggugggacgcgcucgggucagccagggcgccggguggucucugagagagaccgcuugccucggaaaauccuaugcccaaauguggcagcugauguacuuccaucgccgggaucuuagacuggcugccaaugcgaucuguagcgccgugccggucgacugggugccuacaucucggaccacaugguccauucacgcucaccaucaguggaugaccacagaagauaugcucagcguuuggaacagaguguggaucgaggaaaaucccuggauggaggacaagacccacgucuccucuugggaggaagugcccuaucugggcaagcgcgaggaccaauggugcgggagccuuauuggacugacggcccgggccacaugggcuaccaacauccagguugccaucaaucaggugagacgccucauuggcaacgaaaauuaccuggauuacaugaccuccaugaaaagauuuaagaacgagagcgacccugagggggcgcugugguga

SEQ ID NO: 18739 - RNA, 9879 nt, Artificial Sequence
  derived and/or modified CDS sequence (opt5) from DENV-1__FJ390378__SS-prME
agcgugaccaugcugcuuaugcugcuucccaccgcucuggcuuuccaccucacgaccagaggcggggagccucauaugaucgucuccaagcaggaacggggaaagucucugcuuuuuaagaccagcgccggcauuaacaugugcacccugaucgcgauggaccucggggagcugugugaagauacaaugaccuacaaaugcccccgcauuacagaggcugaacccgacgauguugacuguuggugcaaugccaccgauacgugggugaccuauggaacauguucccagaccggcgagcacagacgggacaagcgcucuguggcccuggcuccucaugucgggcucggacuggagacaagaaccgaaacguggaugagcuccgagggcgccuggaaacagauccagaagguggaaacaugggcccuucggcaccccggcuucaccguuacagcccuguuucucgcgcaugccauugggaccucuaucacccagaagggaaucauuuucauccugcuuaugcuggugacaccuagcauggcuaugcgcugcgucggcauugggaacagagauuuuguggagggacucuccggcgccacguggguugacgugguccuggagcacgggagcugugugaccacaauggcuaaagauaagcccacccuggacaucgaacuccugaaaacagaggugaccaauccugccguccuucggaagcugugcauugaagcgaaaaucucuaacacgacaaccgauucccgcuguccgacccagggagaggccacacucguugaagaacaggacagcaauuucgugugcagacggaccuuuguggaucgcggcuggggcaacggguguggacuguucggcaaggggucucuucugacaugcgcuaaguuuaaaugcgucacgaagcucgagggaaaaauugugcaguacgaaaaucugaaguauuccguuaucgugaccguccacacaggcgaccagcaucaaguggggaacgagaccacagaacacggaaccaucgccacgauuacaccccaggcuccuacaagcgagauccagcugaccgacuacggcgcccucacacuggauuguucucccagaaccggccuugacuucaaugaaaugguucugcucacgaugaaagagaaguccuggcuggugcauaaacagugguuucuugaucugccucuccccuggacaagcggggccuccaccucucaagagacauggaaccggcaggaccugcuggucaccuucaagaccgcucacgcgaagaaacaggaaguggucgugcucggaagccaagagggcgccaugcacacagcucugacgggggccaccgaaauucagacauccggaaccacaaccaucuuugccggccaucuuaagugccgccugaaaauggauaagcucacgcugaaagggaugagcuauguuauguguacaggcucuuucaagcuggagaaggaaguggcugagacccagcacggaaccguccuugugcagguuaaauacgagggcacagacgccccgugcaagauuccuuucuccgcgcaagaugaaaaaggggugacccagaauggaagacucaucacagcuaaccccaucgucacggacaaggagaaaccugugaauauugaaaccgagccgcccuuuggcgagagcuauaucgugguuggggccggagaaaaggcccugaagcugucuugguucaaaaagggcagcuccauugggaaaauguuugaggcuacagcccggggcgcuagacgcauggccauccucggagauaccgcgugggacuucggcucuauugggggagucuuuacaagcgugggcaagcuggugcaucaggucuucggggccgcuuacggagugcucuuuuccggcguuagcuggaccaugaaaaucgggaucggcauucugcucacguggcugggacugaacucucgguccaccagccuuucuaugacauguaucgccgugggcauggucacccucuaccugggggugaugguucaggcugauuccggaugcgugauuaauuggaagggcagagaacugaagugugggagcggaaucuucgucacaaacgaggugcacaccuggacagaacaauauaaauuucaggccgacuccccuaagcgccucucugcggccauuggcaaggcuugggaggaggggguuugcggcauccggagcgccaccagacuggaaaacauuauguggaagcagaucuccaaugagcuuaaccauauccugcucgaaaaugacaugaaauucacgguggucgugggagaugcuaacggcauucuggcccaggggaagaaaaugauccgcccgcaacccauggagcaccgguacucuuggaaaagcuggggaaaggccaagauuaucggcgcugacauucaaaauuccacauuuaucaucgaugggccugacacccccgaauguccugaugaccagagagcguggaacauuugggagguggaggauuauggauucggcaucuuuaccacaaauauuuggcugaaacuucgcgacagcuacacccagaugugcgaucaccggcucaugucugccgcuaucaaagacuccaaggccguccaugccgauaugggcuauuggauugaaagcgagaaaaacgaaacguggaagcuggcuagagccucuuucaucgagguuaagacauguaucuggcccaaaucccacacccuguggagcaauggggugcucgaaucugagaugauuaucccgaagauuuacggaggcccuaucagccaacauaacuaucgccccggguacuucacacagaccgcgggaccuuggcaccugggcaaacuugagcuggacuuugaucucugcgaagggacaaccguggucguggacgagcacugcggaaaucggggccccucccugagaacgaccacaguuaccggcaagauuauccaugaaugguguugccggagcuguacacugccuccccuucgcuucagaggggaggacggaugcugguacggcauggagauccggccggugaaagaaaaggaggaaaaccucgucagaucuaugguguccgcugggagcggagagguugauuccuuuucucugggcauucugugugugagcaucaugauugaagaggucaugcgcucccgguggucuagaaagaugcucaugaccgggacgcuggccguguuccuucugcucaucaugggacagcugacauggaaugaccugauucgccuuugcaucaugguuggcgccaacgcuagcgauagaaugggcauggggaccacauaucuggcccucauggcgaccuuuaaaaugcggccuauguucgcugugggacugcucuuucgcagacugaccucccgggagguccuucugcucacaauuggccugucucugguggccagcguggaacuucccaauucccuggaggaacucggggacggacuggccaugggcaucaugaugcucaagcugcuuacggaguuccaaccccaccagcuguggaccacacuccugagccugaccuuuaucaaaacaacccuuucucuggauuacgcuuggcgcacgauggccaugguccucuccauuguuagccuguucccucucugucugucuacaaccucccagaagaccacauggcuuccggugcugcuggggagcuuuggaugcaaaccccucaccauguuccugaucacagaaaacaagauuuggggcagaaagucuuggccucuuaacgagggcaucauggcuauugggaucguguccauccugcucagcucccugcucaaaaaugacgucccccuggccggaccucuuauugcgggcgggaugcugaucgccuguuaugugauuagcggaucuagcgcugaucugucccucgagaaggccgcugaaguuucuugggaggaagaggccgaacauagcggcacgucccacaacauccugguggagguccaggacgaugggaccaugaaaauuaaggacgaggaacgggaugacacacuuaccauccugcucaaagccacacugcucgcugugucuggaguuuaccccaugagcaucccugcgacccuguuugugugguauuucuggcaaaagaaaaagcagcgcuccggcguccuuugggauacgcccucuccgccugagguggaaagagccguccuggacgacggcauuuaccggauccugcagcgcgggcuccugggaagaagccaggugggcguugggguguuccaagauggagucuuucauaccauguggcacgugacacggggcgcuguucuuauguaucaggggaagagacuggagcccuccugggccagcgugaaaaaggaccucauuucuuacggaggcggcuggcgcuuccagggguccuggaauaccggagaggaaguccaggugaucgccguggagccuggcaaaaaccccaagaauguucaaacaaccccggggacauuuaaaacgccugaaggagaggucggcgcuauugcccuggauuucaagcccgggaccagcggaucuccuaucgugaaccgggaaggcaagauugugggccucuacgggaauggagucgugacaaccuccggcaccuauguuagcgcgaucgcucaggccaaaacaucccaggaggggccccugcccgagaucgaagaggaaguguuuaagaaaagaaaccuuacgauuauggaccugcacccuggaucuggcaagacccgccgguaccugccggccaucgucagagaggcuauuaaacgcaagcuccggacacugauccuugcccccaccagagugguugcgagcgaaauggcugaggcccugaaggggaugccuauucgcuaucaaacaaccgccgugaaauccgagcauacgggccgggaaaucgucgaucucaugugccacgcuacauucaccaugagacugcugagccccgugcggguuccuaauuacaacaugaucauuauggacgaggcccauuuuaccgaucccgcuucuaucgccgcgcgcggauauauuuccacaagagugggcaugggggaagccgcugccaucuucaugaccgcuacaccuccgggaagcgucgaggccuuuccccagucuaaugccgugauucaggacgaagaacgggauaucccugagcgcagcuggaacuccggcuacgacuggaucaccgauuuccccgggaagacggugugguuugucccuucuauuaaaagcggaaaugacaucgcuaacugucucagaaagaauggcaaacggguuauucagcuuuccagaaagacauucgacaccgaauaucaaaagacacgcaacaacgauugggacuacguggugaccacggauaucucugagaugggggcgaauuuccgggccgacagagucauugauccccgccggugccugaaaccggugauccugaaggacggcccugaaagaguuauucucgcuggacccaugcccgugaccgucgccagcgccgcucagcgccggggcagaaucgggcgcaaccagaauaaagagggagaucaguacguguauaugggccaaccucugaacaaugacgaggaucacgcccauuggacagaagcgaagaugcuucuggacaacaucaauacccccgaggggauuaucccugcucucuuugaaccggagagagaaaaauccgccgccauugauggagaguaccggcugcgcggcgaggcuagaaagacauucguugaacugaugcggcgcggggaccuccccguguggcuuagcuauaaggucgccucugagggcuuucaguacuccgauagacgguggugcuucgacggagaaagaaacaaucaggugcuggaggaaaacauggacgucgagaucuggaccaaagagggcgaacgcaagaaacugcggccuagauggcucgaugcgcgcacauauagcgacccccuggcccuucgggaguuuaaggaguucgcugccgggagacgguccgugucuggagaucugauucucgagaucggcaaacugccucagcaccugacccuccgcgcucaaaaugcccuugacaaccugguuaugcugcacaauagcgaacaagggggaaaggcuuacagacaugccauggaggagcuccccgauacgaucgaaacacugaugcuucuggcgcucauugccgugcugaccggcggcgugacccuguuuuuccucuccgggaaaggacuuggcaagacaucuaucgggcugcugugugucauggcuagcuccgcccuccuguggauggcuaacguugagccgcacuggauugccgccagcaucauucuugaauuuuuccugauggugcuccugaucccugagcccgaccggcagcgcaccccucaggauaaucaacuggcuuauguggucaucggacuccuuuuuaugauucugacaguggcggccaacgagaugggccugcucgaaacgaccaagaaagaccuggggaucggauacguugcugccgagaaccagcaucacgccacaaugcuugauguggaccugagacccgcuucugccuggacccucuacgcggucgccacaaccgugauuacgccuaugaugcggcacaccaucgaaaauacaaccgcuaacauuucccugacagccaucgcuaaucaggccgcgauucugaugggccucgauaagggcuggcccaucagcaaaauggacaucggggucccgcuucuggcccugggaugcuauucucaagugaacccucucacccugacggcugccguucuuaugcugguggcucauuacgccauuaucggccccgggcuccaggcuaaggccacacgcgaggcgcagaaaagaaccgccgcuggaauuaugaagaaucccacagucgauggcaucguggccauugaccuggacccuguuguguaugaugcuaaguucgaaaaacagcuggggcaaaucaugcuccuuauccuguguaccucccagauucugcucaugcggaccacaugggcccugugcgagagcaucacgcuugccaccggaccgcugacaacccucugggagggcucucccggcaaguuuuggaacacaaccauugcggucagcauggcuaauaucuuccgcggguccuaccuggccggagcuggccuggccuucucucucaugaaaagccuugggggaggcagacgggggacgggagcccagggcgaaacacugggcgagaaguggaaaagacagcugaaccaacucuccaagagcgaauuuaauaccuauaagcgcuccgggauuauggagguggaccggucugaagcuaaagagggacugaagagaggcgagaccacaaaacacgccgugagccgcgggaccgcgaaacuucggugguucguugaaagaaaccuggucaaaccugagggaaaggugaucgaucucggcugugggcgcggaggcugguccuacuauugcgccggccugaagaaagugacagaagucaagggguacacgaaaggaggccccgggcaugaggaaccuauccccauggcuaccuacggauggaaucugguuaagcucuauucuggcaaagacguguuuuucacaccuccggagaagugugauacccuucugugcgacauuggggagagcucccccaacccuacaaucgaagagggacggacccugagagugcucaaaauggucgaacccuggcugcgcggcaaucaguuuuguauuaagauccuuaacccuuacaugcccucugugguugagacgcuggagcagaugcagcggaagcacggcgggaugcucgugagaaauccgcugagccgcaacuccacccaugaaauguauugggucagcugcggaacaggcaauauugugucugccguuaacaugaccucccggaugcugcucaacagauucacaaugacccaccgcaaaccuacauacgagagagauguggaccugggggcuggaacccggcacgucgccguggaacccgagguggcgaaucuugauaucauuggccaacgcaucgaaaacaucaagaaugagcauaaaagcacguggcacuaugacgaggauaaccccuacaagacaugggccuaucaugggucuuacgaagucaaaccuuccggaagcgcuucuuccaugguuaauggcguggugagacugcucaccaagcccugggacgucauuccuauggugacccagaucgccaugacagacacgaccccguuuggccagcaacggguuuucaaggagaaaguggauacaagaacaccccgggcuaagcgcgggacagcccagauuauggaagucaccgcuaaauggcuguggggauuucuuagcagaaacaagaaaccucggaucuguacacgcgaggaguucaccagaaaggugcgguccaaugccgcgauuggcgccguuuuuguggacgagaaccaguggaauagcgcuaaggaggccgucgaagaugagcgcuucugggaccuggugcacagagaacgggagcuccacaaacaggggaagugcgcuacgugcguuuacaacaugaugggaaaacgcgaaaagaaacugggcgaguuugggaaggccaagggcucuagagccaucugguauauguggcugggagcgcgguuccucgaguucgaagcucugggcuuuaugaaugaggaucauugguucagccgcgaaaacuccuuuucugggguggagggagagggccuucacaaacugggguacauccucagagacauuagcaagauccccggaggcaauauguaugccgaugacaccgccgggugggauacacggauuaccgaagacgaucugcaaaacgaggcuaaaaucacagacauuauggaaccugagcaugcccuucuggcuaccuccaucuucaagcucacguaccagaauaaagucgugcgcguccagagacccgccaagaacggcacagugauggauguuaucucucggagagaccagcgcggaagcggccaaguggggaccuauggacugaacacauuuaccaauauggaaguccagcugauucggcagauggaguccgagggcaucuuccucccgucugaacuggagacgccuaaccuugcggaaagagugcugaauuggcucgagaaacacgggaccgaacgccugaagcggauggccauuagcggagacgauugugugguuaagcccguggacgauagauuugcuacagcccuuaucgcucugaacgacaugggcaaaguccgcaaggauauuccucagugggagcccuccaaaggguggaaugacuggcaacaggugccuuucugcagccaucacuuucaccagcucaucaugaaggauggccgggagaucguugugcccuguagaaaccaggacgaacuggucggacgcgcccgggugucucaaggcgcgggguggucccugagagagaccgccugccucggaaaaagcuacgcucagauguggcagcugauguauuuccaucgccgggaucuuagacuggccgcuaaugccauuuguucugcugucccgguggacuggguuccuacaucccggaccacauggagcauccacgcccaucaccaauggaugaccacggaagauaugcucuccguguggaacagagucuggauugaggaaaaucccuggauggaggacaagacacacgugucuagcugggaggaaguucccuaccugggcaagcgcgaggaccaguggugcgggucccuuaucggacugaccgcgcgggccaccugggcuacaaacauucagguggccaucaaucaggucagacgccucauuggcaacgaaaauuaccuggauuauaugaccagcaugaaaagauuuaagaacgagucugacccugagggggcccugugguga

SEQ ID NO: 18740 - RNA, 9879 nt, Artificial Sequence
  derived and/or modified CDS sequence (opt5) from DENV-1__FJ205872__SS-prME
agcgugaccaugcugcucaugcugcuucccaccgcucuggcuuuccaccucacgaccagaggcggggagccucauaugaucgucuccaagcaggaacggggaaaaucucugcuuuuuaagaccagcgccggcauuaacaugugcacccugaucgcgauggaccucggggagcugugugaagauacaaugaccuacaaaugcccccgcauuacagaggcugaacccgacgauguugacuguuggugcaaugccaccgauacgugggugaccuauggaacauguucccagaccggcgagcacagacgggacaagcgcucuguggcccuggcuccucaugucgggcucggacuggagacaagaaccgaaacguggaugagcuccgagggcgccuggaaacagauccagaagguggaaacaugggcccuucggcaccccggcuucaccguuacagccuuuuuccuggcgcaugccauugggaccucuaucacccagaagggaaucauuuuuauccuccugaugcuugugacaccuagcauggcuaugcgcugcgucggcauugggaacagagauuucguggagggacuguccggcgccacguggguugacgugguccucgagcacgggagcugugugaccacaauggcuaaagauaagcccacccuggacaucgaacugcucaaaacagaggugaccaauccugccguccugcggaaacuuugcauugaagcgaaaaucucuaacacgacaaccgauucccgcuguccgacccagggagaggccacacugguugaagaacaggacagcaauuuugugugcagacggaccuucguggaucgcggcuggggcaacggguguggacucuuuggcaaggggucucugcuuacaugcgcuaaguucaaaugcgucacgaagcuggagggaaaaauugugcaguacgaaaaucucaaguauuccguuaucgugaccguccacacaggcgaccagcaucaaguggggaacgagaccacagaacacggaaccaucgccacgauuacaccccaggcuccuacaagcgagauccagcugaccgacuacggcgcccugacacucgauuguucucccagaaccggccuggacuuuaaugaaaugguucuucugacgaugaaagagaaguccuggcucgugcauaaacagugguuccuggaucuuccucugcccuggacaagcggggccuccaccucucaagagacauggaaccggcaggaccuccuggucaccuuuaagaccgcucacgcgaagaaacaggaaguggucgugcugggaagccaagagggcgccaugcacacagcucucacgggggccaccgaaauucagacauccggaaccacaaccaucuucgccggccaucugaagugccgccuuaaaauggauaagcugacgcucaaagggaugagcuauguuauguguacaggcucuuucaagcuggagaaggaaguggcugagacccagcacggaaccguccuggugcagguuaaauacgagggcacagacgccccgugcaagauuccuuuuuccgcgcaagaugaaaaaggggugacccagaauggaagacuuaucacagcuaaccccaucgucacggacaaggagaaaccugugaauauugaaaccgagccgcccuucggcgagagcuauaucgugguuggggccggagaaaaggcccucaagcugucuugguuuaaaaagggcagcuccauugggaaaauguucgaggcuacagcccggggcgcuagacgcauggccauccugggagauaccgcgugggacuuuggcucuauugggggagucuucacaagcgugggcaagcucgugcaucaggucuuuggggccgcuuacggagugcuguucuccggcguuagcuggaccaugaaaaucgggaucggcauucuucugacguggcucggacugaacucucgguccaccagccugucuaugacauguaucgccgugggcauggucacccuuuaccucggggugaugguucaggcugauuccggaugcgugauuaauuggaagggcagagaacugaagugugggagcggaaucuuugucacaaacgaggugcacaccuggacagaacaauauaaauuccaggccgacuccccuaagcgccugucugcggccauuggcaaggcuugggaggaggggguuugcggcauccggagcgccaccagacucgaaaacauuauguggaagcagaucuccaaugagcugaaccauauccuucuggaaaaugacaugaaauuuacgguggucgugggagaugcuaacggcauucucgcccaggggaagaaaaugauccgcccgcaacccauggagcaccgguacucuuggaaaagcuggggaaaggccaagauuaucggcgcugacauucaaaauuccacauucaucaucgaugggccugacacccccgaauguccugaugaccagagagcguggaacauuugggagguggaggauuauggauuuggcaucuucaccacaaauauuuggcugaagcugcgcgacagcuacacccagaugugcgaucaccggcuuaugucugccgcuaucaaagacuccaaggccguccaugccgauaugggcuauuggauugaaagcgagaaaaacgaaacguggaagcucgcuagagccucuuucaucgagguuaagacauguaucuggcccaaaucccacacccuguggagcaauggggugcuggaaucugagaugauuaucccgaagauuuacggaggcccuaucagccaacauaacuaucgccccggguacuuuacacagaccgcgggaccuuggcaccucggcaaacuggagcuugacuucgaucugugcgaagggacaaccguggucguggacgagcacugcggaaaucggggccccucccucagaacgaccacaguuaccggcaagauuauccaugaaugguguugccggagcuguacacugccuccccugcgcuuuagaggggaggacggaugcugguacggcauggagauccggccggugaaagaaaaggaggaaaaccuugucagaucuaugguguccgcugggagcggagagguugauuccuucucucucggcauucugugugugagcaucaugauugaagaggucaugcgcucccgguggucuagaaagaugcugaugaccgggacgcucgccguguuucugcuucugaucaugggacagcucacauggaaugaccugauucgccugugcaucaugguuggcgccaacgcuagcgauagaaugggcauggggaccacauaucuugcccugauggcgaccuucaaaaugcggccuauguuugcugugggacuccuguuccgcagacucaccucccgggagguccugcuucugacaauuggccucucucugguggccagcguggaacugcccaauucccuugaggaacugggggacggacucgccaugggcaucaugaugcugaagcuccugacggaguuucaaccccaccagcuuuggaccacacugcucagccugaccuucaucaaaacaacccugucucuugauuacgcuuggcgcacgauggccaugguccuguccauuguuagccucuuuccucugugucucucuacaaccucccagaagaccacauggcugccggugcuucuggggagcuucggaugcaaaccccugaccauguuucucaucacagaaaacaagauuuggggcagaaagucuuggccucugaacgagggcaucauggcuauugggaucguguccauccuucugagcucccuccugaaaaaugacgucccccucgccggaccucugauugcgggcgggaugcuuaucgccuguuaugugauuagcggaucuagcgcugaucugucccuggagaaggccgcugaaguuucuugggaggaagaggccgaacauagcggcacgucccacaacauccucguggagguccaggacgaugggaccaugaaaauuaaggacgaggaacgggaugacacacugaccauccuucugaaagccacacuccuggcugugucuggaguuuaccccaugagcaucccugcgacccucuucgugugguauuucuggcaaaagaaaaagcagcgcuccggcguccugugggauacgcccucuccgccugagguggaaagagccguccuugacgacggcauuuaccggauccugcagcgcgggcugcucggaagaagccaggugggcguugggguguuucaagauggagucuuccauaccauguggcacgugacacggggcgcuguucugauguaucaggggaagagacuugagcccuccugggccagcgugaaaaaggaccugauuucuuacggaggcggcuggcgcuuucagggguccuggaauaccggagaggaaguccaggugaucgccguggagccuggcaaaaaccccaagaauguucaaacaaccccggggacauucaaaacgccugaaggagaggucggcgcuauugcccucgauuuuaagcccgggaccagcggaucuccuaucgugaaccgggaaggcaagauugugggccuguacgggaauggagucgugacaaccuccggcaccuauguuagcgcgaucgcucaggccaaaacaucccaggaggggccccuccccgagaucgaagaggaaguguucaagaaaagaaaccugacgauuauggaccuucacccuggaucuggcaagacccgccgguaccugccggccaucgucagagaggcuauuaaacgcaagcugcggacacucauccuggcccccaccagagugguugcgagcgaaauggcugaggcccuuaaggggaugccuauucgcuaucaaacaaccgccgugaaauccgagcauacgggccgggaaaucgucgaucugaugugccacgcuacauuuaccaugagacuccugagccccgugcggguuccuaauuacaacaugaucauuauggacgaggcccauuucaccgaucccgcuucuaucgccgcgcgcggauauauuuccacaagagugggcaugggggaagccgcugccaucuuuaugaccgcuacaccuccgggaagcgucgaggccuucccccagucuaaugccgugauucaggacgaggaacgggauaucccugagcgcagcuggaacuccggcuacgacuggaucaccgauuuucccgggaagacggugugguucgucccuucuauuaaaagcggaaaugacaucgcuaacugucugagaaagaauggcaaacggguuauucagcucuccagaaagacauucgacaccgaauaucaaaagacacgcaacaacgauugggacuacguggugaccacggauaucucugagaugggggcgaauuuucgggccgacagagucauugauccccgccggugccuuaaaccggugauccugaaggacggcccugaaagaguuauucuggcuggacccaugcccgugaccgucgccagcgccgcucagcgccggggcagaaucgggcgcaaccagaauaaagagggagaucaguacguguauaugggccaaccucucaacaaugacgaggaucacgcccauuggacagaagcgaagaugcugcuugacaacaucaauacccccgaggggauuaucccugcucuguucgaaccggagagagaaaaauccgccgccauugauggagaguaccggcuccgcggcgaggcuagaaagacauuuguugaacugaugcggcgcggggaccugcccguguggcucagcuauaaggucgccucugagggcuuccaguacuccgauagacgguggugcuuugacggagaaagaaacaaucaggugcuugaggaaaacauggacgucgagaucuggaccaaagagggcgaacgcaagaaacugcggccuagauggcuggaugcgcgcacauauagcgacccccucgcccugcgggaguucaaggaauuugcugccgggagacgguccgugucuggagaucuuauucuggagaucggcaaacucccucagcaccugacccugcgcgcucaaaaugcccucgacaaccuuguuaugcugcacaauagcgaacaagggggaaaggcuuacagacaugccauggaggagcugcccgauacgaucgaaacacucaugcugcuugcgcugauugccgcucucaccggcggcgugacccuguucuuucuguccgggaaaggacucggcaagacaucuaucgggcuucugugugugauggccagcuccgcucugcucuggauggccaacgucgagccgcacuggauugccgcuagcaucauucuggaguucuuucuuaugguucugcucaucccugagcccgaccggcagcgcaccccucaggauaaucaacuggcguauguggugaucggacuccuguucaugauucuuacagucgccgcuaacgagaugggccugcuggaaacgaccaagaaagaccucgggaucggauacguggccgccgagaaccagcaucacgcuacaaugcuggauguugaccuuagacccgccucugcguggacccuguacgccguggcuacaaccgucauuacgccuaugaugcggcacaccaucgaaaauacaaccgccaacauuucccucacagcuaucgccaaucaggcggccauucugaugggccuggauaagggcuggcccaucagcaaaauggacaucggggugccgcuccuugcucugggaugcuauucucaagucaacccucugacccucacggccgcugugcugaugcuuguugcccauuacgcuauuaucggccccgggcugcaggccaaggcgacacgcgaggcccagaaaagaaccgcugccggaauuaugaagaaucccacaguggauggcaucgucgcuauugaccucgacccugugguuuaugaugccaaguuugaaaaacagcuggggcaaaucaugcugcucauccuuuguaccucccagauucugcugaugcggaccacaugggcccucugcgagagcaucacgcuggcgaccggaccgcuuacaacccugugggagggcucucccggcaaguucuggaacacaaccauugcugugagcauggccaauaucuuccgcggguccuaccucgcuggagccggccuggccuuuucucugaugaaaagccucgggggaggcagacgggggacgggagcucagggcgaaacacuuggcgagaaguggaaaagacagcugaaccaacuguccaagagcgaguucaauaccuauaagcgcuccgggauuauggaagucgaccggucugaagccaaagagggacucaagagaggcgagaccacaaaacacgcggugagccgcgggaccgccaagcugcggugguuuguggaaagaaaccuuguuaaaccugagggaaaggucaucgaucugggcugugggcgcggaggcugguccuacuauugcgcuggccucaagaaagugacagaagugaagggguacacgaaaggaggccccgggcaugaggaaccuauccccauggccaccuacggauggaaucuggucaagcuguauucuggcaaagacguuuucuuuacaccuccggagaagugugauacccuccuuugcgacauuggggagagcucccccaacccuacaaucgaagagggacggacccugagagugcugaaaaugguggaacccuggcuccgcggcaaucaguucuguauuaagauccugaacccuuacaugcccucugucguggagacgcuugagcagaugcagcggaagcacggcgggaugcugguuagaaauccgcucagccgcaacuccacccaugaaauguauugggugagcugcggaacaggcaauauugucucugcugugaacaugaccucccggaugcugcugaacagauuuacaaugacccaccgcaaaccuacauacgagagagauguugaccucggggccggaacccggcacguggcggucgaacccgagguggccaaucuggauaucauuggccaacgcaucgaaaacaucaagaaugagcauaaaagcacguggcacuaugacgaggauaaccccuacaagacaugggcuuaucaugggucuuacgaagugaaaccuuccggaagcgccucuuccauggucaauggcguugugagacuucugaccaagcccugggacgugauuccuauggucacccagaucgcuaugacagacacgaccccguucggccagcaacggguguuuaaggagaaaguugauacaagaacaccccgggccaagcgcgggacagcucagauuauggaagugaccgccaaauggcucuggggauuccugagcagaaacaagaaaccucggaucuguacacgcgaggaauuuaccagaaagguccgguccaaugcggccauuggcgcuguguucguugacgagaaccaguggaauagcgccaaggaggcuguggaagaugagcgcuuuugggaccuuguccacagagaacgggagcugcacaaacaggggaagugcgccacgugcguguacaacaugaugggaaaacgcgaaaagaaacucggcgaguucgggaaggccaagggcucuagagcgaucugguauauguggcugggagcucgguuccuggaguuugaagcccucggcuucaugaaugaggaucauugguuuagccgcgaaaacuccuucucugggguugagggagagggccugcacaaacuuggguacauccugagagacauuagcaagauccccggaggcaauauguaugccgaugacaccgcugggugggauacacggauuaccgaagacgaucuccaaaacgaggccaaaaucacagacauuauggaaccugagcaugcucugcuugccaccuccaucuuuaagcugacguaccagaauaaagugguccgcgugcagagacccgcgaagaacggcacagucauggaugugaucucucggagagaccagcgcggaagcggccaaguugggaccuauggacucaacacauucaccaauauggaagugcagcugauucggcagauggaguccgagggcaucuuucugccgucugaacucgagacgccuaaccuggccgaaagaguccuuaauuggcuggagaaacacgggaccgaacgccucaagcggauggcuauuagcggagacgauuguguggugaagcccguugacgauagauucgccacagcucugaucgcccuuaacgacaugggcaaagugcgcaaggauauuccucagugggagcccuccaaaggguggaaugacuggcaacaggucccuuuuugcagccaucacuuccaccagcugaucaugaaggauggccgggagaucgugguucccuguagaaaccaggacgaacucgugggacgcgcgcgggucucucaaggcgccggguggucccugagagagaccgcuugccugggaaaaagcuacgcccagauguggcagcucauguauuuucaucgccgggaucugagacuugcugccaaugcuauuuguucugccgugccggucgacugggugccuacaucccggaccacauggagcauccacgcgcaucaccaauggaugaccacggaagauaugcuguccguuuggaacagaguguggauugaggaaaaucccuggauggaggacaagacacacgucucuagcugggaggaagugcccuaccucggcaagcgcgaggaccaguggugcgggucccugaucggacuuaccgcccgggcuaccugggccacaaacauucagguugccaucaaucaggugagacgccugauuggcaacgaaaauuaccucgauuauaugaccagcaugaaaagauucaagaacgagucugacccugagggggcucugugguga

SEQ ID NO: 18741 - RNA, 9879 nt, Artificial Sequence
  derived and/or modified CDS sequence (opt5) from DENV-1__FJ205873__SS-prME
agcgugaccaugcugcuuaugcugcuucccacagcccuggcuuuccaccucacgaccagaggcggggaaccucauaugaucgucuccaagcaggaacggggaaaaucucugcuuuuuaagacaagcgccggcauuaacaugugcacccugaucgcgauggaccucggggaacugugugaagauacaaugaccuacaaaugccccagaauuacagaggcugaacccgacgauguugacuguuggugcaaugccaccgauacgugggugaccuauggaacauguucccagaccggcgagcacagacgggacaagcgcucuguggcccuggcuccucaugucgggcucggacuggagacaagaaccgaaacguggaugagcuccgagggcgccuggaaacagauccagaagguggaaacaugggcccuucggcaccccggcuucaccguuacagcccuguuucucgcgcaugccauugggaccucuaucacccagaagggaaucauuuucauccugcuuaugcuggugacaccuagcauggcuaugcgcugcgucggcauugggaacagagauuuuguggagggacucuccggcgccacguggguugacgugguccuggagcacgggagcugugugaccacaauggcuaaagauaagcccacccuggacaucgaacuccugaaaacagaggugaccaauccugccguccuucggaagcugugcauugaagcgaaaaucucuaacacgacaaccgauucccgcuguccgacccagggagaggccacacucguugaagaacaagacagcaauuucgugugcagacggaccuuuguggaucgcggcuggggcaacggguguggacuguucggcaaggggucucuucugacaugcgcuaaguuuaaaugcgucacgaagcucgagggaaaaauugugcaguacgaaaaucugaaguauuccguuaucgugaccguccacacaggcgaccagcaucaaguggggaacgagaccacagaacacggaaccaucgccacgauuacaccccaagcuccuaccagcgagauccagcugaccgacuacggcgcccucacacuggauuguucucccagaaccggccuugacuucaaugaaaugguucugcucacgaugaaagagaaguccuggcuggugcauaaacagugguuucuugaucugccucuccccuggacaagcggggccuccaccucucaagagacauggaaccggcaggaccugcuggucaccuucaagaccgcucacgcgaagaaacaggaaguggucgugcucggaagccaagagggcgccaugcacacagcucugacgggggccaccgaaauucagacauccggaaccacaaccaucuuugccggccaucuuaagugccgccugaaaauggauaagcucacgcugaaagggaugagcuauguuauguguacaggcucuuucaagcuggagaaggaaguggcugagacccagcacggaaccguccuugugcagguuaaauacgagggcacagacgccccgugcaagauuccuuucuccgcgcaagaugaaaaaggggugacccagaauggaagacucaucacagcuaaccccaucgucacggacaaggagaaaccugugaauauugaaaccgagccgcccuuuggcgagagcuauaucgugguuggggccggagaaaaggcccugaagcugucuugguucaaaaagggcagcuccauugggaaaauguuugaggcuacagcccggggcgcuagacgcauggccauccucggagauaccgcgugggacuucggcucuauugggggagucuuuacaagcgugggcaagcuggugcaucaggucuucggggccgcuuacggagugcucuuuuccggcguuagcuggaccaugaaaaucgggaucggcauucugcucacguggcugggacugaacucucgguccaccagccuuucuaugacauguaucgccgugggcauggucacccucuaccugggggugaugguucaggcugauuccggaugcgugauuaauuggaagggcagagaacugaagugugggagcggaaucuucgucacaaacgaggugcacaccuggacagaacaauauaaauuucaggccgacuccccuaagcgccucucugcggccauuggcaaggcuugggaggaggggguuugcggcauccggagcgccaccagacuggaaaacauuauguggaagcagaucuccaaugagcuuaaccauauccugcucgaaaaugacaugaaauucacgguggucgugggagaugcuaacggcauucuggcccaggggaagaaaaugauccgcccgcaacccauggagcaccgguacucuuggaaaagcuggggaaaggccaagauuaucggcgcugacauucaaaauuccacauuuaucaucgaugggccugacacccccgaauguccugaugaccagagagcguggaacauuugggagguggaggauuauggauucggcaucuuuaccacaaauauuuggcugaaacuucgcgacagcuacacccagaugugcgaucaccggcucaugucugccgcuaucaaagacuccaaggccguccaugccgauaugggcuauuggauugaaagcgagaaaaacgaaacguggaagcuggcuagagccucuuucaucgagguuaagacauguaucuggcccaaaucccacacccuguggagcaauggggugcucgaaucugagaugauuaucccgaagauuuacggaggcccuaucagccaacauaacuaucgccccggguacuucacacagaccgcgggaccuuggcaccugggcaaacuugagcuggacuuugaucucugcgaagggacaaccguggucguggacgagcacugcggaaaucggggccccucccugagaacgaccacaguuaccggcaagauuauccaugaaugguguugccggagcuguacacugccuccccuucgcuucagaggggaggacggaugcugguacggcauggagauccggccggugaaagaaaaggaggaaaaccucgucagaucuaugguguccgcugggagcggagagguugauuccuuuucucugggcauucugugugugagcaucaugauugaagaggucaugcgcucccgguggucuagaaagaugcucaugaccgggacgcuggccguguuccuucugcucaucaugggacagcugacauggaaugaccugauucgccuuugcaucaugguuggcgccaacgcuagcgauagaaugggcauggggaccacauaucuggcccucauggcgaccuuuaaaaugcggccuauguucgcugugggacugcucuuucgcaagcugaccuccagagagguccuucugcucacaauuggccugucucugguggccagcguggaacuucccaauucccuggaggaacucggggacggacuggccaugggcaucaugaugcucaaacugcuuacggaguuccaaccccaccagcuguggaccacacuccugagccugaccuuuaucaagacaacccuuucucuggauuacgcuuggcggacgauggccaugguccucuccauuguuagccuguucccucucugucugucuacaaccucccagaaaaccacauggcuuccggugcugcuggggagcuuuggaugcaagccccucaccauguuccugaucacagaaaacaagauuuggggccgcaaaucuuggccucuuaacgagggcaucauggcuauugggaucguguccauccugcucagcucccugcucaagaaugacgucccccuggccggaccucuuauugcgggcgggaugcugaucgccuguuaugugauuagcggaucuagcgcugaucugucccucgagaaagccgcugaaguuucuugggaggaagaggccgaacauagcggcacgucccacaacauccugguggagguccaggacgaugggaccaugaagauuaaagacgaggaaagagaugacacacuuaccauccugcucaaggccacacugcucgcugugucuggaguuuaccccaugagcaucccugcgacccuguuugugugguauuucuggcagaagaaaaagcagcgguccggcguccuuugggauacgcccucuccgccugagguggaacgcgccguccuggacgacggcauuuacagaauccugcagcgggggcuccugggacgcagccaggugggcguugggguguuccaagauggagucuuucauaccauguggcacgugacaagaggcgcuguucuuauguaucaggggaaacggcuggagcccuccugggccagcgugaagaaagaccucauuucuuacggaggcggcuggagauuccagggguccuggaauaccggagaggaaguccaggugaucgccguggagccuggcaagaaccccaaaaauguucaaacaaccccggggacauuuaagacgccugaaggagaggucggcgcuauugcccuggauuucaagcccgggaccagcggaucuccuaucgugaaccgcgaaggcaaaguggucggccucuacgggaauggagugguuacaaccuccggcaccuaugugagcgcgauugcucaggccaagacaucccaggaggggccccugcccgagaucgaagaggaagucuuuaaaaagcggaaccuuacgaucauggaccugcacccuggaucuggcaaaaccagacgcuaccugccggccauugugcgggaggcuaucaagagaaagcuccgcacacugauucuugcccccacccggguuguggcgagcgaaauggcugaggcccugaaagggaugccuaucagauaucaaacaaccgccgucaaguccgagcauacgggccgcgaaauuguggaucucaugugccacgcuacauucaccaugcggcugcugagccccguuagagugccuaauuacaacaugaucaucauggacgaggcccauuuuaccgaucccgcuucuauugccgcgcggggauauaucuccacacgcgucggcaugggggaagccgcugccauuuucaugaccgcuacaccuccgggaagcguggaggccuuuccccagucuaaugccgugauccaggacgaagagagagauauuccugagcggagcuggaacuccggcuacgacuggaucaccgauuuccccgggaaaacggucugguuuguuccuucuaucaagagcggaaaugacauugcuaacugucuccgcaaaaauggcaagagagugauccagcuuucccggaagacauucgacaccgaauaucagaaaacaagaaacaacgauugggacuacguggucaccacggauauuucugagaugggggcgaauuuccgcgccgaccgggugaucgaucccagacgcugccugaagccgguuauucugaaagacggcccugaacgggugauccucgcuggacccaugcccgucaccguggccagcgccgcucagagacgcggccggauugggagaaaccagaauaaggagggagaucaguacguuuauaugggccaaccucugaacaaugacgaggaucacgcccauuggacagaagcgaaaaugcuucuggacaacaucaauacccccgaggggaucauuccugcucucuuugaaccggagcgcgaaaaguccgccgccaucgauggagaguacagacugcggggcgaggcucgcaagacauucguggaacugaugagaagaggggaccuccccgucuggcuuagcuauaaaguggccucugagggcuuucaguacuccgaucgcagauggugcuucgacggagaacggaacaaucagguccuggaggaaaacauggacguggagauuuggaccaaggagggcgaacgcaaaaagcugcgcccucgguggcucgaugcgagaacauauagcgacccccuggcccuucgcgaguuuaaagaguucgcugccgggcggagauccguuucuggagaucugauccucgagauuggcaagcugccucagcaccugacccuccgggcucaaaaugcccuugacaaccuggugaugcugcacaauagcgaacaagggggaaaggcuuaccgccaugccauggaggagcuccccgauacgaucgaaacacugaugcuucuggcgcucaucgccgugcugaccggcggcgucacccuguuuuuccucuccgggaagggacuuggcaagacaucuauugggcugcuguguguuauggcuagcuccgcccuccuguggauggcuaacguggagccgcacuggaucgccgccagcauuauccuugaauuuuuccugauggugcuccugauuccugagcccgacagacagcggaccccucaggauaaucaacuggcuuaugucgugaucggacuccuuuuuaugauccugacaguugcggccaacgagaugggccugcucgaaacgaccaaaaaggaccuggggauuggacauguggcugccgagaaccagcaccacgccacaaugcuugaugucgaccugcgccccgcuucugccuggacccucuacgcgguggccacaaccgucaucacgccuaugaugagacauaccauugaaaauacaaccgcuaacaucucccugacagccauugcuaaucaggccgcgauccugaugggccucgauaaaggcuggcccauuagcaagauggacaucggggugccgcuucuggcccugggaugcuacucucaaguuaacccucucacccugacggcugccgugcuuaugcuggucgcucacuaugccaucauuggccccgggcuccaggcuaaagccacacgggaggcgcagaagcgcaccgccgcuggaaucaugaagaaucccacaguggauggcauuguugccaucgaccuggacccuguggucuacgaugcuaaauucgaaaagcagcuggggcaaauuaugcuccuuauccuguguaccucccagauccugcucaugagaaccacaugggcccugugcgagagcauuacgcuugccaccggaccgcugacaacccucugggagggcucucccggcaaauuuuggaacacaaccaucgcggugagcauggcuaauauuuuccggggguccuaucuggccggagcuggccuggccuucucucucaugaaaagccuugggggaggccgcagagggacgggagcccagggcgaaacacugggcgagaaauggaagcggcagcugaaccaacucuccaagagcgaauuuaauaccuacaaaagauccgggaucauggagguggaccgcucugaagcuaaggagggacugaaacggggcgagaccacaaagcaugccguuagcagagggaccgcgaaacuucgcugguucgucgaacggaaccuggugaagccugagggaaaggugauugaucucggcugugggagaggaggcugguccuauuacugcgccggccugaaaaaggucacagaaguuaaaggguauacgaagggaggccccgggcacgaggaaccuauccccauggcuaccuacggauggaaucuggugaaacucuacucuggcaaggacguguuuuucacaccuccggagaaaugugauacccuucugugcgacaucggggagagcucccccaacccuacaauugaagagggacgcacccugcggguccucaagaugguggaacccuggcugagaggcaaucaguuuuguaucaagauucuuaacccuuauaugcccucuguuguggagacgcuggagcagaugcagcgcaaacauggcgggaugcucguccggaauccgcugagcagaaacuccacccacgaaauguacugggugagcugcggaacaggcaauaucguuucugccgugaacaugaccucccgcaugcugcucaaccgguucacaaugacccacagaaagccuacauaugagcgcgaugucgaccugggggcuggaaccagacauguggccguggaacccgaggucgcgaaucuugauauuaucggccaacggauugaaaacaucaaaaaugagcacaagagcacguggcauuacgacgaggauaaccccuauaaaacaugggccuaccacgggucuuaugaaguuaagccuuccggaagcgcuucuuccauggugaauggcgugguccgccugcucaccaagcccugggacgugaucccuaugguuacccagauugccaugacagacacgaccccguuuggccagcaaagaguguucaaagagaaggucgauacacggacccccagagcuaaacgggggacagcccagaucauggaagugaccgcuaaguggcuguggggauuucuuagccgcaacaaaaagccuagaauuuguacacgggaggaguucacccgcaagguuagauccaaugccgcgaucggcgccguguuugucgacgagaaccaguggaauagcgcuaaagaggccguggaagaugagcgguucugggaccugguucaccgcgaaagagagcuccauaagcaggggaaaugcgcuacgugcguguacaacaugaugggaaagcgggagaaaaagcugggcgaguuugggaaggccaaaggcucucgcgccauuugguacauguggcugggagcgagauuccucgaguucgaagcucugggcuuuaugaaugaggaucacugguucagccgggaaaacuccuuuucuggggucgagggagagggccuucauaagcugggguauauccuccgcgacaucagcaaaauucccggaggcaauauguacgccgaugacaccgccgggugggauacaagaaucaccgaagacgaucugcaaaacgaggcuaagauuacagacaucauggaaccugagcacgcccuucuggcuaccuccauuuucaaacucacguaucagaauaaggugguccgggugcagcgccccgccaaaaacggcacaguuauggaugugaucucuagacgggaccagagaggaagcggccaagucgggaccuacggacugaacacauuuaccaauauggaagugcagcugauccgccagauggaguccgagggcauuuuccucccgucugaacuggagacgccuaaccuugcggaacgggugcugaauuggcucgagaagcaugggaccgaaagacugaagcgcauggccaucagcggagacgauuguguugugaaacccgucgacgaucgguuugcuacagcccuuauugcucugaacgacaugggcaaggugagaaaagauaucccucagugggagcccuccaagggguggaaugacuggcaacagguuccuuucugcagccaccacuuucaucagcucauuaugaaagauggccgcgagaucgugguccccugucggaaccaggacgaacuggugggacgggcucgcgucucucaaggcgcgggguggucccugcgggagaccgccugccucggaaagagcuaugcucagauguggcagcugauguacuuccacagacgcgaucuucggcuggccgcuaaugccaucuguucugcugugccgguugacugggugccuacauccagaaccacauggagcauucaugcccaccaccaauggaugaccacggaagauaugcucuccgucuggaaccggguguggaucgaggaaaaucccuggauggaggacaagacacauguuucuagcugggaggaagugcccuaucugggcaaaagagaggaccaguggugcgggucccuuauuggacugaccgcgcgcgccaccugggcuacaaacauccaggucgccauuaaucaggugcggagacucaucggcaacgaaaauuaccuggauuacaugaccagcaugaagcgcuuuaaaaacgagucugacccugagggggcccugugguga

SEQ ID NO: 18742 - RNA, 9879 nt, Artificial Sequence
  derived and/or modified CDS sequence (opt5) from DENV-1__FJ390379__SS-prME
agcgugaccaugcugcuuaugcugcuucccaccgcucuggcuuuccaccucacgaccagaggcggggagccucauaugaucgucuccaagcaggaacggggaaaaucucugcuuuuuaagacaagcgccggcauuaacaugugcacccugaucgcgauggaccucggggagcugugugaagauacaaugaccuacaaaugcccccgcauuacagaggcugaacccgacgauguugacuguuggugcaaugccaccgauacgugggugaccuauggaacauguucccagaccggcgagcacagacgggacaagcgcucuguggcccuggcuccucaugucgggcucggacuggagacaagaaccgaaacguggaugagcuccgagggcgccuggaaacagauccagaagguggaaacaugggcccuucggcaccccggcuucaccguuacagcccuguuucucgcgcaugccauugggaccucuaucacccagaagggaaucauuuucauccugcuuaugcuggugacaccuagcauggcuaugcgcugcgucggcauugggaacagagauuuuguggagggacucuccggcgccacguggguugacgugguccuggagcacgggagcugugugaccacaauggcuaaagauaagcccacccuggacaucgaacuccugaaaacagaggugaccaauccugccguccuucggaagcugugcauugaagcgaaaaucucuaacacgacaaccgauucccgcuguccgacccagggagaggccacacucguugaagaacaggacagcaauuucgugugcagacggaccuuuguggaucgcggcuggggcaacggguguggacuguucggcaaggggucucuucugacaugcgcuaaguuuaaaugcgucacgaagcucgagggaaaaauugugcaguacgaaaaucugaaguauuccguuaucgugaccguccacacaggcgaccagcaucaaguggggaacgagaccacagaacacggaaccaucgccacgauuacaccccaagcuccuaccagcgagauccagcugaccgacuacggcgcccucacacuggauuguucucccagaaccggccuugacuucaaugaaaugguucugcucacgaugaaagagaaguccuggcuggugcauaaacagugguuucuugaucugccucuccccuggacaagcggggccuccaccucucaagagacauggaaccggcaggaccugcuggucaccuucaagaccgcucacgcgaagaaacaggaaguggucgugcucggaagccaagagggcgccaugcacacagcucugacgggggccaccgaaauucagacauccggaaccacaaccaucuuugccggccaucuuaagugccgccugaaaauggauaagcucacgcugaaagggaugagcuauguuauguguacaggcucuuucaagcuggagaaggaaguggcugagacccagcacggaaccguccuugugcagguuaaauacgagggcacagacgccccgugcaagauuccuuucuccgcgcaagaugaaaaaggggugacccagaauggaagacucaucacagcuaaccccaucgucacggacaaggagaaaccugugaauauugaaaccgagccgcccuuuggcgagagcuauaucgugguuggggccggagaaaaggcccugaagcugucuugguucaaaaagggcagcuccauugggaaaauguuugaggcuacagcccggggcgcuagacgcauggccauccucggagauaccgcgugggacuucggcucuauugggggagucuuuacaagcgugggcaagcuggugcaucaggucuucggggccgcuuacggagugcucuuuuccggcguuagcuggaccaugaaaaucgggaucggcauucugcucacguggcugggacugaacucucgguccaccagccuuucuaugacauguaucgccgugggcauggucacccucuaccugggggugaugguucaggcugauuccggaugcgugauuaauuggaagggcagagaacugaagugugggagcggaaucuucgucacaaacgaggugcacaccuggacagaacaauauaaauuucaggccgacuccccuaagcgccucucugcggccauuggcaaggcuugggaggaggggguuugcggcauccggagcgccaccagacuggaaaacauuauguggaagcagaucuccaaugagcuuaaccauauccugcucgaaaaugacaugaaauucacgguggucgugggagaugcuaacggcauucuggcccaggggcgcaagaugauccggccgcaacccauggagcacagauacucuuggaaaagcuggggaaaggccaagauuaucggcgcugacauucaaaauuccacauuuaucaucgaugggccugacacccccgaauguccugaugaccagcgcgcguggaacauuugggagguggaggauuauggauucggcaucuuuaccacaaauauuuggcugaaacuucgggacagcuacacccagaugugcgaucacagacucaugucugccgcuaucaaggacuccaaagccguccaugccgauaugggcuauuggauugaaagcgagaagaacgaaacguggaaacuggcucgcgccucuuucaucgagguuaagacauguaucuggcccaagucccacacccuguggagcaauggggugcucgaaucugagaugauuaucccgaaaauuuacggaggcccuaucagccaacauaacuaucggcccggguacuucacacagaccgcgggaccuuggcaccugggcaaacuugagcuggacuuugaucucugcgaagggacaaccguggucguggacgagcacugcggaaauagaggccccucccugcggacgaccacaguuaccggcaaaauuauccaugaaugguguugccgcagcuguacacugccuccccuuagauucagaggggaagacggaugcugguacggcauggagauccggccggugaaggaaaaagaggaaaaccucguccgcucuaugguguccgcugggagcggagagguugauuccuuuucucugggcauucugugugugagcaucaugauugaagaggucaugcgguccagauggucucgcaagaugcucaugaccgggacgcuggccguguuccuucugcucaucaugggacagcugacauggaaugaccugauuagacuuugcaucaugguuggcgccaacgcuagcgaucggaugggcauggggaccacauaucuggcccucauggcgaccuuuaagaugcgcccuauguucgcugugggacugcucuuuagacggcugaccucccgcgagguccuucugcucacaauuggccugucucugguggccagcguggaacuucccaauucccuggaggaacucggggacggacuggccaugggcaucaugaugcucaaacugcuuacggaguuccaaccccaccagcuguggaccacacuccugagccugaccuuuaucaagacaacccuuucucuggauuacgcuuggagaacgauggccaugguccucuccauuguuagccuguucccucucugucugucuacaaccucccagaaaaccacauggcuuccggugcugcuggggagcuuuggaugcaagccccucaccauguuccugaucacagaaaacaaaauuuggggccggaagucuuggccucuuaacgagggcaucauggcuauugggaucguguccauccugcucagcucccugcucaagaaugacgucccccuggccggaccucuuauugcgggcgggaugcugaucgccuguuaugugauuagcggaucuagcgcugaucugucccucgagaaagccgcugaaguuucuugggaggaagaggccgaacauagcggcacgucccacaacauccugguggagguccaggacgaugggaccaugaagauuaaagacgaggaacgcgaugacacacuuaccauccugcucaaggccacacugcucgcuaucucuggaguguaccccaugagcauuccugcgacccuguuuguuugguauuucuggcagaagaagaaacagagauccggcgugcuuugggauacgcccucuccgccugaggucgaacgggccgugcuggacgacggcaucuaccgcauucugcagagagggcuccugggacggagccaggucggcguggggguuuuccaagauggaguguuucauaccauguggcacgucacaagaggcgcugugcuuauguaucaggggaaacgccuggagcccuccugggccagcguuaagaaagaccucaucucuuacggaggcggcuggcgguuccagggguccuggaauaccggagaggaagugcaggucauugccguggagccuggcaagaaccccaaaaaugugcaaacaaccccggggacauuuaagacgccugaaggagagguuggcgcuaucgcccuggauuucaaacccgggaccagcggaucuccuauugucaacagagaaggcaagaucgugggccucuacgggaauggaguggucacaaccuccggcaccuaugugagcgcgaucgcucaggccaagacaucccaggaggggccccugcccgagauugaagaggaaguuuuuaaaaagcgcaaccuuacgaucauggaccugcacccuggaucuggcaaaacccggagauaccugccggccauugugcgcgaggcuaucaagcggaaacucagaacacugauucuugcccccacccgcgucguggcgagcgaaauggcugaggcccugaaggggaugccuauccgguaucaaacaaccgccguuaaguccgagcauacgggcagagaaaucguggaucucaugugccacgcuacauucaccaugcggcugcugagccccguccgcgugccuaauuacaacaugauuaucauggacgaggcccauuuuaccgaucccgcuucuauugccgcgagaggauauaucuccacacggguuggcaugggggaagccgcugccauuuucaugaccgcuacaccuccgggaagcguggaggccuuuccccagucuaaugccgucauccaggacgaagaacgcgauaucccugagagaagcuggaacuccggcuacgacuggauuaccgauuuccccgggaaaacggugugguuugugccuucuaucaagagcggaaaugacauugcuaacugucuccggaaaaauggcaagagagucauccagcuuucccgcaaaacauucgacaccgaauaucaaaagacacggaacaacgauugggacuacguugugaccacggauauuucugagaugggggcgaauuucagagccgaccgcgugaucgauccccggagaugccugaagccggucauucugaaagacggcccugaacgcgugauccucgcuggacccaugcccguuaccguggccagcgccgcucagcggagaggccgcaucgggagaaaccagaauaaggagggagaucaguacgucuauaugggccaaccucugaacaaugacgaggaucacgcccauuggacagaagcgaaaaugcuucuggacaacauuaauacccccgaggggaucauuccugcucucuuugaaccggagcgggaaaaguccgccgccaucgauggagaguaccgccugagaggcgaggcucggaaaacauucguggaacugaugcgcagaggggaccuccccguuuggcuuagcuauaagguggccucugagggcuuucaguacuccgaucggagauggugcuucgacggagaacgcaacaaucagguccuggaggaaaacauggacguggagauuuggaccaaggagggcgaacggaaaaagcugagaccucgcuggcucgaugcgcggacauauagcgacccccuggcccuuagagaguuuaaagaguucgcugccgggcggcgcuccgucucuggagaucugauccucgagaucggcaagcugccucagcaccugacccucagagcucaaaaugcccuugacaaccuggugaugcugcacaauagcgaacaagggggaaaggcuuaccggcaugccauggaggagcuccccgauacgauugaaacacugaugcuucuggcgcucaucgccguucugaccggcggcgugacccuguuuuuccucuccgggaagggacuuggcaaaacaucuauugggcugcugugugugauggcuagcuccgcccuccuguggauggcuaacgucgagccgcacuggaucgccgccagcauuauccuugaauuuuuccugaugguucuccugaucccugagcccgaccgccagagaaccccucaggauaaucaacuggcuuauguggugauuggacuccuuuuuaugauccugacagucgcggccaacgagaugggccugcucgaaacgaccaagaaggaccuggggauuggacauguggcugccgagaaccagcaccacgccacaaugcuugauguugaccugcggcccgcuucugccuggacccucuacgcgguggccacaaccgucaucacgccuaugaugcgccauaccauugaaaauacaaccgcuaacaucucccugacagccauugcuaaucaggccgcgauccugaugggccucgauaaaggcuggcccaucagcaagauggacauuggggugccgcuucuggcccugggaugcuacucucaagucaacccucucacccugacggcugccgugcuuaugcugguugcucacuaugccaucauuggccccgggcuccaggcuaaagccacaagagaggcgcagaagcggaccgccgcuggaaucaugaaaaaucccacaguggauggcauugucgccaucgaccuggacccugugguuuacgaugcuaaguucgaaaagcagcuggggcaaaucaugcuccuuauucuguguaccucccagauccugcucaugcgcaccacaugggcccugugcgagagcauuacgcuugccaccggaccgcugacaacccucugggagggcucucccggcaaauuuuggaacacaaccaucgcggugagcauggcuaauauuuucagaggguccuaucuggccggagcuggccuggccuucucucucaugaaaagccuugggggaggccggagagggacgggagcccagggcgaaacacugggcgagaaauggaagcgccagcugaaccaacucuccaaaagcgaauuuaauaccuacaagcgguccgggaucauggaggucgacagaucugaagcuaaggagggacugaaacgcggcgagaccacaaagcaugccgugagccgggggaccgcgaaacuuagaugguucguggaacgcaaccugguuaagccugagggaaaagucaucgaucucggcugugggcggggaggcugguccuauuacugcgccggccugaagaaggugacagaagugaaaggguauacgaagggaggccccgggcacgaggaaccuguccccauggcuaccuacggauggaaucugguuaaacucuacucuggcaaggacguguuuuucacaccuccggagaaaugugauacccuucugugcgacauuggggagagcucccccaacccuacaaucgaagagggaagaacccugcgcgugcucaagauggucgaacccuggcugcggggcaaucaguuuuguauuaaaauccuuaacccuuauaugcccucugugguugagacgcuggagcagaugcagagaaagcauggcgggaugcucgugcgcaauccgcugagccggaacuccacccacgaaauguacugggucagcugcggaacaggcaauauugugucugccguuaacaugaccuccagaaugcugcucaaccgcuucacaaugacccacagaaagccuacauaugagcgggauguggaccugggggcuggaacccgccaugucgccguggaacccgagguggcgaaucuugauaucauuggccaaagaaucgaaaacaucaaaaaugagcacaagagcacguggcauuacgacgaggauaaccccuauaaaacaugggccuaccacgggucuuaugaagucaagccuuccggaagcgcuucuuccaugguuaauggcguggugcggcugcucaccaaacccugggacgucauuccuauggugacccagaucgccaugacagacacgaccccguuuggccagcaaagaguuuucaaggagaagguggauacacggacaccccgcgcuaaaagagggacagcccagauuauggaagucaccgcuaaguggcuguggggauuucuuagccggaacaaaaagccucgcaucuguacaagagaggaguucacccggaaagugcgcuccaaugccgcgauuggcgccguuuuuguggacgagaaccaguggaauagcgcuaaggaggccgucgaagaugagagauucugggaccuggugcaccgggaacgcgagcuccauaagcaggggaaaugcgcuacgugcguuuacaacaugaugggaaagagagagaaaaagcugggcgaguuugggaaagccaagggcucucgggccaucugguacauguggcugggagcgcgcuuccucgaguucgaagcucugggcuuuaugaaugaggaucacugguucagcagagaaaacuccuuuucugggguggagggagagggccuucauaagcugggguauauccuccgggacauuagcaaaauccccggaggcaauauguacgccgaugacaccgccgggugggauacacgcauuaccgaagacgaucugcaaaacgaggcuaagaucacagacauuauggaaccugagcacgcccuucuggcuaccuccaucuucaaacucacguaucagaauaaggucgugagaguccagcggcccgccaaaaacggcacagugauggauguuaucucuagacgcgaccagcggggaagcggccaaguggggaccuacggacugaacacauuuaccaauauggaaguccagcugauuagacagauggaguccgagggcaucuuccucccgucugaacuggagacgccuaaccuugcggaacgcgugcuggacuggcucgagaagcaugggaccgaacggcugaaaagaauggccauuagcggagaugacugugugguuaagcccguggaugaccgcuuugcuacagcccuuaucgcucugaaugauaugggcaagguccggaaagacauuccucagugggagcccuccaagggguggaacgauuggcaacaggugccuuucugcagccaccacuuucaucagcucaucaugaaagacggcagagagaucguugugcccugucgcaaucaggaugaacuggucggacgggccagagugucucaaggcgcgggguggucccugcgcgagaccgccugccucggaaagagcuaugcucagauguggcagcugauguacuuccaccggagagaccuucggcuggccgcuaacgccauuuguucugcugucccgguggauuggguuccuacauccagaaccacauggagcauccaugcccaccaccaauggaugaccacggaagacaugcucuccguguggaaucgcgucuggauugaggaaaaccccuggauggaggacaaaacacaugugucuagcugggaggaaguucccuaucugggcaagcgggaggaucaguggugcgggucccuuaucggacugaccgcgagagccaccugggcuacaaauauucagguggccaucaaccagguccgcagacucauuggcaaugaaaacuaccuggacuacaugaccagcaugaagcgguuuaaaaaugagucugauccugagggggcccugugguga

SEQ ID NO: 18743 - RNA, 9879 nt, Artificial Sequence
  derived and/or modified CDS sequence (opt5) from DENV-1__FJ390380__SS-prME
agcgugaccaugcugcugaugcugcuucccaccgcucuggcuuuccaccuuacgaccagaggcggggagccucauaugaucguguccaagcaggaacggggaaagucucugcuuuuuaagaccagcgccggcauuaacaugugcacccugaucgcgauggaccucggggagcugugugaagauacaaugaccuacaaaugcccccgcauuacagaggcugaacccgacgauguugacuguuggugcaaugccaccgauacgugggugaccuauggaacauguucccagaccggcgagcacagacgggacaagcgcucuguggcccuggcuccucaugucgggcucggacuggagacaagaaccgaaacguggaugagcuccgagggcgccuggaaacagauccagaagguggaaacaugggcccuucggcaccccggcuucaccguuacagcccuguuucucgcgcaugccauugggaccucuaucacccagaagggaaucauuuucauccugcuuaugcuggugacaccuagcauggcuaugcgcugcgucggcauugggaacagagauuuuguggagggacucuccggcgccacguggguugacgugguccuggagcacgggagcugugugaccacaauggcuaaagauaagcccacccuggacaucgaacuccugaaaacagaggugaccaauccugccguccuucggaagcugugcauugaagcgaaaaucucuaacacgacaaccgauucccgcuguccgacccagggagaggccacacucguugaagaacaggacagcaauuucgugugcagacggaccuuuguggaucgcggcuggggcaacggguguggacuguucggcaaggggucucuucugacaugcgcuaaguuuaaaugcgucacgaagcucgagggaaaaauugugcaguacgaaaaucugaaguauuccguuaucgugaccguccacacaggcgaccagcaucaaguggggaacgagaccacagaacacggaaccaucgccacgauuacaccccaggcuccuacaagcgagauccagcugaccgacuacggcgcccucacacuggauuguucucccagaaccggccuugacuucaaugaaaugguucugcucacgaugaaagagaaguccuggcuggugcauaaacagugguuucuugaucugccucuccccuggacaagcggggccuccaccucucaagagacauggaaccggcaggaccugcuggucaccuucaagaccgcucacgcgaagaaacaggaaguggucgugcucggaagccaagagggcgccaugcacacagcucugacgggggccaccgaaauucagacauccggaaccacaaccaucuuugccggccaucuuaagugccgccugaaaauggauaagcucacgcugaaagggaugagcuauguuauguguacaggcucuuucaagcuggagaaggaaguggcugagacccagcacggaaccguccuugugcagguuaaauacgagggcacagacgccccgugcaagauuccuuucuccgcgcaagaugaaaaaggggugacccagaauggaagacucaucacagcuaaccccaucgucacggacaaggagaaaccugugaauauugaaaccgagccgcccuuuggcgagagcuauaucgugguuggggccggagaaaaggcccugaagcugucuugguucaaaaagggcagcuccauugggaaaauguuugaggcuacagcccggggcgcuagacgcauggccauccucggagauaccgcgugggacuucggcucuauugggggagucuuuacaagcgugggcaagcuggugcaucaggucuucggggccgcuuacggagugcucuuuuccggcguuagcuggaccaugaaaaucgggaucggcauucugcucacguggcugggacugaacucucgguccaccagccuuucuaugacauguaucgccgugggcauggucacccucuaccugggggugaugguucaggcugauuccggaugcgugauuaauuggaagggcagagaacugaagugugggagcggaaucuucgucacaaacgaggugcacaccuggacagaacaauauaaauuucaggccgacuccccuaagcgccucucugcggccauuggcaaggcuugggaggaggggguuugcggcauccggagcgccaccagacuggaaaacauuauguggaagcagaucuccaaugagcuuaaccauauccugcucgaaaaugacaugaaauucacgguggucgugggagaugcuaacggcauucuggcccaggggaagaaaaugauccgcccgcaacccauggagcaccgguacucuuggaaaagcuggggaaaggccaagauuaucggcgcugacauucaaaauuccacauuuaucaucgaugggccugacacccccgaauguccugaugaccagagagcguggaacauuugggagguggaggauuauggauucggcaucuuuaccacaaauauuuggcugaaacuucgcgacagcuacacccagaugugcgaucaccggcucaugucugccgcuaucaaagacuccaaggccguccaugccgauaugggcuauuggauugaaagcgagaaaaacgaaacguggaagcuggcuagagccucuuucaucgagguuaagacauguaucuggcccaaaucccacacccuguggagcaauggggugcucgaaucugagaugauuaucccgaagauuuacggaggcccuaucagccaacauaacuaucgccccggguacuucacacagaccgcgggaccuuggcaccugggcaaacuugagcuggacuuugaacucugcgaggggacaaccguggucguggaugaacacugcggaaaucggggccccucccugagaacgaccacaguuaccggcaagauuauccaugagugguguugccggagcuguacacugccuccccuucgcuucagaggggaggacggaugcugguacggcauggaaauccggccggugaaagagaaggaagagaaccucgucagaucuaugguguccgcugggagcggagaaguugacuccuuuucucugggcauucugugugugagcaucaugauugaggaggucaugcgcucccgguggucuagaaagaugcucaugaccgggacgcuggugguuuucuuucuucugaucaugggacagcucacauggaaugaucugauucgccugugcaucauggugggcgccaacgccagcgacagaaugggcauggggaccacauaucuugcucugauggccaccuucaaaaugcggccuauguuugcggucggacuccuguuccgcagacucaccucccgggaagugcugcuucugacaauuggccucucucugguggcuagcgucgagcugcccaauucccuugaagaacugggggauggacucgccaugggcaucaugaugcugaagcuccugacggaauuucaaccccaccagcuuuggaccacacugcucagccugaccuucaucaaaacaacccugucucuugacuacgccuggcgcacgauggcuaugguucuguccauugugagccucuuuccucugugucucucuacaaccucccagaagaccacauggcugccggugcuucuggggagcuucggaugcaaaccccugaccauguuucucaucacagagaacaagauuuggggcagaaagucuuggccucugaacgagggcaucauggccauugggaucgucuccauccuucugagcucccuccugaaaaaugaugugccccucgcuggaccucugauugccggcgggaugcuuaucgcguguuauguuauuagcggaucuagcgccgaccugucccuggaaaaggcugccgaggugucuugggaagaggaagcugagcauagcggcacgucccacaacauccucgucgaggugcaggaugacgggaccaugaaaauuaaggaugaggaacgggacgauacacugaccauccuucugaaagccacacuccuggccguuucuggaguguaccccaugagcaucccugcuaccuucuucgucugguauuuuuggcaaaagaaaaagcagcgcuccggcgugcucugggacacgcccucuccgccugaagucgagagagcggugcuggaugacggcauuuaccggauccuucagcgcgggcugcugggaagaagccagguuggcgugggggucuuccaagacggaguguuucauaccauguggcacguuacacggggcgccgugcucauguaucaggggaagagacuggagcccuccugggcuagcgucaaaaaggaucuuauuucuuacggaggcggcuggcgcuuccagggguccuggaauaccggagaagagguccaggugaucgccguugaaccuggcaaaaaccccaagaauguccaaacaaccccggggacauuuaaaacgccugagggagaagugggcgccauugcucuggacuucaagcccgggaccagcggaucuccuaucgugaaccgggagggcaagauugucggccucuacgggaauggagugguuacaaccuccggcaccuaugugagcgccaucgcgcaggcuaaaacaucccaggaggggccccugcccgaaaucgaggaagaggucuuuaagaaaagaaaccucacgauuauggaucugcacccuggaucuggcaagacccgccgguaccuuccggccaucgugagagaagccauuaaacgcaagcugcggacacugauccucgcucccaccagaguuguggccagcgagauggcggaggcucugaaggggaugccuauucgcuaucaaacaaccgccgucaaauccgaacauacgggccgggagaucguggaccuuaugugccacgccacauucaccaugagacugcucagccccguucgggugccuaauuacaacaugaucauuauggaugaagcucauuuuaccgaccccgccucuaucgcugcccgcggauauauuuccacaagagucggcaugggggaggcggccgcuaucuucaugaccgccacaccuccgggaagcguggaggcuuuuccccagucuaaugccgugauucaggaugaggagcgggacaucccugaacgcagcuggaacuccggcuacgauuggaucaccgacuuccccgggaagacggucugguucguuccuucuauuaaaagcggaaaugauaucgccaacugucugagaaagaauggcaaacgggugauucagcuguccagaaagacauuugacaccgaguaucaaaagacacgcaacaacgacugggauuacguggucaccacggacaucucugaaaugggggcuaauuuccgggcggauagagugauugacccccgccggugccucaaaccgguuauccuuaaggauggcccugagagagugauucuggccggacccaugcccgucaccguggcuagcgccgcccagcgccggggcagaaucgggcgcaaccagaauaaagagggagaccaguacguuuauaugggccaaccucugaacaaugaugaagaccacgcucauuggacagaggccaagaugcuccuggauaacaucaauacccccgaagggauuaucccugcgcuuuuugagccggaaagagagaaauccgcugccauugacggagaguaccggcugcgcggcgaagccagaaagacauucguggagcucaugcggcgcggggaucugcccgucuggcugagcuauaagguggcuucugaaggcuuucaguacuccgacagacgguggugcuucgauggagagagaaacaaucagguccucgaagagaacauggacguggagaucuggaccaaagaaggcgagcgcaagaaacuucggccuagauggcuggacgcccgcacauauagcgauccccuggcgcuccgggaauuuaaggaguucgccgcugggagacgguccguuucuggagaccugauucuugaaaucggcaaacugccucagcaccucacccugcgcgcccaaaaugcucuggauaaccucgugaugcuucacaauagcgagcaagggggaaaggccuacagacaugcuauggaggaacugcccgacacgaucgagacacugaugcuccuggcccuuauugcggugcugaccggcggcgucacccucuuuuuccuguccgggaaaggacugggcaagacaucuaucgggcuccuuuguguuauggccagcuccgcucugcuguggauggccaacguggaaccgcacuggauugcugccagcaucauucucgaguuuuuccugauggugcuucugaucccugagcccgaucggcagcgcaccccucaggacaaucaacucgccuaugucgugaucggacugcuguuuaugauucucacaguugcugcgaacgaaaugggccuucuggagacgaccaagaaagaucuggggaucggacauguggccgcugaaaaccagcaccacgccacaaugcucgacgucgaucugagacccgccucugcuuggacccuuuacgccguggcgacaaccgucauuacgccuaugaugcggcauaccaucgagaauacaaccgccaacauuucccugacagcuaucgccaaucaggcugccauucucaugggccuggacaagggcuggcccaucagcaaaauggauaucggggugccgcugcucgcgcuuggaugcuacucucaaguuaacccucugacccugacggccgcugugcucaugcuggucgcccacuaugcuauuaucggccccgggcuucaggccaaggcuacacgcgaagcccagaaaagaaccgcggccggaauuaugaagaaucccacaguggacggcaucguugcuauugaucuggacccuguggucuacgacgccaaguucgagaaacagcucgggcaaaucaugcugcugauccucuguaccucccagauucuucugaugcggaccacaugggcucugugcgagagcaucacgcucgccaccggaccgcugacaacccuuugggaaggcucucccggcaaguucuggaacacaaccauugccgugagcauggcgaauaucuuucgcggguccuaucuggcuggagccggccucgcuuucucucugaugaaaagccucgggggaggcagacgggggacgggagcccagggcgagacacucggcgaaaaguggaaaagacagcuuaaccaacuguccaagagcgaguuuaauaccuacaagcgcuccgggauuauggaaguggaucggucugaggccaaagagggacugaagagaggcgaaaccacaaaacaugcuguuagccgcgggaccgccaagcuccggugguucgucgagagaaaccuggugaaaccugaaggaaaggugaucgaccuuggcugugggcgcggaggcugguccuauuacugcgcgggccugaagaaagucacagagguuaagggguauacgaaaggaggccccgggcacgaggaaccuauccccauggccaccuacggauggaaucucgugaagcuguacucuggcaaagauguguuuuucacaccuccggagaagugugacacccugcucugcgauauuggggaaagcucccccaacccuacaaucgaggaaggacggacccuuagaguccugaaaaugguggagcccuggcugcgcggcaaucaguuuuguauuaagauccucaacccuuauaugcccucuguuguggagacgcuggaacagaugcagcggaagcauggcgggaugcuugucagaaauccgcugagccgcaacuccacccacgagauguacugggugagcugcggaacaggcaauauuguuucugcugugaacaugaccucccggaugcuccugaacagauucacaaugacccaccgcaaaccuacauaugaaagagacgucgaucugggggccggaacccggcauguggcuguggagcccgaagucgccaaucucgacaucauuggccaacgcaucgagaacaucaagaaugagcacaaaagcacguggcauuacgaugaagacaaccccuauaagacaugggcguaccacgggucuuaugagguuaaaccuuccggaagcgccucuuccauggugaauggcguggucagacugcuuaccaagcccugggaugugauuccuaugguuacccagaucgcuaugacagacacgaccccguuuggccagcaacggguguucaaggaaaaagucgacacaagaacaccccgggccaagcgcgggacagcucagauuauggaggugaccgccaaauggcuguggggauuucucagcagaaacaagaaaccucggaucuguacacgcgaagaguucaccagaaagguucgguccaaugcugccauuggcgcgguguuugucgaugagaaccaguggaauagcgccaaggaagcuguggaggacgaacgcuucugggaucugguucacagagagcgggaacuucauaaacaggggaagugcgccacgugcguguacaacaugaugggaaaacgcgagaagaaacugggcgaguucgggaaggcuaagggcucuagagccaucugguacauguggcucggagcccgguuucuggaguucgaggcgcugggcuuuaugaaugaagaccacugguucagccgcgagaacuccuuuucuggggucgagggagaaggccuccauaaacugggguauauccuuagagauauuagcaagauccccggaggcaauauguacgcugacgauaccgccgggugggacacacggauuaccgaggaugaccugcaaaacgaagccaaaaucacagauauuauggagccugaacacgcucuccuggccaccuccaucuucaaacuuacguaucagaauaaagugguccgcgugcagagacccgcuaagaacggcacaguuauggacgugaucucucggagagaucagcgcggaagcggccaagucgggaccuacggacugaacacauuuaccaauauggaggugcagcucauucggcagauggaguccgaaggcaucuuccugccgucugagcuggaaacgccuaaccucgccgagagagugcugaauuggcuugaaaaacaugggaccgagcgccugaagcggauggcgauuagcggagacgacuguguugugaagcccgucgaugacagauuugccacagcucucaucgcccugaacgauaugggcaaagugcgcaaggacauuccucagugggagcccuccaaaggguggaaugauuggcaacagguuccuuucugcagccaccacuuucaucagcuuaucaugaaggacggccgggaaaucgugguccccuguagaaaccaggaugagcuggugggacgcgcucgggucucucaaggcgccggguggucccucagagaaaccgcgugccugggaaaaagcuaugcccagauguggcagcugauguacuuccaccgccgggaccucagacuggcugccaaugcuauuuguucugccgugccgguugauugggugccuacaucccggaccacauggagcauccaugcucaccaccaauggaugaccacggaggacaugcuuuccgucuggaacagaguguggauugaagagaaucccuggauggaggauaagacacauguuucuagcugggaagaggugcccuaucugggcaagcgcgaagaccaguggugcgggucccucaucggacugaccgcccgggcgaccugggccacaaacauucaggucgcuaucaaucaggugagacgccuuauuggcaacgagaauuaccuggacuacaugaccagcaugaaaagauuuaagaacgagucugauccugaaggggcccucugguga

SEQ ID NO: 18744 - RNA, 9879 nt, Artificial Sequence
  derived and/or modified CDS sequence (opt5) from DENV-1__FJ205874__SS-prME
agcgugaccaugcugcucaugcugcuucccacaguccuggccuuccaccucacgaccagaggcggggagccucauaugaucguuggaaagcaggaacggggcaaaucccugcuuuuuaagacaucugcuggggugaacaugugcacccugauugccauggaccucggagagcugugugaagauacaaugaccuacaaaugcccgcgcaucacagaggcggaacccgacgauguggacuguuggugcaaugcuaccgauacgugggucaccuauggcacauguagccaaaccggggagcacagacgggacaagcgcuccguggcccuggccccucauguuggacucggccuggagacaagaaccgaaacguggaugucuagcgagggcgcuuggaaacagauucagaagguggaaacaugggcccuucggcaccccggguucaccgucaucgcuuuuuuccuggcccaugcgauuggaacauccaucacccagaagggcaucauuuuuauccuccugaugcuugugaccccuucuauggccaugcgcugcguugggauuggaaacagagauuucguggagggccugagcggggcuacaugggucgacguggugcucgagcacggauccugugucacgaccauggccaaaaauaagcccacacuggauaucgaacugcucaaaaccgagguuacaaacccugcugugcugcggaagcuuugcauugaagccaaaaucagcaauaccacgacagacucucgcuguccgacccaaggcgaggcgacccugguggaagagcaggaugccaacuuugucugcagacggacauucguggaccgcggcugggggaauggauguggccucuuugggaagggaucccugcuuaccugcgcuaaguucaaaugcguuacaaagcuggagggcaaaauugugcaguacgaaaaccucaaguauagcgucaucgugacgguucacaccggggaucagcaucaagugggaaaugagacaaccgaacacggcacaaucgccaccauuacgccccaggcuccuaccucugagauccagcugacagacuacggcgcccugacccucgacuguucccccagaacagggcuggauuuuaacgaaaugguccuucugaccaugaaagagaagagcuggcucgugcauaaacagugguuccuggaccuuccucugcccuggacgucuggagccuccacaagccaagagaccuggaaucggcaggaucuccuggucacauuuaagaccgcucacgcgaagaaacaggaagugguugugcugggcucccaagagggggccaugcacaccgcucucacaggagccacggaaauucagaccucuggcacaaccacaaucuucgccgggcaucugaagugccgccuuaaaauggacaagcugacccucaaaggcaugagcuaugucauguguacgggauccuucaagcuggagaaggaaguggcugagacacagcacggcaccguucuggugcaggucaaauacgaggggaccgaugccccgugcaagauuccucuuagcacacaagacgaaaaaggagugacccagaacggcagacucaucacagcgaaucccaucgugacggauaaggagaaaccuguuaacauugaaaccgagccccccuuuggggagucuuauaucauugucggagcuggcgaaaaggcccugaagcuguccugguucaaaaaggggagcucuaucggcaaaauguuugaggccacagcucggggagccagacgcauggcuauucucggcgacaccgccugggauuucgggagcaucggaggcguguuuacauccguggggaagcugguccaucagguguucggaaccgcguacggcguucuuuuuucuggggugagcuggacgaugaaaaucggcauuggaauccugcucaccuggcugggccugaauucccggagcgccucucuuuccaugacauguauugcugucgggauggugacccucuaccugggaguuauggugcaggccgacagcggcugcgucaucaacuggaaggggagagaacugaaguguggaucuggcauuuucgugacaaacgagguucacaccuggacagaacaauauaaauuucaggcugauuccccuaagcgccucagcgccgcgaucgggaaagccugggaggagggcgugugcggaguccgguccgcuaccagacuggaaaauauuauguggaagcagaucucuaacgagcuuaaucauauccugcucgaaaacgacaugaaauucacggugguggucggcgacgccaaugggauucuggcucagggaaagaaaaugauccgcccgcaacccauggagcacaaguacagcuggaaguccuggggcaaagccaagauuaucggggccgauauucagaacacaaccuuuaucaucgacggaccugauacccccgaauguccugacgaucagcgggcuuggaauauuugggagguugaggacuauggcuucggcaucuuuacaaccaacauuuggcugaaacuuagagauucuuacacgcagaugugcgaccaccgccucaugagcgcggccaucaaggauuccaaagcugugcaugccgacaugggguauuggauugaaagcgagaagaaugaaacauggcggcuggccagagcuucuuucaucgaggugaagaccuguaucuggcccaaaucccacacacuguggagcaacggaguccucgaaucugagaugauuaucccgaagauuuacggcgggccuaucucccaacauaauuaucgccccggauacuucacccagacagccggcccuuggcaccuggggaaacuugagcuggauuuugaccucugcgaaggaaccacggugguuguggaugagcacugcggcaaccggggccccagccugagaaccacaaccgucacagggaagauuauccaugaaugguguugccggucuuguacccugccuccccuucgcuucagaggagaggacggcugcugguacgggauggagauccggccggugaaagaaaaggaggaaaaucucguuagaagcaugguguccgcgggaagcggcgaggucgacucuuuuucccuggggauucugugucucagcaucaugauugaagaggugaugcgcucccgguggucuagaaagaugcugaugacgggaacacuugcuguuuuccugcuccugaucaugggccagcugaccuggaacgaucuuauucgccugugcaucauggugggcgccaaugccagcgacagaauggggaugggaacaaccuaucucgcucugauggccaccuuuaaaaugcggccuauguucgcggucggccuccuguuucgcagacuuacaucccgggaggugcugcuccugacgauugggcugucucuuguggcuagcgucgaacugcccaacucccucgaggaacugggagauggccucgccauggggaucaugaugcugaagcuucugaccgaguuccaaccccaccagcucuggacaacccugcugucucuuacauuuaucaaaaccacgcugagccucgacuacgccuggaagacaauggcuaugguucuguccauugugagccucuucccucugugucuuucuaccaccucccagaaaacaaccuggcugccggugcugcucggaagcuuuggcugcaagccccugacaauguuccuuaucacggaaaacaagauuuggggccgcaaaucuuggccucugaaugaggggaucauggccauuggaaucgucuccauccuccugagcucucuccugaagaacgaugugccccuugcuggcccucugauugccgggggaaugcugaucgcguguuauguuauuuccggcagcuccgccgaccucagccuggagaaagcugccgaagugucuugggaggaagaggcugaacauagcgggaccucccacaauauccuugucgaggugcaggaugacggaacaaugaagauuaaagaugaggaaagagacgauacccugacaauccuccugaaggccacccuccuggccguuucuggcguguaccccaugagcaucccugcuacgcuuuuugucugguauuucuggcaaaaaaagaagcagcgguccggcgugcugugggacacccccucuccgccugaggucgaacgcgcggugcuggaugacgggauuuacagaauccuccagcggggacugcuuggccgcagccagguuggggugggagucuuccaagacggcguguuucauacaauguggcacguuaccagaggggccgugcugauguaucagggaaaacggcucgagcccuccugggcuucugucaagaaagaucugauuagcuacggcggcggguggagauuccagggauccuggaacacaggcgaggaagugcaggugaucgccguugagccugggaagaaucccaaaaacguccaaaccacaccgggaacguuuaagaccccugaaggcgaggugggggccguggcucucgacuucaagcccggaacaagcggcucuccuauugucaaucgcgaaggcaaaaucguggggcuguacggaaacggcguugugaccaccuccgggacauaugucagcgccauugcgcaggcuaaggccucucaggagggaccccuucccgagaucgaagaugagguguuuaaaaagcggaaucugacgaucauggaccugcacccuggcuccgggaaaaccagacgcuaccucccggccauuguucgggaagcuaucaagagaaagcugcgcacacuuauucuggcccccacccggguggucgcgagcgagauggcugaagcccucaaaggcaugccuaucagauaucaaacaaccgccgugaaguccgagcauacgggacgcgagauuguugaucugaugugccacgcuacauucaccaugcggcugcucucucccgugagagucccuaacuacaauaugaucaucauggacgaagcccauuuuaccgaucccgcuagcauugccgcgcggggcuauaucuccacacgcguggggaugggagaggccgcugccauuuucaugaccgcuacaccuccgggcagcguggaagccuuuccccagucuaacgccgucauccaggacgaggaaagagauauuccugagcgguccuggagcucuggguacgacuggaucaccgauuuccccggaaaaacgguuugguuugugccuagcaucaaguccggcaaugacauugcuaacugucuucgcaaaaaugggaagagagugauccagcugucucggaagacauucgacaccgaguaucaaaaaacaaagaacaacgauugggacuacgucgugaccacggauauuagcgaaaugggcgcgaauuucagagccgaccgcguuaucgauccccggagaugccugaaaccggugauucucaaggacggaccugagcgcgucauccuggcuggccccaugcccgugaccguugccuccgccgcucagcggagagggcgcauuggacggaaccagaauaaagaaggcgaucaguacguguauauggggcaaccucuuaacaaugacgaggaucacgcccauuggacagaggcgaagaugcugcucgacaacaucaauacccccgaaggaaucauuccugcucuguuugagccggaaagagagaagucugccgccaucgauggcgaauaccgccugagaggggaggcucggaaaacauucgucgagcucaugaagcgcggcgaccuucccguguggcugagcuauaaagucgccuccgaaggauuucaguacagcgauagacgguggugcuucgacggcgagcgcaacaaucaggugcuggaagagaacauggacguugaaauuuggaccaaggagggggagagaaaaaagcuccggccuagauggcuggaugcgcgcacauauucugacccccuugcccugcgggaauuuaaagaguucgcugccggaagacgcuccgugagcggcgaucucauccuggaaauugggaagcugccucagcaccucacccuucgggcucaaaaugcccuggacaaccuggugaugcuccacaauuccgagcagggaggcaaggcuuacagacaugccauggaagagcugcccgauacgaucgagacacuuaugcugcucgcgcugaucgccguccugaccggcgggguuaugcucuuuuuccuuucuggaaaaggccuggggaagaccagcauuggacugcucugugugauggcuuccucugcccugcuuuggauggcuagcguggaaccgcacuggaucgccgccuccauuauccuggaguuuuuccucaugguccugcugauuccugaacccgaccggcagcgcacaccucaggauaaccaacucgcuuaugugguuaucggccuucuguuuaugauccugaccguggcggccaaugagauggggcuccuggagacaacgaaaaaggaccuuggaauuggccaugucgcugccgaaaaccaccaccaugugaccaugcuggaugucgaccucagacccgccagcgcuuggacacuguacgccguggcgaccacaguuaucaccccuaugaugcggcacacgauugagaacaccacagccaauaucucucugaccgcuauugccaaccaggcugccauccucaugggccuugauaaaggguggcccauuuccaagauggacaucggagugccgcugcuggcgcucggcugcuacagccaggucaauccucugacacuuaccgccgcugugcugaugcucguugcccauuaugcuaucauugggcccggacugcaagccaaggcuacgcgcgaagcccagaaaagaacagcggccggcaucaugaagaaccccaccguggaugggauugucgcuaucgaccuggacccugugguguacgaugccaaauucgagaagcagcucggacagauuaugcuucugauccuguguacaucucaaauccuccugaugcggaccaccugggcucuuugcgaauccauuacacuggccacgggcccgcucaccacacugugggagggcagccccgggaaauuuuggaauaccacaaucgccguuucuauggcgaacauuuuccgcggaagcuaucuggcuggcgccgggcucgcuuucucccuuaugaagucucugggaggcgggagacggggaaccggcgcccagggcgagacgcugggggaaaaguggaaacgccagcucaaucagcugagcaaguccgaguuuaacacauacaaaagaagcggaaucauggaagucgaccgguccgaggccaaggaaggccuuaaaagaggggagaccaccaagcacgcugugucucgcggaacagccaagcugcggugguucguggagagaaaucucgucaaaccugaaggcaagguuauugaucugggguguggacgcggcggcuggagcuauuacugcgcggggcugaaaaaggugaccgaggugaaaggauauacaaagggcgggcccggacaugaagagccuauccccauggccacguacggcuggaaccucgucaaacuucacuccgggaaggacguguuuuucaccccuccggaaaagugugauacacugcugugcgacaucggagagucuagccccaauccuaccauugaggaaggccggacacucagaguucugaaaaugguggagcccuggcuucgcggcaaccaauuuuguaucaagauucugaauccuuacaugcccuccgucguggaaacccucgagcagaugcagcggagacacgggggaaugcugguucgcaacccgcugucucggaauagcacgcaugagauguauuggguguccugcggcaccgggaacaucgucagcgcugugaauaugacaucuagaaugcuccugaaccgcuucaccauggcccaccggaaaccuacauacgaaagagauguggaccuuggagcuggcacccgccaugucgccguugagcccgaaguggcgaaccuggggauuaucggacagagaauugagaauaucaagaacgaacacaaauccacauggcacuaugaugaggacaaucccuacaagaccugggccuaucauggcagcuacgaggugaagccuucuggcuccgcuagcucuauggucaacggggugguucggcuccugacgaaacccugggaugugaucccuauggucacacaaauugccaugaccgacaccacaccguuuggacagcagcgcguguucaaggaaaaaguugacacgagaaccccccgggcuaagagaggcacagcccaaaucauggaggugaccgcuaaauggcuuugggauuuucugucccggaauaagaagccucgcauuuguacaagagaagaguucauccggaaaguccgcagcaacgccgcgauuggggccguguuuguugacgaaaaucaguggaacuccgcuaaggaggccguggaggaugaaagauucugggaccucguccaccgggagcgcgaacugcauaaacagggaaagugcgcuaccugcguguauaauaugaugggcaaaagagagaagaagcugggggaauuuggcaaagccaagggaagccgggccaucugguacauguggcucggcgcgcgcuuccuggaguucgaggcucuuggguuuaugaacgaagaucacugguucucuagagagaauagccuguccggagucgaaggcgaggggcuccauaaacugggauacauccuucgggacauuucuaagauccccggcgggaacauguaugccgaugacacagccggcugggauacccgcauuacggaggacgaucugcagaaugaagcuaaaaucaccgacauuauggagccugaacacgcccuccuggcuacaagcaucuuuaagcugaccuaccaaaacaaagugguuagagugcagcggcccgccaagaauggaacagucauggaugugaucucccgcagagaccagcggggcucugggcaggugggaaccuauggccucaacacguucacaaacauggagguucaacugauuagacagauggaaagcgaggggaucuuucuuccguccgagcuggaaaccacaaaucucgcggagcgcgugcuggacuggcuugaaaagcacggagucgagcggcugaaaagaauggccauuucuggcgaugacugugugguuaagccuaucgaugaccgcuucgcuaccgcccucauugcucugaacgauauggggaaagugcggaaggacaucccccagugggaaccuagcaaaggcuggaaugauuggcagcaaguccccuuuugcucccaucacuuccaucagcugaucaugaaggacggaagagagauuguggucccuugucgcaaccaggaugagcucgugggccgggccagaguuagccagggggcgggauggucucugcgcgaaacggccugccuuggcaaguccuacgcucaaauguggcagcugauguauuuucaccggagagaccuccgccuggccgcuaaugccaucuguagcgcugugcccgucgauugggugccgaccucucggacaaccugguccauucacgcccaucaccaguggaugacaaccgaggacaugcuuagcguuuggaacagaguguggaucgaagagaauccuuggauggaagacaaaacacaugucuccucuugggaggaggugcccuaccuggggaagcgggaagaucaauggugcggaagccucauuggccugaccgcgagagccacgugggcuacaaacauccagguggccauuaaucagguucgccggcugaucgggaacgagaauuaucucgacuacaugaccuccaugaaaagauucaagaacgaaagcgaucccgagggcgcccugugguga

SEQ ID NO: 18745 - RNA, 9879 nt, Artificial Sequence
  derived and/or modified CDS sequence (opt5) from DENV-1__FJ205875__SS-prME
agcgugaccaugcugcucaugcugcuucccacagcucuggcuuuccaccucacgaccagaggcggggagccucauaugaucgucuccaagcaggaacggggaaagucucugcuuuuuaagacaagcgccggcauuaacaugugcacccugaucgcgauggaccucggggagcugugugaagauacaaugaccuacaaaugccccagaauuacagaggcugaacccgacgauguugacuguuggugcaaugccaccgauacgugggugaccuauggaacauguucccagaccggcgagcacagacgggacaagcgcucuguggcccuggcuccucaugucgggcucggacuggagacaagaaccgaaacguggaugagcuccgagggcgccuggaaacagauccagaagguggaaacaugggcccuucggcaccccggcuucaccguuauugcccuguuucucgcgcaugccaucgggacaucuaucacccagaagggaauuaucuucauucugcuuaugcuggugaccccuagcauggcuaugcgcugcgucggcaucgggaacagagauuuuguggagggacucuccggcgccacauggguugacgugguccuggagcacgggagcugugugacgaccauggcuaaagauaagcccacacuggacauugaacuccugaaaaccgaggugacaaauccugccauccuucggaagcugugcauugaagcgaaaaucucuaacaccacgacagauucccgcuguccgacccaaggagaggccacccucgucgaagaacaggacgcuaauuucguuugcagacggacauuuguggaucgcggcuggggcaacggguguggacuguucggcaaggggagccuucugaccugcgccaaguuuaaaugcgugacaaagcucgagggaaaaaucguccaguacgaaaaucugaaguauucugugauuguuacggugcacaccggcgaccagcaucaagucgggaacgagacaaccgaacacggaacaaucgcuaccauuacgccccaggccccuaccuccgagauccagcugacagacuacggcgcccucacccuggauuguagccccagaacaggccuugacuucaaugaaauggugcugcucaccaugaaagagaagucuuggcugguucauaaacagugguuucuugaucugccucuccccuggacguccggggcuagcacaucccaagagaccuggaaccggcaggaccugcuggugacauucaagaccgcgcacgccaagaaacaggaagucgugguccucggaucucaagagggcgcuaugcacaccgcccugacaggggccacggaaauucagaccagcggaacaaccacaaucuuugcuggccaucuuaagugccgccugaaaauggauaagcucacccugaaagggauguccuaugugauguguacgggcagcuucaagcuggagaaggaaguugccgagacacagcacggaaccgugcuuguccaggugaaauacgagggcaccgacgcgccgugcaagaucccuuucucuacacaagaugaaaaagggguuacccagaauggaagacucauuacagcuaaccccaucgugacggacaaggagaaaccugucaauauugaaaccgagccgcccuuuggcgaguccuauaucguggugggggccggagaaaaggcccugaagcugagcugguucaaaaagggcucuagcauugggaaaauguuugaggcuacagcccggggcgcuagacgcauggccauccucggagauaccgcgugggacuucggcuccaucgggggaguuuuuacaucugucggcaagcuggugcaucagguguucgggaccgccuacggaguccuuuuuagcggcguguccuggacgaugaaaauugggaucggcauucugcucaccuggcugggacugaacagccggucuacaucccuuagcaugaccuguaucgcuguuggcauggugacacucuaccugggggucauggugcaggccgauucuggaugcguuauuaauuggaagggcagagaacugaaguguggguccggaaucuucgugaccaacgagguccacacauggaccgaacaauauaaauuucaggcugacagcccuaagcgccucuccgccgcgauuggcaaagccugggaggagggggugugcggcauccggucugcuacgagacuggaaaacaucauguggaagcagauuagcaaugagcuuaaccauauccugcucgaaaaugacaugaaauucacaguuguggucggagaugccaacggcauucuggcucaggggaagaaaaugauccgcccgcaacccauggagcacaaguacuccuggaagucuuggggaaaagccaagauuaucggcgccgacauccagaauaccaccuuuauuaucgaugggccugacacacccgaauguccugaugaccagcgggcuuggaacauuugggagguggaggauuauggauucggcaucuuuaccacgaauauuuggcugaaacuuagagacagcuacacacagaugugcgaucaccgccucauguccgcggccaucaaggacagcaaagcugugcaugccgauaugggcuauuggaucgaaucugagaagaacgaaaccuggaagcuggcccgggcuuccuucauugaggucaaaacauguaucuggcccaagagccacacccuguggucuaaugggguucucgaauccgagaugauuaucccgaaaauuuacggaggcccuaucagccaacauaacuauagacccggguacuucacacagaccgccggaccuuggcaccugggcaaacuugagcuggacuuugaucucugcgaagggacgaccgugguggucgacgagcacugcggaaaucgcggccccucucugcggacaaccacagugaccggcaaaaucauucaugaaugguguugcagaagcuguacgcugccuccccuucgguuccgcggggaggacggaugcugguacggcauggagaucagaccgguuaaggaaaaggaggaaaaccucgugcgguccauggucagcgcggggucuggagagguggauuccuuuagccugggcauucuguguguuuccaucaugauugaagaggugaugagaucucgcuggagcaaaaagaugcucaugacagggacccuggcugucuuccuucugcucaucaugggacagcugacauggaaugaccugauucggcuuugcaucauggugggcgccaacgccuccgauagaaugggcauggggaccaccuaucuggcucucauggccacauuuaaaaugcgcccuauguucgcgguuggacugcucuuuagacggcugacgucucgcgaggugcuucugcucaccaucggccugagccuggucgcuuccguggaacuucccaauucucuggaggaacucggggacggacuggccaugggcauuaugaugcucaagcugcuuacagaguuccaaccccaccagcuguggaccacacuccugagccugaccuuuaucaaaacgacacuuucccuggauuacgccuggagaaccauggcuauggugcucagcauugucucucuguucccucucugucuguccaccacaagccagaagaccacauggcuuccgguucugcuggggucuuuuggaugcaagccccucacgauguuccugaucaccgaaaacaaaauuuggggccggaaguccuggccucuuaacgagggcaucauggccaucgggauugugagcauccugcucucuucccugcucaaaaaugacgugccccuggcuggaccucuuauugccggcgggaugcugaucgcguguuaugucauuagcggauccagcgccgaucugucucucgagaaggcugccgaagugagcugggaggaagaggcugaacauuccggcacaucucacaacauccugguugaggugcaggacgaugggaccaugaaaaucaaggacgaggaacgcgaugacacacuuaccauucugcucaaagccacgcugcucgccgucagcggaguguaccccauguccaucccugcuacccuguuuguuugguauuucuggcaaaagaagaaacagagaucuggcgugcuuugggauacacccagcccgccugaggucgaacgggcggugcuggacgacggcauuuaccgcauccugcagagagggcuccugggacggucccaggucggcguggggguuuuccaagauggaguguuucauaccauguggcacgucacacgcggcgccgugcuuauguaucaggggaagagacuggagcccucuugggcuagcguuaaaaaggaccucauuuccuacggaggcggcuggcgguuccaggggagcuggucuaccggagaggaagugcaggucaucgccguggagccuggcaaaaaucccaagaacgugcaaacaacgccggggaccuuuaagacaccugaaggagagguuggcgccauugcucuggauuucaaacccgggaccuccggaagcccuaucgucaauagagaaggcaagaucgugggccucuacgggaacggaguggucaccacaucuggcacguauguguccgccauugcgcaggcuaaaaccagccaggaggggccccugcccgagaucgaagacgagguuuuuaagaaacgcaaucuuacaauuauggaucugcacccuggauccggcaagacccggagauaccugccggccaucgugcgcgaagccauuaagcggaaacucagaacacugauccuugcucccacccgcgucguggccucugagauggcggaagcucugaaggggaugccuauccgguaucaaacgacagccguuaaaagcgagcauaccggcagagagauuguggaccucaugugccacgccaccuucacaaugcgccugcugucccccguccgggugccuaacuacaauaugaucauuauggaugaagcucauuuuaccgaccccgccagcaucgcugccagaggauauauuucuacacggguuggcaugggggaggcggccgcuaucuucaugaccgccacgccuccgggauccguggaggcuuuuccccagagcaacgccgucauccaggaugaggaacgcgacauuccugagagaucuuggaauagcggcuacgauuggaucacagacuuccccgggaagaccgugugguuugugccuuccauuaaaucuggaaacgacaucgccaauugucuccggaagaacggcaagcgcgucauucagcuuagcagaaaaacauucgauaccgaguaucaaaagacgaaaaauaacgacugggauuacguugugaccacagacaucuccgaaaugggggcuaacuuccgggcggauagagugauugacccccgccggugccugaagccggucauccugaaagauggcccugagagagugauccucgccggacccaugcccguuaccguggcuucugccgcccagcgccggggcagaauugggcgcaaucagaacaaggaaggagaccaguacgucuauaugggccaaccucugaauaacgaugaggaccacgcucauuggacagaggccaagaugcuucuggauaauaucaacacccccgaagggauuaucccugcgcucuuugagccggaacgggagaaaagcgcugccauugacggagaauacagacugcgcggcgaggccagaaagacauucguggagcugaugcggcgcggggaucuccccguuuggcuuuccuauaaaguggcuagcgaaggcuuucaguacucugacagacgguggugcuucgacggagagcgcaauaaccagguccuggaagagaauauggauguggaaaucuggaccaaggagggcgagcgcaagaagcugcggccuagauggcucgacgcccgcacguauuccgauccccuggcgcuucgggaauuuaaagaguucgccgcugggagacgcagcgucuccggagaccugauccucgaaauuggcaagcugccucagcaccugacacuccgggcccaaaacgcucuugauaaucuggugaugcugcacaacucugagcaagggggaaaggccuacagacaugcuauggaagaacuccccgacaccaucgagacccugaugcuucuggcccucauugcgguucugacaggcggcgugacccuguuuuuccucagcgggaaaggacuuggcaagacauccaucgggcugcugugugugauggccucuagcgcucuccuguggauggccaaugucgaaccgcacuggauugcugccuccaucauccuugaguuuuuccugaugguucuccugauuccugaacccgaucggcagcgcacgccucaggacaaccaacuggccuauguggugaucggacuccuuuuuaugauucugaccgucgcugcgaaugagaugggccugcucgagacaaccaaaaaggaucuggggaucggacauguggccgcugaaaaccaccaccaugccacaaugcuugacguugaucugagacccgccagcgcuuggacccucuacgccguggcgacgaccgucauuacaccuaugaugcggcacaccaucgagaacacaaccgccaauauuucucugacggcuaucgccaaccaggcugccauccugaugggccucgacaaaggcuggcccauuuccaagauggauaucggggugccgcuucuggcgcugggaugcuacagccaggucaauccucucacacugaccgccgcugugcuuaugcugguugcccauuaugcuauuaucggccccgggcuccaagccaaggcuacacgcgaagcccagaaaagaaccgcggccggaauuaugaagaaccccaccguggacggcaucgucgcuaucgaccuggauccugugguuuacgacgccaaauucgagaagcagcuggggcagauuaugcuccuuauccuguguacaucucaaauucugcucaugcggacgaccugggcucugugcgaauccaucacacuugccaccggaccgcugacaacccucugggagggcagccccggcaaauuuuggaauacgacaauugccgugucuauggcgaacaucuuccgcgggagcuaucuggcuggagccggccuggcuuucucccucaugaagucucuugggggaggcagacgggggaccggagcccagggcgagacccugggcgaaaaguggaaacgccagcugaaucagcucagcaaguccgaguuuaacacauacaaaagaagcgggaucauggaagucgaucgguccgaggccaaggaaggacugaaaagaggcgagaccacaaagcacgcugugucucgcgggacggccaaacuucgguggcugguggagagaaaucucguuaaaccugaaggaaaggucauugaccugggcugugggcgcggaggcuggagcuauuacugcgcgggccugaaaaaggugaccgaggugaaaggguauacaaagggaggccccgggcaugaggaaccuauccccauggccaccuacggauggaaccucgucaaacuuuacuccggcaaggauguuuucuuuacaccuccggaaaagugugacacccugcugugcgauauuggggagucuagccccaauccuacgaucgaggaaggacggacccucagagugcugaaaaugguggagcccuggcuucgcggcaaccaauucuguauuaagauccugaauccuuauaugcccuccgucguggaaacacucgagcagaugcagcggaaacacggcgggaugcugguuagaaacccgcugucucgcaauagcacccacgagauguacuggguguccugcggaacaggcaacauugucagcgcugugaauaugaccucucggaugcuccugaacagauuuacaaugguucaucgcaagccuaccuaugaacgggacguggaucuuggggccggaacgagacacgucgcuguggagcccgaaguggccaaccuggacaucaucggccagcgcauugagaauaucaaaaacgaacauaaguccacauggcacuacgaugaggacaaucccuauaagaccugggcguaccacgggagcuaugaggucaaaccuucuggauccgccagcucuaugguuaacggcguggugagacuccugaccaagcccugggacgucauuccuauggugacacaaaucgcuaugacggauaccacaccguucggccagcagcggguuuuuaaagaaaagguggacacccgcacacccagagccaaacgggggaccgcucaaauuauggaggucacagccaaguggcuuuggggauuccuguccagaaauaagaaaccucggaucuguacccgcgaagaguuuacgagaaaggugcggagcaacgcugccaucggcgcgguuuucguggaugaaaaucaguggaacuccgccaaagaggcugucgaggacgaacgcuuuugggaucucgugcauagagagcgggaacugcacaagcaggggaaaugcgcuaccugcguuuacaauaugaugggaaagcgcgagaagaaacugggcgaguucgggaaggccaaaggcagcagagccauuugguacauguggcucggagcccgguuucuggaguucgaggcgcuuggcuucaugaacgaagaccauugguuuucucgcgagaauagcuucuccgggguggaaggagauggccugcacaagcucggguauauccugagagacauuucuaaaauccccggaggcaacauguacgcugaugacacagccgggugggauacccggauuacagaggacgaucuucagaaugaggccaagaucaccgacaucauggaaccugagcaugcucugcucgccacgagcauuuuuaaacugacauaucaaaacaaggucgugcgcguccagagacccgcuaagaauggcaccgugauggacguuaucucccggcgcgaucagagaggaucuggccagguggggacauacggacugaacaccuucacgaacauggaagcccaacucauucggcagauggagagcgaaggcaucuuucugccguccgagcuugagaccccuaaucuggcggaaagaguccucgacuggcuggagaaacacgggacagaacgccuuaagcggauggccauuucuggagaugacuguguggugaaacccguugaugacagauucgcuaccgcccugacagcucucaacgauaugggcaaggugcgcaaagacaucccucagugggagcccagcaagggguggaaugauuggcagcaagucccuuuuugcucccaccauuuccaccagcugaucaugaaggacggccgggaaauugugguucccuguagaaaccaggaugagcuggugggacgcgcccgggucagccagggcgcgggguggucucucagagagaccgccugccugggaaaauccuaugcucaaauguggcagcuuauguacuuucaucgccgggaccugagacucgccgcuaaugccaucuguagcgcugugccggucgacugggugccuacaucucgcaccacgugguccauucacgcccaccaucaguggaugacaaccgaagauaugcugagcguuuggaaccggguguggaucgaggaaaaucccuggauggaggacaagacccacgucuccucuugggaagaggugcccuaucuuggcaaaagagaggaucaauggugcgggagccugauuggacucacagcgcgggccaccugggcuacaaacauccagguugccauuaaucaggugagacgccugaucggcaacgaaaauuaccuggacuacaugacguccaugaagcgguucaaaaacgagagcgauccugaaggggcccucugguga

SEQ ID NO: 18746 - RNA, 9879 nt, Artificial Sequence
  derived and/or modified CDS sequence (opt5) from DENV-1__FJ410173__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcauuaacaugugcacccugaucgcgauggaccucggggagcugugugaagauacaaugaccuacaaaugcccgcgcauuacagaggcugaacccgacgauguugacuguuggugcaaugccaccgauacgugggugaccuauggaacauguucccaaaccggcgagcacagacgggacaagcgcucuguggcccuggcuccucaugucgggcucggacuggagacaagaaccgaaacguggaugagcuccgagggcgccuggaaacagauccagaagguggaaacaugggcucuucggcaccccggcuucaccguuacagcccuguuucucgcgcaugccauugggaccucuaucacccagaagggaaucauuuucauccugcuuaugcuggugacaccuagcauggcuaugcgcugcgucggcauugggaacagagauuuuguggagggacucuccggcgccacguggguugacgugguccuggagcacgggagcugugugaccacaauggcuaaagauaagcccacccuggacaucgaacuccugaaaacagaggugaccaauccugccguccuucggaagcugugcauugaagcgaaaaucucuaacacgacaaccgauucccgcuguccgacccaaggagaggccacacucguugaagagcaggacagcaauuucgugugcagacggaccuuuguggaucgcggcuggggcaacggguguggacuguucggcaaggggucucuucugacaugcgcuaaguuuaaaugcgucacgaagcucgagggaaaaauugugcaguacgaaaaucugaaguauuccguuaucgugaccguccacacaggcgaccagcaucaaguggggaacgagaccacagaacacggaaccaucgccacgauuaccccccaggcuccuacaaccgagauccagcugacagacuacggcgcccucacccuggauuguagccccagaacgggccuugacuucaaugaaaugguucugcucacaaugaaagagaagucuuggcuggugcauaaacagugguuucuugaucugccucuccccuggaccuccggggccagcacaucccaagagaccuggaaccggcaggaccugcuggucaccuucaagacagcucacgcgaagaaacaggaaguggucgugcucggaucucaagagggcgccaugcacacggcucugaccggggccacagaaauucagaccagcggaacaaccacgaucuuugccggccaucuuaagugccgccugaaaauggauaagcucacacugaaagggauguccuauguuauguguaccggcagcuucaagcuggagaaggaaguggcugagacccagcacggaacaguccuugugcagguuaaauacgagggcaccgacgccccgugcaagauuccuuucucugcgcaagaugaaaaaggggugacacagaauggaagacucaucacggcuaaccccaucgucaccgacaaggagaaaccugugaauauugaaacagagccccccuuuggcgaguccuauaucgugguuggggccggagaaaaggcccugaagcugagcugguucaaaaagggcucuagcauugggaaaauguuugaggcuaccgcccggggcgcuagacgcauggccauccucggagauacagcgugggacuucggcuccauugggggagucuuuaccucugugggcaagcuggugcaucaggucuucggggccgcuuacggagugcuuuuuagcggcguuuccuggacgaugaaaaucgggaucggcauucugcucaccuggcugggacugaacagccggucuacaucccuuagcaugaccuguaucgccgugggcauggucacacucuaccugggggugaugguucaggcugauucuggaugcgugauuaauuggaagggcagagaacugaaguguggguccggaaucuucgucaccaacgaggugcacacauggaccgaacaauauaaauuucaggccgacagcccuaagcgccucuccgcggccauuggcaaagcuugggaggaggggguuugcggcauccggucugccacgagacuggaaaacauuauguggaagcagaucagcaaugagcuuaaccauauccugcucgaaaaugacaugaaauucacaguggucgugggagaugcuaacggcauucuggcccaggggaagaaaaugauccgcccgcaacccauggagcaccgguacuccuggaagucuuggggaaaggccaaaauuaucggcgcugacauucagaauagcaccuuuaucaucgaugggccugacacccccgaauguccugaugaccagagagcguggaacauuugggagguggaggauuauggauucggcaucuuuacaaccaauauuuggcugaagcuucgcgacuccuacacgcagaugugcgaucaccggcucaugagcgccgcuaucaaagacucuaaggccguccaugccgauaugggcuauuggauugaauccgagaaaaacgaaacauggaagcuggcuagagccagcuucaucgagguuaagaccuguaucuggcccaaaucucacacacugugguccaauggggugcucgaaagcgagaugauuaucccgaagauuuacggaggcccuaucucucaacauaacuaucgccccggguacuucacccagacagcgggaccuuggcaccugggcaaacuugagcuggacuuugaucucugcgaagggaccacgguggucguggacgagcacugcggaaaucggggccccagccugagaaccacaaccguuacaggcaagauuauccaugaaugguguugccgguccuguacccugccuccccuucgcuucagaggggaggacggaugcugguacggcauggagauccggccggugaaagaaaaggaggaaaaccucgucagaagcauggugucugcuggguccggagagguugauagcuuuucccugggcauucugugugugucuaucaugauugaagaggucaugcgcagccggugguccagaaagaugcucaugacggggacacuggccguguuccuucugcucaucaugggacagcugaccuggaaugaccugauucgccuuugcaucaugguuggcgccaacgcuucugauagaaugggcauggggacaaccuaucuggcccucauggcgaccuuuaaaaugcggccuauguucgcugugggacugcucuuucgcagacugacaagccgggagguccuucugcucacgauuggccugucccugguggccucuguggaacuucccaauagccuggaggaacucggggacggacuggccaugggcaucaugaugcucaagcugcuuaccgaguuccaaccccaccagcuguggacaacccuccugucccugacauuuaucaaaaccacgcuuagccuggauuacgcuuggcgcacaauggccaugguccucucuauuguuucccuguucccucucugucugagcaccaccucucagaagacaaccuggcuuccggugcugcugggguccuuuggaugcaaaccccucacaauguuccugaucacggaaaacaagauuuggggcagaaagagcuggccucuuaacgagggcaucauggcuauugggaucgugucuauccugcucuccagccugcucaaaaaugacgucccccuggccggaccucuuauugcgggcgggaugcugaucgccuguuaugugauuuccggaagcucugcugaucugagccucgagaaggccgcugaaguuuccugggaggaagaggccgaacauucuggcaccagccacaacauccugguggagguccaggacgaugggacaaugaaaauuaaggacgaggaacgggaugacacccuuacaauccugcucaaagccacccugcucgcuguguccggaguuuaccccaugucuaucccugcgacguuuuucgugugguauuucuggcaaaagaaaaagcagcgcagcggcguccugugggauacccccuccccgccugagguggaaagagccguccuugacgacggcauuuaccggauccugcagcgcgggcugcucggaagaucucaggugggcguugggguguuucaagauggagucuuccauacaauguggcacgugacccggggcgcuguucugauguaucaggggaagagacuugagcccagcugggccuccgugaaaaaggaccugauuagcuacggaggcggcuggcgcuuucaggggucuuggaauacaggagaggaaguccaggugaucgccguggagccuggcaaaaaccccaagaauguucaaaccacaccggggacguucaaaaccccugaaggagaggucggcgcuauugcccucgauuuuaagcccgggacauccggaagcccuaucgugaaccgggaaggcaagauugugggccuguacgggaauggagucgugaccaccucuggcacauauguuuccgcgaucgcucaggccaaaacgagccaggaggggccccuccccgagaucgaagaggaaguguucaagaaaagaaaccugaccauuauggaccuucacccuggauccggcaagacacgccgguaccugccggccaucgucagagaggcuauuaaacgcaagcugcggacccucauccuggcccccacaagagugguugcgucugaaauggcugaggcccuuaaggggaugccuauucgcuaucaaaccacggccgugaaaagcgagcauacaggccgggaaaucgucgaucugaugugccacgcuaccuuuaccaugagacuccugucccccgugcggguuccuaauuacaacaugaucauuauggacgaggcccauuucacagaucccgcuagcaucgccgcgcgcggauauauuucuaccagagugggcaugggggaagccgcugccaucuuuaugacagcuaccccuccgggauccgucgaggccuucccccagagcaaugccgugauucaggacgaagagcgggauaucccugagcgcucuuggaacagcggcuacgacuggaucacggauuuucccgggaagacagugugguucgucccuuccauuaaaucuggaaaugacaucgcuaacugucugagaaagaauggcaaacggguuauucagcucagcagaaagaccuucgacacagaauaucaaaagacccgcaacaacgauugggacuacguggugacgaccgauaucuccgagaugggggcgaauuuucgggccgacagagucauugauccccgccggugccuuaaaccggugauccugaaggacggcccugaaagaguuauucuggcuggacccaugcccgugacagucgccucugccgcucagcgccggggcagaaucgggcgcaaccagaauaaagagggagaucaguacguguauaugggccaaccucucaacaaugacgaggaucacgcccauuggaccgaagcgaagaugcugcuugacaacaucaauacacccgaggggauuaucccugcucuguucgaaccggagagagaaaaaagcgccgccauugauggagaguaccggcuccgcggcgaggcuagaaagaccuuuguugaacugaugcggcgcggggaccugcccguguggcucuccuauaaggucgccagcgagggcuuccaguacucugauagacgguggugcuuugacggagaaagaaacaaucaggugcuugaggaaaacauggacgucgagaucuggacaaaagagggcgaacgcaagaaacugcggccuagauggcuggaugcgcgcaccuauuccgacccccucgcccugcgggaguucaaggaauuugcugccgggagacggagcguguccggagaucuuauucuggagaucggcaaacucccucagcaccugacgcugcgcgcucaaaaugcccucgacaaccuuguuaugcugcacaauucugaacaggggggaaaggcuuacagacaugccauggaggagcugcccgauacaaucgaaacccucaugcugcuugcgcugauugccgugcucaccggcggcgugacacuguucuuucugagcgggaaaggacucggcaagaccuccaucgggcuucugugugucauggcuucuagcgcccugcucuggauggcuaacguugagccgcacuggauugccgccuccaucauucuggaauucuuucuuauggugcugcucaucccugagcccgaccggcagcgcacaccucaggauaaucaacuggcuuauguggucaucggacugcucuucaugauucuuacgguggcggccaacgagaugggccugcuggaaaccacaaagaaagaccucgggaucggacauguugcugccgagaaccagcaccacgccaccaugcuggauguggaccuuagacccgcuagcgccuggacacuguacgcggucgccaccacggugauuaccccuaugaugcggcauacaaucgaaaauaccacagcuaacauuucucucaccgccaucgcuaaucaggccgcgauucugaugggccuggauaagggcuggcccaucuccaaaauggacaucggggucccgcuccuugcccugggaugcuacagccaagugaacccucugacgcucacagcugccguucugaugcuuguggcucacuaugccauuaucggccccgggcugcaggcuaaggccacccgcgaggcgcagaaaagaacagccgcuggaauuaugaagaaucccaccgucgauggcaucguggccauugaccucgacccuguuguguacgaugcuaaguuugaaaaacagcuggggcaaaucaugcugcucauccuuuguaccucucagauucugcugaugcggacaacgugggcccucugcgaguccaucacccuggccacaggaccgcuuaccacacugugggagggcagccccggcaaguucuggaacaccacgauugcggucucuauggcuaauaucuuccgcgggagcuaucucgccggagcuggccuggccuuuucccugaugaaaucucucgggggaggcagacgggggacaggagcccagggcgaaacccuuggcgagaaguggaaaagacagcugaaccaacugagcaaguccgaauucaauaccuacaagcgcagcgggauuauggagguggaccgguccgaagcuaaagagggacucaagagaggcgagacaaccaaacaugccgugucucgcgggacagcgaagcugcggugguuuguugaaagaaaccuugucaaaccugagggaaaggugaucgaucugggcugugggcgcggaggcuggagcuauuacugcgccggccucaagaaagugacggaagucaagggguauaccaaaggaggccccgggcacgaggaaccuauccccauggcuacauacggauggaaucugguuaagcuguacuccggcaaagacguguucuuuaccccuccggagaagugugauacacuccuuugcgacauuggggagucuagccccaacccuaccaucgaagagggacggacgcugagagugcugaaaauggucgaacccuggcuccgcggcaaucaguucuguauuaagauccugaacccuuauaugcccuccgugguugagacccuugagcagaugcagcggaagcauggcgggaugcuggugagaaauccgcucucucgcaacagcacacacgaaauguacugggucuccugcggaaccggcaauauugugagcgccguuaacaugacaucucggaugcugcugaacagauuuaccaugacacaccgcaaaccuaccuaugagagagauguggaccucggggcuggaacgcggcaugucgccguggaacccgagguggcgaaucuggauaucauuggccaacgcaucgaaaacaucaagaaugagcacaaauccacauggcauuacgacgaggauaaccccuauaagaccugggccuaccacgggagcuaugaagucaaaccuucuggauccgcuagcucuaugguuaauggcguggugagacuucugaccaagcccugggacgucauuccuauggugacacagaucgccaugacggacaccacaccguucggccagcaacggguuuuuaaggagaaaguggauaccagaacaccccgggcuaagcgcgggaccgcccagauuauggaagucacagcuaaauggcucuggggauuccuguccagaaacaagaaaccucggaucuguacccgcgaggaauuuacgagaaaggugcggagcaaugccgcgauuggcgccguuuucguggacgagaaccaguggaauuccgcuaaggaggccgucgaagaugagcgcuuuugggaccuugugcacagagaacgggagcugcauaaacaggggaagugcgcuaccugcguuuacaacaugaugggaaaacgcgaaaagaaacucggcgaguucgggaaggccaagggcagcagagccaucugguacauguggcugggagcgcgguuccuggaguuugaagcucucggcuucaugaaugaggaucacugguuuucucgcgaaaacagcuucuccgggguggagggagagggccugcauaaacuuggguauauccugagagacauuucuaagauccccggaggcaauauguacgccgaugacacagccgggugggauacccggauuacagaagacgaucuccaaaacgaggcuaaaaucaccgacauuauggaaccugagcacgcccugcuugcuacgagcaucuuuaagcugacauaucagaauaaagucgugcgcguccagagacccgccaagaacggcaccgugauggauguuaucucccggagagaccagcgcggaucuggccaaguggggacauacggacucaacaccuucacgaauauggaaguccagcugauucggcagauggagagcgagggcaucuuucugccguccgaacucgagaccccuaaccuggcggaaagagugcuuaauuggcuggagaaacaugggacagaacgccucaagcggauggccauuucuggagacgauugugugguuaagcccguggacgauagauucgcuaccgcccugaucgcucuuaacgacaugggcaaaguccgcaaggauauuccucagugggagcccagcaaaggguggaaugacuggcaacaggugccuuuuugcucccaccacuuccaucagcugaucaugaaggauggccgggagaucguugugcccuguagaaaccaggacgaacucgucggacgcgcccgggugagccaaggcgcgggguggucucugagagagacagccugccugggaaaauccuaugcucagauguggcagcucauguacuuucaccgccgggaucugagacuugccgcuaaugccauuuguagcgcugucccgguggacuggguuccuaccucucggacaaccugguccauccaugcccaccaccaauggaugacgacagaagauaugcugagcguguggaacagagucuggauugaggaaaaucccuggauggaggacaagacccauguguccucuugggaggaaguucccuaucucggcaagcgcgaggaccaguggugcgggagccugaucggacuuaccgcgcgggccacaugggcuaccaacauucagguggccaucaaucaggucagacgccugauuggcaacgaaaauuaccucgauuacaugacauccaugaaaagauucaagaacgagagcgacccugagggggcccugugguga

SEQ ID NO: 18747 - RNA, 9879 nt, Artificial Sequence
  derived and/or modified CDS sequence (opt5) from DENV-1__FJ410174__SS-prME
agcgugaccaugcugcuuaugcugcuucccacagcucuggcuuuccaccucacgacccggggcggggaaccucauaugaucgucuccaagcaggaacggggaaaaucucugcuuuuuaagacaagcgccggcauuaacaugugcacccugaucgcgauggaccucggggagcugugugaagauacaaugaccuacaaaugccccagaauuacagaggcugaacccgacgauguugacuguuggugcaaugccaccgauacgugggugaccuauggaacauguucccagaccggcgagcacagacgggacaagcgcucuguggcccuggcuccucaugucgggcucggacuggagacaagaaccgaaacguggaugagcuccgagggcgccuggaaacagauccagaagguggaaacaugggcccuucggcaccccggcuucaccguuacagcccuguuucucgcgcaugccauugggaccucuaucacccagaagggaaucauuuucauccugcuuaugcuggugacaccuagcauggcuaugcgcugcgucggcauugggaacagagauuuuguggagggacucuccggcgccacguggguugacgugguccuggagcacgggagcugugugaccacaaucgcuaaagauaagcccacccuggacauugaacuccugaaaacagaggugaccaauccugccguccuucggaagcugugcaucgaagcgaaaauuucuaacacgacaaccgauucccgcuguccgacccaaggagaggccacacucguugaagaacaggacagcaauuucgugugcagacggaccuuuguggaucgcggcuggggcaacggguguggacuguucggcaaggggucucuucugacaugcgcuaaguuuaaaugcgucacgaagcucgagggaaaaaucgugcaguacgaaaaucugaaguauuccguuaucgugaccguccacacaggcgaccagcaucaaguggggaacgagaccacagaacacggaaccauugccacgaucacaccccaggcuccuacaagcgagauucagcugaccgacuacggcgcccucacacuggauuguucucccagaaccggccuugacuucaaugaaaugguucugcucacgaugaaagagaaguccuggcuggugcauaaacagugguuucuugaucugccucuccccuggacaagcggggccuccaccucucaagagacauggaaccggcaggaccugcuggucaccuucaagaccgcucacgcgaagaaacaggaaguggucgugcucggaagccaagagggcgccaugcacacagcucugacgggggccaccgaaauccagacauccggaaccacaaccauuuuugccggccaucuuaagugccgccugaaaauggauaagcucacgcugaaagggaugagcuauguuauguguacaggcucuuucaagcuggagaaggaaguggcugagacccagcacggaaccguccuugugcagguuaaauacgagggcacagacgccccgugcaagaucccuuucuccgcgcaagaugaaaaaggggugacccagaauggaagacucaucacagcuaaccccauugucacggacaaggagaaaccugugaauaucgaaaccgagccgcccuuuggcgagagcuauauugugguuggggccggagaaaaggcccugaagcugucuugguucaaaaagggcagcuccaucgggaaaauguuugaggcuacagcccggggcgcuagacgcauggccauucucggagauaccgcgugggacuucggcucuaucgggggagucuuuacaagcgugggcaagcuggugcaucaggucuucggggccgcuuacggagugcucuuuuccggcguuagcuggaccaugaaaaucgggauuggcauccugcucacguggcugggacugaacucucgguccaccagccuuucuaugacauguauugccgugggcauggucacccucuaccugggggugaugguucaggcugauuccggaugcgugaucaauuggaagggcagagaacugaagugugggagcggaauuuucgucacaaacgaggugcacaccuggacagaacaauauaaauuucaggccgacuccccuaagcgccucucugcggccaucggcaaggcuugggaggaggggguuugcggcauucggagcgccaccagacuggaaaacaucauguggaagcagaucuccaaugagcuuaaccauauucugcucgaaaaugacaugaaauucacgguggucgugggagaugcuaacggcauccuggcccaggggaagaaaaugauucgcccgcaacccauggagcaccgguacucuuggaaaagcuggggaaaggccaaaaucauuggcgcugacauccagaauacaaccuuuaucauugaugggccugacacccccgaauguccugaugaccagagagcguggaacaucugggagguggaggauuauggauucggcauuuuuacaaccaauaucuggcugaaacuucgcgacuccuacacgcagaugugcgaucaccggcucaugagcgccgcuauuaaagacucuaaggccguccaugccgauaugggcuauuggaucgaauccgagaaaaacgaaacauggaagcuggcuagagccagcuucaucgagguuaagaccuguauuuggcccaaaucucacacacugugguccaauggggugcucgaaagcgagaugaucauuccgaagaucuacggaggcccuauuucucaacauaacuaucgccccggguacuucacccagacagcgggaccuuggcaccugggcaaacuugagcuggacuuugaucucugcgaagggaccacgguggucguggacgagcacugcggaaaucggggccccagccugagaaccacaaccguuacaggcaagaucauccaugaaugguguugccgguccuguacccugccuccccuucgcuucagaggggaggacggaugcugguacggcauggagauucggccggugaaagaaaaggaggaaaaccucgucagaagcauggugucugcuggguccggagagguugauagcuuuucccugggcauccugugugugucuauuaugaucgaagaggucaugcgcagccggugguccagaaagaugcucaugacggggacacuggccguguuccuucugcucauuaugggacagcugaccuggaaugaccugauccgccuuugcauuaugguuggcgccaacgcuucugauagaaugggcauggggaucacauaucuggcccucauggcgaccuuuaaaaugcggccuauguucgcugugggacugcucuuucgcagacugaccagccgggagguccuucugcucacaaucggccugucccugguggccucuguggaacuucccaauagccuggaggaacucggggacggacuggccaugggcauuaugaugcucaagcugcuuacggaguuccaaccccaccagcuguggaccacacuccugucccugaccuuuaucaaaacaacccuuagccuggauuacgcuuggcgcacgauggccaugguccucucuauuguuucccuguucccucucugucugagcacaaccucucagaagaccacauggcuuccggugcugcugggguccuuuggaugcaaaccccucaccauguuccugaucacagaaaacaagauuuggggcagaaagagcuggccucuuaacgagggcaucauggcuaucgggauugugucuauccugcucuccagccugcucaaaaaugacgucccccuggccggaccucuuauugcgggcgggaugcugaucgccuguuaugugauuuccggaagcucugcugaucugagccucgagaaggccgcugaaguuuccugggaggaagaggccgaacauucuggcacgagccacaacauccugguggagguccaggacgaugggaccaugaaaaucaaggacgaggaacgggaugacacacuuaccauucugcucaaagccacacugcucgcuguguccggaguuuaccccaugucuaucccugcgacccuguuugugugguauuucuggcaaaagaaaaagcagcgcagcggcguccuuugggauacgcccuccccgccugagguggaaagagccguccuggacgacggcauuuaccggauccugcagcgcgggcuccugggaagaucucaggugggcguugggguguuccaagauggagucuuucauaccauguggcacgugacacggggcgcuguucuuauguaucaggggaagagacuggagcccagcugggccuccgugaaaaaggaccucauuagcuacggaggcggcuggcgcuuccaggggucuuggaauaccggagaggaaguccaggugaucgccguggagccuggcaaaaaccccaagaauguucaaacaaccccggggacauuuaaaacgccugaaggagaggucggcgcuauugcccuggauuucaagcccgggaccuccggaagcccuaucgugaaccgggaaggcaagaucgugggccucuacgggaauggagucgugacaaccucuggcaccuauguuuccgcgauugcucaggccaaaacaagccaggaggggccccugcccgagaucgaagaggaaguguuuaagaaaagaaaccuuacgauuauggaccugcacccuggauccggcaagacccgccgguaccugccggccaucgucagagaggcuauuaaacgcaagcuccggacacugauccuugcccccaccagagugguugcgucugaaauggcugaggcccugaaggggaugccuauccgcuaucaaacaaccgccgugaaaagcgagcauacgggccgggaaauugucgaucucaugugccacgcuacauucaccaugagacugcugucccccgugcggguuccuaauuacaacaugaucauuauggacgaggcccauuuuaccgaucccgcuagcaucgccgcgcgcggauauauuucuacaagagugggcaugggggaagccgcugccaucuucaugaccgcuacaccuccgggauccgucgaggccuuuccccagagcaaugccgugauccaggacgaagaacgggauauuccugagcgcucuuggaacagcggcuacgacuggaucaccgauuuccccgggaagacggugugguuugucccuuccauuaaaucuggaaaugacaucgcuaacugucucagaaagaauggcaaacggguuauucagcuuagcagaaagacauucgacaccgaauaucaaaagaccaagaauaacgauugggacuacguggugaccacggauaucuccgagaugggggcgaauuuccgcgccgaccgggucauugaucccagacgcugccugaagccggugauccugaaagacggcccugaacggguuauccucgcuggacccaugcccgugaccgucgccucugccgcucagagacgcggccggauugggagaaaccagaauaaggagggagaucaguacguguauaugggccaaccucugaacaaugacgaggaucacgcccauuggacagaagcgaaaaugcuucuggacaacaucaauacccccgaggggauuaucccugcucucuuugaaccggagcgcgaaaagagcgccgccauugauggagaguacagacugcggggcgaggcucgcaagacauucguugaacugaugagaagaggggaccuccccguguggcuuuccuauaaagucgccagcgagggcuuucaguacucugaucgcagauggugcuucgacggagaacggaacaaucaggugcuggaggaaaacauggacgucgagaucuggaccaaggagggcgaacgcaagaaacugcgcccucgguggcucgaugcgagaacauauuccgacccccuggcccuucgcgaguuuaaagaguucgcugccgggcggagaagcguguccggagaucugauccucgagauuggcaagcugccucagcaccugacccuccgggcucaaaaugcccuugacaaccugguuaugcugcacaauucugaacaagggggaaaggcuuaccgccaugccauggaggagcuccccgauacgaucgaaacacugaugcuucuggcgcucauugccgugcugaccggcggcgugacccuguuuuuccucagcgggaagggacuuggcaagacauccaucgggcugcugugugucauggcuucuagcgcccuccuguggauggcuaacguugagccgcacuggauugccgccuccaucauccuugaauuuuuccugauggugcuccugauuccugagcccgacagacagcggaccccucaggauaaucaacuggcuuauguggucaucggacuccuuuuuaugauucugacaguggcggccaacgagaugggccugcucgaaacgaccaaaaaggaccuggggaucggacauguugcugccgagaaccagcaccacgccacaaugcuugauguggaccugcgccccgcuagcgccuggacccucuacgcggucgccacaaccgugauuacgccuaugaugagacauaccaucgaaaauacaaccgcuaacauuucucugacagccaucgcuaaucaggccgcgauccugaugggccucgauaaaggcuggcccauuuccaagauggacaucggggucccgcuucuggcccugggaugcuacagccaagugaacccucucacccugacggcugccguucuuaugcugguggcucacuaugccauuaucggccccgggcuccaggcuaaagccacacgggaggcgcagaagcgcaccgccgcuggaauuaugaagaaucccacagucgauggcaucguggccaucgaccuggacccuguuguguacgaugcuaaauucgaaaagcagcuggggcaaauuaugcuccuuauccuguguaccucucagauucugcucaugagaaccacaugggcccugugcgaguccaucacgcuugccaccggaccgcugacaacccucugggagggcagccccggcaaauuuuggaacacaaccauugcggucucuauggcuaauaucuuccgggggagcuaucuggccggagcugcccuggccuucucccucaugaagucucuuggcgggggacgcagaggcacgggggcucagggagaaacacugggcgagaaauggaagcggcagcugaaccaacucagcaaguccgaauuuaauaccuacaaaagaagcggcaucauggagguggaccgcuccgaagccaaggaggggcugaaacggggagagaccacaaagcaugcggugucuagaggcaccgccaaacuucgcugguucguugaacggaaccuggucaagccugaggggaaggugauugaucucggauguggcagagggggauggagcuauuacugcgcuggccugaaaaaggugacagaagucaaaggcuauacgaaagggggacccggccacgaggaaccuauccccauggccaccuacggguggaaucugguuaaacucuacuccggaaaggacguguuuuucacaccuccggagaaaugugauacccuucugugcgacauuggcgagucuagccccaacccuacaaucgaagaggggcgcacccugcgggugcucaagauggucgaacccuggcugagaggaaaucaguuuuguauuaagauccuuaacccuuauaugcccuccgugguugagacgcuggagcagaugcagcgcaaacauggcggcaugcucgugcggaauccgcugucuagaaacagcacccacgaaauguacugggucuccugcgggacaggaaauauugugagcgcuguuaacaugaccucucgcaugcugcucaaccgguucacaaugacccacagaaagccuacauaugagcgcgauguggaccugggcgccgggaccagacaugucgcgguggaacccgagguggccaaucuugauaucaucggacaacggauugaaaacaucaaaaaugagcacaaguccacguggcauuacgacgaggauaaccccuauaaaacaugggcuuaccacggcagcuaugaagucaagccuucuggguccgccagcucuaugguuaauggaguggugcgccugcucaccaagcccugggacgucauuccuauggugacccagaucgcuaugacagacacgaccccguuuggccagcaaagaguuuucaaagagaagguggauacacggacccccagagccaaacggggcacagcucagauuauggaagucaccgccaaguggcuguggggguuucuuucccgcaacaaaaagccuagaaucuguacacgggaggaguucacccgcaaggugagaagcaaugcggccaucggagcuguuuuuguggacgagaaccaguggaacuccgccaaagaggcugucgaagaugagcgguucugggaccuggugcaccgcgaaagagagcuccauaagcagggcaaaugcgccacgugcguuuacaacaugauggggaagcgggagaaaaagcugggagaguuuggcaaggccaaagggagccgcgcgauuugguacauguggcugggcgcuagauuccucgaguucgaagcccugggauuuaugaaugaggaucacugguucucucgggaaaacagcuuuuccggcguggagggggagggacuucauaagcugggcuauauccuccgcgacauuucuaaaauccccgggggaaauauguacgccgaugacaccgcuggcugggauacaagaauuaccgaagacgaucugcaaaacgaggccaagaucacagacaucauggaagcugagcacgcccuucuggcgaccagcauuuucaaacucacguaucagaauaaggucgugcggguccagcgcccugccaaaaacgggacagugauggauguuaucuccagacgggaccagagaggcucuggacaagugggcaccuacgggcugaacacauuuaccaauauggaaguccagcugauucgccagauggagagcgagggaaucuuccuccccuccgaacuggagacgccgaaccuugcugaacgggugcuggacuggcucgagaagcauggcaccgaaagacugaagcgcauggccauuucuggggaugacugugugguuaaaccuguggaugaccgguuugcuacagcccuuaucgcgcugaaugauaugggaaaggucagaaaagacaucccccagugggagccuagcaagggcuggaacgauuggcaacaggugcccuucugcucccaccacuuucaucagcucauuaugaaagacgggcgcgagaucguugugccuugucggaaucaggaugaacuggucggcagagcccgcgugagccaaggagcuggcuggucucugcgggagaccgccugccucgggaaguccuaugcucagauguggcagcugauguacuuccacagacgcgaccuucggcuggccgcuaacgccauuuguagcgcgguccccguggauuggguuccgacaucuagaaccacaugguccauccaugcccaccaccaauggaugaccacggaagacaugcucagcguguggaaucgggucuggauugaggaaaacccuuggauggaggacaagacacauguguccucuugggaggaaguucccuaucugggaaaaagagaggaucaguggugcggcagccuuaucgggcugaccgcucgcgccaccugggccacaaauauucagguggcuaucaaccagguccggagacucaucggaaaugaaaacuaccuggacuacaugaccuccaugaagcgcuuuaaaaaugagagcgaucccgagggcgcccugugguga

SEQ ID NO: 18748 - RNA, 9879 nt, Artificial Sequence
  derived and/or modified CDS sequence (opt5) from DENV-1__FJ410175__SS-prME
agcgugaccaugcugcuuaugcugcuucccacagcucuggcuuuccaccucacgacccggggcggggaaccucauaugaucgucuccaagcaggaacggggaaaaucucugcuuuuuaagacaagcgccggcauuaauaugugcacccugaucgcgauggaccucggggagcugugugaagauacaaugaccuacaaaugccccagaauuacagaggcugaacccgacgauguugacuguuggugcaaugccaccgauacgugggugaccuauggaacauguucccagaccggcgagcacagacgggacaagcgcucuguggcccuggcuccucaugucgggcucggacuggagacaagaaccgaaacguggaugagcuccgagggcgccuggaaacagauccagaagguggaaacaugggcccuucggcaccccggcuucaccguuacagcccuguuucucgcgcaugccauugggaccucuaucacccagaagggaaucauuuucauccugcuuaugcuggugacaccuagcauggcuaugcgcugcgucggcauugggaacagagauuuuguggagggacucuccggcgccacguggguugacgugguccuggagcacgggagcugugugaccacaauggcuaaagauaagcccacccuggacaucgaacuccugaaaacagaggugaccaauccugccguccuucggaagcugugcauugaagcgaaaaucucuaacacgacaaccgauucccgcuguccgacccaaggagaggccacacucguugaagaacaggacagcaauuucgugugcagacggaccuuuguggaucgcggcuggggcaacggguguggacuguucggcaaggggucucuucugacaugcgcuaaguuuaaaugcgucacgaagcucgagggaaaaauugugcaguacgaaaaucugaaguauuccguuaucgugaccguccacacaggcgaccagcaucaaguggggaacgagaccacagaacacggaaccaucgccacgauuacaccccaggcuccuacaagcgagauccagcugaccgacuacggcgcccucacacuggauuguucucccagaaccggccuugacuucaaugaaaugguucugcucacgaugaaagagaaguccuggcuggugcauaaacagugguuucuugaucugccucuccccuggacaagcggggccuccaccucucaagagacauggaaccggcaggaccugcuggucaccuucaagaccgcucacgcgaagaaacaggaaguggucgugcucggaagccaagagggcgccaugcacacagcucugacgggggccaccgaaauucagacauccggaaccacaaccaucuuugccggccaucuuaagugccgccugaaaauggauaagcucacgcugaaagggaugagcuauguuauguguacaggcucuuucaagcuggagaaggaaguggcugagacccagcacggaaccguccuugugcagguuaaauacgagggcacagacgccccgugcaagauuccuuucuccgcgcaagaugaaaaaggggugacccagaauggaagacucaucacagcuaaccccaucgucacggacaaggagaaaccugugaauauugaaaccgagccgcccuuuggcgagagcuauaucgugguuggggccggagaaaaggcccugaagcugucuugguucaaaaagggcagcuccauugggaaaauguuugaggcuacagcccggggcgcuagacgcauggccauccucggagauaccgcgugggacuucggcucuauugggggagucuuuacaagcgugggcaagcuggugcaucaggucuucggggccgcuuacggagugcucuuuuccggcguuagcuggaccaugaaaaucgggaucggcauucugcucacguggcugggacugaacucucgguccaccagccuuucuaugacauguaucgccgugggcauggucacccucuaccugggggugaugguucaggcugauuccggaugcgugauuaauuggaagggcagagaacugaagugugggagcggaaucuucgucacaaacgaggugcacaccuggacagaacaauauaaauuucaggccgacuccccuaagcgccucucugcggccauuggcaaggcuugggaggaggggguuugcggcauccggagcgccaccagacuggaaaacauuauguggaagcagaucuccaaugagcuuaaccauauccugcucgaaaaugacaugaaauucacgguggucgugggagaugcuaacggcauucuggcccaggggaagaaaaugauccgcccgcaacccauggagcaccgguacucuuggaaaagcuggggaaaggccaaaauuaucggcgcugacauucagaauacaaccuuuaucaucgaugggccugacacccccgaauguccugaugaccagagagcguggaacauuugggagguggaggauuauggauucggcaucuuuacaaccaauauuuggcugaaacuucgcgacuccuacacgcagaugugcgaucaccggcucaugagcgccgcuaucaaagacucuaaggccguccaugccgauaugggcuauuggauugaauccgagaaaaacgaaacauggaagcuggcuagagccagcuucaucgagguuaagaccuguaucuggcccaaaucucacacacugugguccaauggggugcucgaaagcgagaugauuaucccgaagauuuacggaggcccuaucucucaacauaacuaucgccccggguacuucacccagacagcgggaccuuggcaccugggcaaacuugagcuggacuuugaucucugcgaagggaccacgguggucguggacgagcacugcggaaaucggggccccagccugagaaccacaaccguuacaggcaagauuauccaugaaugguguugccgguccuguacccugccuccccuucgcuucagaggggaggacggaugcugguacggcauggagauccggccggugaaagaaaaggaggaaaaccucgucagaagcauggugucugcuggguccggagagguugauagcuuuucccugggcauucugugugugucuaucaugauugaagaggucaugcgcagccggugguccagaaagaugcucaugacggggacacuggccguguuccuucugcucaucaugggacagcugaccuggaaugaccugauucgccuuugcaucaugguuggcgccaacgcuucugauagaaugggcauggggacaaccuaucuggcccucauggcgaccuuuaaaaugcggccuauguucgcugugggacugcucuuucgcagacugacaagccgggagguccuucugcucacgauuggccugucccugguggccucuguggaacuucccaauagccuggaggaacucggggacggacuggccaugggcaucaugaugcucaagcugcuuaccgaguuccaaccccaccagcuguggacaacccuccugucccugacauuuaucaaaaccacgcuuagccuggauuacgcuuggcgcacaauggccaugguccucucuauuguuucccuguucccucucugucugagcaccaccucucagaagacaaccuggcuuccggugcugcugggguccuuuggaugcaaaccccucacaauguuccugaucacggaaaacaagauuuggggcagaaagagcuggccucuuaacgagggcaucauggcuauugggaucgugucuauccugcucuccagccugcucaaaaaugacgucccccuggccggaccucuuauugcgggcgggaugcugaucgccuguuaugugauuuccggaagcucugcugaucugagccucgagaaggccgcugaaguuuccugggaggaagaggccgaacauucuggcaccagccacaacauccugguggagguccaggacgaugggacaaugaaaauuaaggacgaggaacgggaugacacccuuacaauccugcucaaagccacccugcucgcuguguccggaguuuaccccaugucuaucccugcgacgcuguuugugugguauuucuggcaaaagaaaaagcagcgcagcggcguccuuugggauacccccuccccgccugagguggaaagagccguccuggacgacggcauuuaccggauccugcagcgcgggcuccugggaagaucucaggugggcguugggguguuccaagauggagucuuucauacaauguggcacgugacccggggcgcuguucuuauguaucaggggaagagacuggagcccagcugggccuccgugaaaaaggaccucauuagcuacggaggcggcuggcgcuuccaggggucuuggaauacaggagaggaaguccaggugaucgccguggagccuggcaaaaaccccaagaauguucaaaccacaccggggacguuuaaaaccccugaaggagaggucggcgcuauugcccuggauuucaagcccgggacauccggaagcccuaucgugaaccgggaaggcaagauugugggccucuacgggaauggagucgugaccaccucuggcacauauguuuccgcgaucgcucaggccaaaacgagccaggaggggccccugcccgagaucgaagaggaaguguuuaagaaaagaaaccuuaccauuauggaccugcacccuggauccggcaagacacgccgguaccugccggccaucgucagagaggcuauuaaacgcaagcuccggacccugauccuugcccccacaagagugguugcgucugaaauggcugaggcccugaaggggaugccuauucgcuaucaaaccacggccgugaaaagcgagcauacaggccgggaaaucgucgaucucaugugccacgcuaccuucaccaugagacugcugucccccgugcggguuccuaauuacaacaugaucauuauggacgaggcccauuuuacagaucccgcuagcaucgccgcgcgcggauauauuucuaccagagugggcaugggggaagccgcugccaucuucaugacagcuaccccuccgggauccgucgaggccuuuccccagagcaaugccgugauucaggacgaagaacgggauaucccugagcgcucuuggaacagcggcuacgacuggaucacggauuuccccgggaagacagugugguuugucccuuccauuaaaucuggaaaugacaucgcuaacugucucagaaagaauggcaaacggguuauucagcuuagcagaaagaccuucgacacagaauaucaaaagaccaaaaacaacgauugggacuacguggugacgaccgauaucuccgagaugggggcgaauuuccgcgccgaccgggucauugaucccagacgcugccugaagccggugauccugaaagacggcccugaacggguuauucucgcuggacccaugcccgugacagucgccucugccgcucagagacgcggccggaucgggagaaaccagaauaaggagggagaucaguacguguauaugggccaaccucugaacaaugacgaggaucacgcccauuggaccgaagcgaaaaugcuucuggacaacaucaauacacccgaggggauuaucccugcucucuuugaaccggagcgcgaaaagagcgccgccauugauggagaguacagacugcggggcgaggcucgcaagaccuucguugaacugaugagaagaggggaccuccccguguggcuuuccuauaaagucgccagcgagggcuuucaguacucugaucgcagauggugcuucgacggagaacggaacaaucaggugcuggaggaaaacauggacgucgagaucuggacaaaggagggcgaacgcaagaaacugcgcccucgguggcucgaugcgagaaccuauuccgacccccuggcccuucgcgaguuuaaagaguucgcugccgggcggagaagcguguccggagaucugauucucgagaucggcaagcugccucagcaccugacgcuccgggcucaaaaugcccuugacaaccugguuaugcugcacaauucugaacaagggggaaaggcuuaccgccaugccauggaggagcuccccgauacaaucgaaacccugaugcuucuggcgcucauugccgugcugaccggcggcgugacacuguuuuuccucagcgggaagggacuuggcaagaccuccaucgggcugcugugugucauggcuucuagcgcccuccuguggauggcuaacguugagccgcacuggauugccgccuccaucauucuugaauuuuuccugauggugcuccugaucccugagcccgacagacagcggacaccucaggauaaucaacuggcuuauguggucaucggacuccuuuuuaugauucugacgguggcggccaacgagaugggccugcucgaaaccaccaaaaaggaccuggggaucggacauguugcugccgagaaccagcaccacgccaccaugcuugauguggaccugcgccccgcuagcgccuggacacucuacgcggucgccaccacggugauuaccccuaugaugagacauacaaucgaaaauaccacagcuaacauuucucugaccgccaucgcuaaucaggccgcgauucugaugggccucgauaaaggcuggcccaucuccaagauggacaucggggucccgcuucuggcccugggaugcuacagccaagugaacccucucacgcugacagcugccguucuuaugcugguggcucacuaugccauuaucggccccgggcuccaggcuaaagccacccgggaggcgcagaagcgcacagccgcuggaauuaugaagaaucccaccgucgauggcaucguggccauugaccuggacccuguuguguacgaugcuaaauucgaaaagcagcuggggcaaaucaugcuccuuauccuguguaccucucagauucugcucaugagaacaacgugggcccugugcgaguccaucacccuugccacaggaccgcugaccacacucugggagggcagccccggcaaauuuuggaacaccacgauugcggucucuauggcuaauaucuuccgggggagcuaucuggccggagcuggccuggccuucucccucaugaagucucuugggggaggccgcagagggacaggagcccagggcgaaacccugggcgagaaauggaagcggcagcugaaccaacucagcaaguccgaauuuaauaccuacaaaagaagcgggauuauggagguggaccgcuccgaagcuaaggagggacugaaacggggcgagacaaccaagcaugccgugucuagagggacagcgaaacuucgcugguucguugaacggaaccuggucaagccugagggaaaggugaucgaucucggcugugggagaggaggcuggagcuauuacugcgccggccugaaaaaggugacggaagucaaaggguauaccaagggaggccccgggcacgaggaaccuauccccauggcuacauacggauggaaucugguuaaacucuacuccggcaaggacguguuuuucaccccuccggagaaaugugauacacuucugugcgacauuggggagucuagccccaacccuaccaucgaagagggacgcacgcugcgggugcucaagauggucgaacccuggcugagaggcaaucaguuuuguauuaagauccuuaacccuuauaugcccuccgugguugagacccuggagcagaugcagcgcaaacauggcgggaugcucgugcggaauccgcugucuagaaacagcacacacgaaauguacugggucuccugcggaaccggcaauauugugagcgccguuaacaugacaucucgcaugcugcucaaccgguucaccaugacacacagaaagccuaccuaugagcgcgauguggaccugggggcuggaacgagacaugucgccguggaacccgagguggcgaaucuugauaucauuggccaacggaucgaaaacaucaaaaaugagcacaaguccacauggcauuacgacgaggauaaccccuauaaaaccugggccuaccacgggagcuaugaagucaagccuucuggauccgcuagcucuaugguuaauggcguggugcgccugcucaccaagcccugggacgucauuccuauggugacacagaucgccaugacggacaccacaccguuuggccagcaaagaguuuucaaagagaagguggauacccggacacccagagcuaaacgggggaccgcccagauuauggaagucacagcuaaguggcuguggggauuucuuucccgcaacaaaaagccuagaaucuguacccgggaggaguucacgcgcaaggugagaagcaaugccgcgauuggcgccguuuuuguggacgagaaccaguggaacuccgcuaaagaggccgucgaagaugagcgguucugggaccuggugcaccgcgaaagagagcuccauaagcaggggaaaugcgcuaccugcguuuacaacaugaugggaaagcgggagaaaaagcugggcgaguuugggaaggccaaaggcagccgcgccaucugguacauguggcugggagcgagauuccucgaguucgaagcucugggcuuuaugaaugaggaucacugguucucucgggaaaacagcuuuuccgggguggagggagagggccuucauaagcugggguauauccuccgcgacauuucuaaaauccccggaggcaauauguacgccgaugacacagccgggugggauaccagaauuacagaagacgaucugcaaaacgaggcucggaucaccgacauuauggaaccugagcacgcccuucuggcuacgagcaucuucaagcucacauaucagaauaaagucgugcgcguccagagacccgccaagaacggcaccgugauggauguuaucucccggagagaccagcgcggaucuggccaaguggggacauacggacugaacaccuuuacgaauauggaaguccagcugauucggcagauggagagcgagggcaucuuccucccguccgaacuggagaccccuaaccuugcggaaagagugcuggacuggcucgagaaacaugggacagaacgccugaagcggauggccauuucuggagaugacugugugguuaagcccguggaugacagauuugcuaccgcccuuaucgcucugaaugauaugggcaaaguccgcaaggacauuccucagugggagcccagcaaaggguggaacgauuggcaacaggugccuuucugcucccaccacuuucaucagcucaucaugaaggacggccgggagaucguugugcccuguagaaaucaggaugaacuggucggacgcgcccgggugagccaaggcgcgggguggucucugagagagacagccugccucggaaaauccuaugcucagauguggcagcugauguacuuccaccgccgggaccuuagacuggccgcuaacgccauuuguagcgcugucccgguggauuggguuccuaccucucggacaaccugguccauccaugcccaccaccaauggaugacgacagaagacaugcucagcguguggaauagagucuggauugaggaaaaccccuggauggaggacaagacccauguguccucuugggaggaaguucccuaucugggcaagcgcgaggaucaguggugcgggagccuuaucggacugaccgcgcgggccacaugggcuaccaauauucagguggccaucaaccaggucagacgccucauuggcaaugaaaacuaccuggacuacaugacauccaugaaaagauuuaagaaugagagcgauccugagggggcccugugguga

SEQ ID NO: 18749 - RNA, 9879 nt, Artificial Sequence
  derived and/or modified CDS sequence (opt5) from DENV-1__FJ562105__SS-prME
agcgugaccaugcugcucaugcugcuucccacaguccuggccuuccaccucacgaccagaggcggggagccucauaugaucguuggaaagcaggaacggggcaaaucccugcuuuuuaagacaucugcuggggugaacaugugcacccugauugccauggaccucggagagcugugugaagauacaaugaccuacaaaugcccgcgcaucacagaggcggaacccgacgauguggacuguuggugcaaugcuaccgauacgugggucaccuauggcacauguagccaaaccggggagcacagacgggacaagcgcuccguggcccuggccccucauguuggacucggccuggagacaagaaccgaaacguggaugucuagcgagggcgcuuggaaacagauucagaagguggaaacaugggcccuucggcaccccggguucaccgucaucgcuuuuuuccuggcccaugcgauuggaacauccaucacccagaagggcaucauuuuuauccuccugaugcuugugaccccuucuauggccaugcgcugcguugggauuggaaacagagauuucguggagggccugagcggggcuacaugggucgacguggugcucgagcacggauccugugucacgaccauggccaaaaauaagcccacacuggauaucgaacugcucaaaaccgagguuacaaacccugcugugcugcggaagcuuugcauugaagccaaaaucagcaauaccacgacagacucucgcuguccgacccaaggcgaggcgacccugguggaagagcaggaugccaacuuugucugcagacggacauucguggaccgcggcugggggaauggauguggccucuuugggaagggaucccugcuuaccugcgcuaaguucaaaugcguuacaaagcuggagggcaaaauugugcaguacgaaaaccucaaguauagcgucaucgugacgguucacaccggggaucagcaucaagugggaaaugagacaaccgaacacggcacaaucgccaccauuacgccccaggcuccuaccucugagauccagcugacagacuacggcgcccugacccucgacuguucccccagaacagggcuggauuuuaacgaaaugguccuucugaccaugaaagagaagagcuggcucgugcauaaacagugguuccuggaccuuccucugcccuggacgucuggagccuccacaagccaagagaccuggaaucggcaggaucuccuggucacauuuaagaccgcucacgcgaagaaacaggaagugguugugcugggcucccaagagggggccaugcacaccgcucucacaggagccacggaaauucagaccucuggcacaaccacaaucuucgccgggcaucugaagugccgccuuaaaauggacaagcugacccucaaaggcaugagcuaugucauguguacgggauccuucaagcuggagaaggaaguggcugagacacagcacggcaccguucuggugcaggucaaauacgaggggaccgaugccccgugcaagauuccucuuagcacacaagacgaaaaaggagugacccagaacggcagacucaucacagcgaaucccaucgugacggauaaggagaaaccuguuaacauugaaaccgagccccccuuuggggagucuuauaucauugucggagcuggcgaaaaggcccugaagcuguccugguucaaaaaggggagcucuaucggcaaaauguuugaggccacagcucggggagccagacgcauggcuauucucggcgacaccgccugggauuucgggagcaucggaggcguguuuacauccguggggaagcugguccaucagguguucggaaccgcguacggcguucuuuuuucuggggugagcuggacgaugaaaaucggcauuggaauccugcucaccuggcugggccugaauucccggagcgccucucuuuccaugacauguauugcugucgggauggugacccucuaccugggaguuauggugcaggccgacagcggcugcgucaucaacuggaaggggagagaacugaaguguggaucuggcauuuucgugacaaacgagguucacaccuggacagaacaauauaaauuucaggcugauuccccuaagcgccucagcgccgcgaucgggaaagccugggaggagggcgugugcggaguccgguccgcuaccagacuggaaaauauuauguggaagcagaucucuaacgagcuuaaucauauccugcucgaaaacgacaugaaauucacggugguggucggcgacgccaaugggauucuggcucagggaaagaaaaugauccgcccgcaacccauggagcacaaguacagcuggaaguccuggggcaaagccaagauuaucggggccgauauucagaacacaaccuuuaucaucgacggaccugauacccccgaauguccugacgaucagcgggcuuggaauauuugggagguugaggacuauggcuucggcaucuuuacaaccaacauuuggcugaaacuuagagauucuuacacgcagaugugcgaccaccgccucaugagcgcggccaucaaggauuccaaagcugugcaugccgacaugggguauuggauugaaagcgagaagaaugaaacauggaagcuggcccgggcuucuuucaucgaggugaaaaccuguaucuggcccaagucccacacacuguggagcaacggaguccucgaaucugagaugauuaucccgaaaauuuacggcgggccuaucucccaacauaauuauagacccggauacuucacccagacagccggcccuuggcaccuggggaagcuugagcuggauuuugaccucugcgaaggaaccacggugguuguggaugagcacugcggcaaccgcggccccagccugcggaccacaaccgucacagggaaaauuauccaugaaugguguugcagaucuuguacccugccuccccuucgguuccgcggagaggacggcugcugguacgggauggagaucagaccggugaaggaaaaggaggaaaaucucguucggagcaugguguccgcgggaagcggcgaggucgacucuuuuucccuggggauucugugucucagcaucaugauugaagaggugaugagaucccgcuggucucggaaaaugcugaugacgggaacacuugcuguuuuccugcuccugaucaugggccagcugaccuggaacgaucuuauuagacugugcaucauggugggcgccaaugccagcgaccgcauggggaugggaacaaccuaucucgcucugauggccaccuuuaagaugagaccuauguucgcggucggccuccuguuucggcgccuuacauccagagaggugcugcuccugacgauugggcugucucuuguggcuagcgucgaacugcccaacucccucgaggaacugggagauggccucgccauggggaucaugaugcugaaacuucugaccgaguuccaaccccaccagcucuggacaacccugcugucucuuacauuuaucaagaccacgcugagccucgacuacgccuggaaaacaauggcuaugguucuguccauugugagccucuucccucugugucuuucuaccaccucccagaagacaaccuggcugccggugcugcucggaagcuuuggcugcaagccccugacaauguuccuuaucacggaaaacaaaauuuggggccggaagucuuggccucugaaugaggggaucauggccauuggaaucgucuccauccuccugagcucucuccugaaaaacgaugugccccuugcuggcccucugauugccgggggaaugcugaucgcguguuauguuauuuccggcagcuccgccgaccucagccuggagaaggcugccgaagugucuugggaggaagaggcugaacauagcgggaccucccacaauauccuugucgaggugcaggaugacggaacaaugaaaauuaaggaugaggaacgcgacgauacccugacaauccuccugaaagccacccuccuggccguuucuggcguguaccccaugagcaucccugcuacgcuuuuugucugguauuucuggcaaaagaagaaacagagauccggcgugcugugggacacccccucuccgccugaggucgaacgggcggugcuggaugacgggauuuaccgcauccuccagagaggacugcuuggccggagccagguuggggugggagucuuccaagacggcguguuucauacaauguggcacguuacccgcggggccgugcugauguaucagggaaagagacucgagcccuccugggcuucugucaaaaaggaucugauuagcuacggcggcggguggcgguuccagggauccuggaacacaggcgaggaagugcaggugaucgccguugagccugggaaaaaucccaagaacguccaaaccacaccgggaacguuuaagaccccugaaggcgaggugggggccguggcucucgacuucaaacccggaacaagcggcucuccuauugucaauagagaaggcaagaucguggggcuguacggaaacggcguugugaccaccuccgggacauaugucagcgccauugcgcaggcuaaagccucucaggagggaccccuucccgagaucgaagaugagguguuuaagaaacgcaaucugacgaucauggaccugcacccuggcuccgggaagacccggagauaccucccggccauuguucgcgaagcuaucaagcggaaacugagaacacuuauucuggcccccacccgcguggucgcgagcgagauggcugaagcccucaagggcaugccuauccgguaucaaacaaccgccgugaaauccgagcauacgggaagagagauuguugaucugaugugccacgcuacauucaccaugcgccugcucucucccgugcgggucccuaacuacaauaugaucaucauggacgaagcccauuuuaccgaucccgcuagcauugccgcgagaggcuauaucuccacacggguggggaugggagaggccgcugccauuuucaugaccgcuacaccuccgggcagcguggaagccuuuccccagucuaacgccgucauccaggacgaggaacgcgauauuccugagagauccuggaauagcggguacgacuggaucaccgauuuccccggaaagacgguuugguuugugccuucuaucaaaagcggcaacgacauugcuaauugucuucggaagaacgggaagcgcgugauccagcuguccagaaaaacauucgacaccgaguaucaaaagacaaaaaacaaugauugggacuacgucgugaccacggauauuucugaaaugggcgcgaacuuccgggccgacagaguuaucgauccccgccggugccugaagccggugauucucaaagacggaccugagagagucauccuggcuggccccaugcccgugaccguugccagcgccgcucagcgccgggggagaauuggacgcaaucagaacaaggaaggcgaucaguacguguauauggggcaaccucuuaauaacgacgaggaucacgcccauuggacagaggcgaagaugcugcucgacaauaucaacacccccgaaggaaucauuccugcucuguuugagccggaacgggagaaauccgccgccaucgauggcgaauacagacugcgcggggaggcuagaaagacauucgucgagcucaugcggcgcggcgaccuucccguguggcugucuuauaaagucgccagcgaaggauuucaguacuccgauagacgguggugcuucgacggcgagcgcaauaaccaggugcuggaagagaauauggacguugaaauuuggaccaaggagggggagagaaaaaagcuccggccuagauggcuggaugcgcgcacauauagcgacccccuugcccugcgggaauuuaaagaguucgcugccggaagacgcucuguguccggcgaucucauccuggaaauugggaagcugccucagcaccucacccuucgggcucaaaacgcccuggacaaucuggugaugcuccacaacagcgagcagggaggcaaggcuuacagacaugccauggaagagcugcccgauacgaucgagacacuuaugcugcucgcgcugaucgccguccugaccggcgggguuaugcucuuuuuccuuuccggaaaaggccuggggaagaccucuauuggacugcucugugugauggcuagcuccgcccugcuuuggauggcuucuguggaaccgcacuggaucgccgccagcauuauccuggaguuuuuccucaugguccugcugauuccugaacccgaccggcagcgcacaccucaggauaaucaacucgcuuaugugguuaucggccuucuguuuaugauccugaccguggcggccaacgagauggggcuccuggagacaacgaaaaaggaccuuggaauuggccaugucgcugccgaaaaccaccaccaugugaccaugcuggaugucgaccucagacccgccuccgcuuggacacuguacgccguggcgaccacaguuaucaccccuaugaugcggcacacgauugagaauaccacagccaacaucagccugaccgcuauugccaaucaggcugccauccucaugggccuugauaaaggguggcccauuucuaagauggacaucggagugccgcugcuggcgcucggcugcuacucccaggucaacccucugacacuuaccgccgcugugcugaugcucguugcccauuaugcuaucauugggcccggacugcaagccaaggcuacgcgcgaagcccagaaaagaacagcggccggcaucaugaagaaucccaccguggaugggauugucgcuaucgaccuggacccugugguguacgaugccaaauucgagaagcagcucggacagauuaugcuucugauccuguguacaagccaaauccuccugaugcggaccaccugggcucuuugcgaaucuauuacacuggccacgggcccgcucaccacacugugggagggcucccccgggaaauuuuggaacaccacaaucgccguuagcauggcgaauauuuuccgcggaucuuaucuggcuggcgccgggcucgcuuucagccuuaugaagucccugggaggcgggagacggggaaccggcgcccagggcgagacgcugggggaaaaguggaaacgccagcucaaccagcugucuaagagcgaguuuaauacauacaaaagauccggaaucauggaagucgaccggagcgaggccaaggaaggccuuaaaagaggggagaccaccaagcacgcugugucccgcggaacagccaagcugcggugguucguggagagaaaccucgucaaaccugaaggcaagguuauugaucugggguguggacgcggcggcuggucuuauuacugcgcggggcugaaaaaggugaccgaggugaaaggauauacaaagggcgggcccggacaugaagagccuauccccauggccacguacggcuggaaucucgucaaacuucacagcgggaaggacguguuuuucaccccuccggaaaagugugauacacugcugugcgacaucggagaguccucucccaacccuaccauugaggaaggccggacacucagaguucugaaaaugguggagcccuggcuuggcgggaaucaauuuuguaucaagauucugaacccuuacaugcccagcgucguggaaacccucgagcagaugcagcgcaaacacggaggcaugcugguucggaauccgcuguccagaaacucuacgcaugagauguauugggugagcugcgggaccggaaauaucgucuccgcugugaacaugacaagccgcaugcuccugaaccgguucaccauggcccacagaaagccuacauacgaacgcgauguggaccuuggcgcugggacccggcaugucgccguugagcccgaaguggcgaaucugggaauuaucggccagagaauugagaacaucaaaaaugaacacaagucuacauggcacuaugaugaggacaaccccuacaagaccugggccuaucauggcuccuacgaggugaaaccuagcgggucugcuuccagcauggucaauggagugguucgccuccugacgaagcccugggaugugaucccuauggucacacaaauugccaugaccgacaccacaccguuuggccagcagagaguguucaaagaaaagguugacacgcggaccccccgcgcuaaaagagggacagcccaaaucauggaggugaccgcuaaguggcuuugggauuuucugucucggaacaagaaaccuagaauuuguacacgggaagaguucauccgcaaggucagauccaaugccgcgauuggagccguguuuguugacgaaaaccaguggaauagcgcuaaagaggccguggaggaugaacgguucugggaccucguccaccgcgagagagaacugcauaagcagggcaaaugcgcuaccugcguguauaacaugauggggaagcgggagaagaaacugggcgaauuuggaaaggccaaaggcucccgcgccaucugguacauguggcucggggcgagauuccuggaguucgaggcucuuggauuuaugaaugaagaucacugguucagccgggagaacucucugagcggcgucgaaggggagggacuccauaagcugggcuacauccuucgcgacauuuccaaaauccccgggggcaauauguaugccgaugacacagccggaugggauaccagaauuacggaggacgaucugcagaacgaagcuaagaucaccgacauuauggagccugaacacgcccuccuggcuacaucuaucuuuaaacugaccuaccaaaauaaggugguucgggugcagcgccccgccaagaacggcacagucauggaugugaucagcagacgggaccagcgcggguccggacaggugggcaccuaugggcucaacacguucacaaauauggagguucaacugauuagacagauggaaucugagggaaucuuucuuccgagcgagcuggaaaccacaaaccucgcggagcgggugcuggacuggcuugaaaaacacggcgucgagagacugaagcgcauggccauuuccggggaugacugugugguuaaaccuaucgaugaccgguucgcuaccgcccucauugcucugaaugauaugggcaaggugagaaaagacaucccccagugggaaccuucuaagggauggaacgauuggcagcaaguccccuuuugcagccaucacuuccaucagcugaucaugaaggacggccgcgagauuguggucccuugucggaaucaggaugagcucguggggagagcccgcguuucccagggagcgggcuggagccugcgggaaacggccugccuugggaaaucuuacgcucaaauguggcagcugauguauuuucacagacgcgaccuccggcuggccgcuaacgccaucuguuccgcugugcccgucgauugggugccgaccagcagaacaaccuggucuauucacgcccaucaccaguggaugacaaccgaggacaugcuuuccguuuggaaucgcguguggaucgaagagaacccuuggauggaagacaagacacaugucagcuccugggaggaggugcccuaccugggaaaacgggaagaucaauggugcggcucucucauugggcugaccgcgagagccacgugggcuacaaauauccagguggccauuaaccagguucggagacugaucggcaaugagaacuaucucgacuacaugaccagcaugaagcgcuucaaaaaugaauccgaucccgagggagcccugugguga

SEQ ID NO: 18750 - RNA, 9879 nt, Artificial Sequence
  derived and/or modified CDS sequence (opt5) from DENV-1__FJ562106__SS-prME
agcgugacaaugcugcucaugcugcuucccacggcgcuggcuuuccaccucacgaccagaggcggggagccucauaugaucgucuccaagcaggaacggggaaaaucucugcuuuuuaagacaagcgcuggcguuaacaugugcacccugauugcgauggaccucggggagcugugugaagauacaaugaccuacaaaugccccagaaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagaagguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaaaaccgaggucacaaacccugccguucuucggaagcugugcauugaagcgaaaaucucuaauaccacgacagacucccgcuguccgacccaaggagaggccacccucguggaagaacaggaugcuaacuucgugugcagacggacauuugucgaccgcggcuggggcaauggguguggacuguucggcaaggggagccuucugaccugcgccaaguuuaaaugcgugacaaagcucgagggaaaaauuguucaguacgaaaaccugaaguauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagccccagaacaggccuugauuucaacgaaauggugcugcucaccaugaaagagaagucuuggcugguccauaaacagugguuucuugaccugccucuccccuggacguccggggcuagcacaucccaagagaccuggaaucggcaggaucugcuggugacauucaagaccgcgcacgccaagaaacaggaagucgugguucucggaucucaagagggcgcuaugcacaccgcccugacaggggccacggaaauucagaccagcggaacaaccacaaucuuugcuggccaucuuaagugccgccugaaaauggacaagcucacccugaaagggauguccuaugugauguguacgggcagcuucaagcuggagaaggaagucgccgagacacagcacggaaccgugcuuguucaggugaaauacgagggcaccgaugcgccgugcaagauuccuuucucuacacaagacgaaaaaggggucacccagaacggaagacucaucacagcuaaucccaucgugacggauaaggagaaaccugugaacauugaaaccgagccgcccuuuggcgaguccuauaucaugguuggggccggagaaaaggcccugaagcugagcugguucaaaaagggcucuagcauugggaaaauguuugaggcuacagcccggggcgcuagacgcauggccauccucggagacaccgcgugggauuucggcuccauugggggagucuuuacaucugugggcaagcuggugcaucaggucuucgggaccgccuacggagugcuuuuuagcggcguuuccuggacgaugaaaaucgggaucggcauucugcucaccuggcugggacugaauagccggucugcuucccuuagcaugacauguaucgccgugggcauggucacccucuaccugggggugaugguucaggcugacucuggaugcgugauuaacuggaagggcagagaacugaaguguggguccggaaucuucgucacaaacgaggugcacaccuggacagaacaauauaaauuucaggccgauagcccuaagcgccucuccgcggccauuggcaaggcuugggaggaggggguuugcggcauccggucugccaccagacuggaaaauauuauguggaagcagaucagcaacgagcuuaaucauauccugcucgaaaacgacaugaaauucacgguggucgugggagacgcuaauggcauucuggcccaggggaagaaaaugauccgcccgcaacccauggagcacaaguacuccuggaagucuuggggaaaagccaagauuaucggcgcugauauucagaacacaaccuuuaucaucgacgggccugauacccccgaauguccugacgaucagcgggcguggaauauuugggagguggaggacuauggauucggcaucuuuacaaccaacauuuggcugaaacuuagagauagcuacacgcagaugugcgaccaccgccucauguccgccgcuaucaagaauagcaaagccguccaugccgauaugggcuauuggauugaaucugagaagaacgaaacauggaagcuggcucgggccuccuucaucgagguuaaaaccuguaucuggcccaagagccacacacuguggucuaauggggugcucgaauccgagaugauuaucccgaaaauuuacggaggcccuaucagccaacauaacuauagacccggguacuucacccagacagcgggaccuuggcaccugggcaaacuugagcuggacuuugggcucugcgaaggaaccacgguggucguggaugagcacugcggcaaucgcggccccucucugcggaccacaaccguuacagggaaaauuauccaugaaugguguugcagaagcuguacccugccuccccuucgguuccgcggagaggacggcugcugguacgggauggagaucagaccggugaaggaaaaggaggaaaaccucguccgguccauggugagcgcuggaucuggcgagguugauuccuuuagccuggggauucuguguguguccaucaugauugaagaggucaugagaucucgcuggagccggaaaaugcucaugacgggaacacuggccguguuccuucugcucaucaugggccagcugaccuggaaugaccugauuagacuuugcaucaugguuggcgccaacgcuuccgaccgcauggggaugggaacaaccuaucuggcccucauggcgaccuuuaagaugagaccuauguucgcugugggccugcucuuucggcgccugacaucuagagagguccuucugcucacgauugggcugagccugguggccuccguggaacuucccaacucucuggaggaacucggagauggccuggccauggggaucaugaugcucaaacugcuuaccgaguuccaaccccaccagcuguggacaacccuccugagccugacauuuaucaagaccacguucucccuugacuacgcuuggaaaacaauggccaugguccugagcauuguuucucucuuuccucugugucucuccaccaccagccagaagacaaccuggcugccggugcuucugggaucuuucggcugcaagccccugacaauguuucucaucacggaaaauaaaauuuggggccggaaguccuggccucugaacgaggggaucauggcuauuggaaucgugagcauccuucugucuucccuccugaaaaaugaugucccccucgccggcccucugauugccggcgggaugcuuaucgccuguuaugugauuagcggguccagcgcugaccugucucuggagaaggccgcugaaguuagcugggaggaagaggccgaacauuccgggaccucucacaacauccucguggagguccaggaugacggaacaaugaaaauuaaggaugaggaacgcgacgauacccugacaauccuucugaaagccacccuccuggcugugagcggcguuuaccccauguccaucccugcgacacuguucgugugguauuucuggcaaaagaagaaacagagaucuggcguccugugggacacccccagcccgccugagguggaacgggccguccuugaugacgggauuuaccgcauccugcagagaggacugcucggccggucccagguggggguuggaguguuucaagauggcgucuuccauacaauguggcacgugacccgcggggcuguucugauguaucagggaaagagacuugagcccucuugggccagcgugaaaaaggaccugauuuccuacggcggcggguggcgguuucagggaagcuggaauacaggcgaggaaguccaggugaucgccguggagccugggaaaaaccccaagaauguucaaaccacaccgggaacguucaagaccccugaaggcgaggucggggcuauugcccucgacuuuaaacccggaacaucuggcuccccuaucgugaacagagaaggcaagauuguggggcuguacggaaauggcgucgugaccaccagcgggacauauguuucugcgaucgcucaggccaaagccucccaggagggaccccuccccgagaucgaagaugagguguucaagaaacgcaaccugacgauuauggaccuucacccuggcagcgggaagacccggagauaccugccggcuaucguccgcgaagccauuaagcggaaacugagaacacucauccuggcgcccacccgcgugguugcuuccgagauggccgaagcccuuaagggcaugccuauucgguaucaaacaaccgcugugaaaucugagcauacgggaagagagaucgucgaucugaugugccacgccacauuuaccaugcgccuccugagccccgugcggguuccuaauuacaacaugaucauuauggacgaagcucauuucaccgaucccgccuccaucgcggccagaggcuauauuagcacacggguggggaugggagaggcugccgcuaucuuuaugaccgccacaccuccgggcucugucgaagccuucccccaguccaaugcugugauucaggacgaggaacgcgauaucccugagagaagcuggaacucuggguacgacuggaucaccgauuuucccggaaagacggugugguucgucccuagcauuaaauccggcaaugacaucgcgaacugucugcggaagaacgggaagcgcguuauucagcucucuagaaaaacauucgauaccgaguaucaaaagaccaaaaauaacgacugggacuacguggugaccacggauaucagcgaaaugggcgccaauuuucgggcugacagagucauugauccccgccggugccuuaagccggugauccugaaagacggaccugagagaguuauucuggccggccccaugcccgugaccgucgccuccgcugcccagcgccgggggagaaucggacgcaaccagaauaaggaaggcgaucaguacguguauauggggcaaccucucaacaaugacgaggaucacgcgcauuggacagaggcuaagaugcugcuugacaacaucaauacccccgaaggaauuaucccugcccuguucgagccggaacgggagaaaucugccgcuauugauggcgaauacagacuccgcggggaggccagaaagacauuuguugagcugaugcggcgcggcgaccugcccguguggcucagcuauaaagucgcguccgaaggauuccaguacagcgauagacgguggugcuuugacggcgagcgcaacaaucaggugcuugaagagaacauggaugucgaaaucuggaccaaggagggggagcgcaaaaagcugcggccuagauggcuggacgcccgcacauauucugacccccucgcucugcgggaguucaaagaguuugccgcuggaagacgcuccgugagcggcgaucuuauucuggaaaucgggaagcucccucagcaccugacccugcgggcccaaaaugcucucgacaaccuuguuaugcugcacaauuccgagcagggaggcaaggccuacagacaugcgauggaagaacugcccgauacgaucgagacacucaugcugcuugcccugauugcugugcucaccggcggggugacccuguucuuucugucuggaaaaggccucgggaagacaagcaucggacuucugugugucauggccuccucugcucugcucuggauggccagcguugaaccgcacuggauugccgcuuccaucauucuggaguucuuucuuauggugcugcucaucccugaacccgaccggcagcgcaccccucaggauaaccaacuggcguauguggucaucggccuccucuucaugauucuuacaguggccgcuaacgagauggggcugcuggagacgaccaaaaaggaccucggaaucggccauguugccgccgaaaaucaccaccaugcuacaaugcuggauguggaccuuagacccgccagcgcguggacccuguacgccgucgcuacaaccgugauuacgccuaugaugcggcacaccaucgagaacacaaccgccaauauuucucucacagcuaucgccaaccaggcggccauucugaugggccuggauaaaggguggcccaucuccaagauggacaucggagucccgcuccuugcucugggcugcuacagccaggugaauccucugacccucacggccgcuguucugaugcuuguggcccauuaugcuauuaucgggcccggacugcaagccaaggcgacacgcgaagcccagaaaagaaccgcugccggcauuaugaagaaccccacagucgaugggaucguggcuauugaccucgauccuguuguguacgacgccaaauuugagaagcagcugggacagaucaugcugcucauccuuuguaccucucaaauucugcugaugcggaccacaugggcccucugcgaauccaucacgcuggcgaccggcccgcuuacaacccugugggagggcagccccgggaaauucuggaauacaaccauugcugucucuauggccaacaucuuccgcggaagcuaucucgcuggcgccgggcuggccuuuucccugaugaagucucucggaggcgggagacggggaacgggcgcucagggcgagacacuuggggaaaaguggaaacgccagcugaaucagcugagcaaguccgaguucaacaccuacaaaagaagcggaauuauggaaguggaccgguccgaggccaaggaaggccucaaaagaggggagaccacaaagcacgcggugucucgcggaaccgccaagcugcggugguuuguugagagaaaucuugucaaaccugaaggcaaggugaucgaucugggguguggacgcggcggcuggagcuauuacugcgcugggcucaaaaaggugacagaggucaaaggauauacgaagggcgggcccggacaugaggaaccuauccccauggccaccuacggcuggaaccugguuaaacugcacuccgggaaggacguguucuuuacaccuccggaaaagugugauacccuccuuugcgacauuggagagucuagccccaauccuacaaucgaggaaggccggacccugagagugcugaaaauggucgagcccuggcuccgcggcaaccaauucuguauuaagauccugaauccuuacaugcccuccgugguugaaacgcuugagcagaugcagcggaaacacgggggaaugcuggugagaaacccgcucucucgcaauagcacccaugagauguauugggucuccugcggcacagggaacauugugagcgcuguuaacaugaccucucggaugcugcugaauagauuuacaauggcccaccgcaagccuaccuacgaacgggauguggaccucggagcgggcacaagacaugucgccguggagcccgaaguggcuaaccuggauaucauugggcagcgcaucgagaauaucaaaaacgaacacaaguccaccuggcacuaugacgaggauaaucccuacaagacgugggccuaucauggaagcuacgaggucaaaccuucuggcuccgcuagcucuaugguuaacggcguggugagacuucugacaaagcccugggacgucauuccuauggugacccaaaucgccaugaccgauacaacgccguucgggcagcagcggguuuuuaaagaaaagguggacacccgcacacccagagcuaaacggggaaccgcccaaauuauggaggucacagcgaaguggcucuggggcuuccuguccagaaauaagaaaccucggaucuguacccgcgaagaguuuacaagaaaggugcggagcaacgccgcuauuggggccguuuucguggacgaaaaucaguggaacuccgcuaaagaggccgucgaggaugaacgcuuuugggaccuugugcacagagagcgggaacugcauaagcagggaaaaugcgcgaccugcguuuauaauaugaugggcaagcgcgagaagaaacucggggaguucggcaaggccaaaggaagcagagcuaucugguacauguggcugggcgcccgguuccuggaguuugaggcccucggguucaugaacgaagaucacugguuuucucgcgagaauagccuguccggaguggaaggcgaggggcuucauaagcugggauacauccucagagacauuucuaaaauccccggcgggaacauguaugcugaugacacggccggcugggauacccggauuacagaggacgaucugcagaaugaagcuaagaucaccgacauuauggagccugaacacgcccuucuggcgacaagcaucuucaaacucaccuaccaaaacaaggucgugcgcguccagagacccgccaagaacggaacggugauggauguuaucucccggcgcgaccagagaggcucuggacaggugggaacauauggccugaauaccuuuacaaacauggagguccaacugauucggcagauggaaagcgaggggaucuuccucccgugugagcuggaaaccccuaaucuugcugagagagugcuggauuggcucgaaaaacacggagccgagcgccugaagcggauggcuauuuccggcgacgacugcgugguuaaacccaucgaugacagauuugccacggcgcuuauugcccugaacgauauggggaaggugcgcaaagacaucccucagugggaacccucuaagggcuggaaugauuggcagcaagucccuuucuguagccaucacuuucaucagcucaucaugaaggacggacgggagauugugguucccugcagaaaccaggaugagcuggugggccgcgcucgggucucccagggggccggauggagccugagagaaaccgcuugucucggcaaaucuuacgcccaaauguggcagcugauguauuuccaccgccgggaccuuagacuggcugccaaugcgaucugcuccgccgugccggucgauugggugccuacaagccgcaccacauggucuauucacgcucaucaccaguggaugaccacagaggacaugcucuccguuuggaaccggguguggaucgaagagaaucccuggauggaagauaagacccaugucagcuccugggaggaggugcccuaccuggggaaaagagaagaccaaugguguggaucucuuauuggccugacgacacgggccaccugggccaccaacauccagguugcuauuaaucaggugagacgccucaucgggaacgagaauuaucuggacuacaugacaagcaugaagcgguuuaaaaacgaauccgauccugagggcgcccugugguga

SEQ ID NO: 18751 - RNA, 9879 nt, Artificial Sequence
  derived and/or modified CDS sequence (opt5) from DENV-1__FJ410179__SS-prME
agcgugaccaugcugcuuaugcugcuucccaccgcucuggcuuuccaccucacgaccagaggcggggagccucauaugaucgucuccaagcaggaacggggaaagucucugcuuuuuaagaccagcgccggcauuaacaugugcacccugaucgcgauggaccucggggagcugugugaagauacaaugaccuacaaaugcccccgcauuacagaggcugaacccgacgauguugacuguuggugcaaugccaccgauacgugggugaccuauggaacauguucccagaccggcgagcacagacgggacaagcgcucuguggcccuggcuccucaugucgggcucggacuggagacaagaaccgaaacguggaugagcuccgagggcgccuggaaacagauccagaagguggaaacaugggcccuucggcaccccggcuucaccguuacagcccuguuucucgcgcaugccauugggaccucuaucacccagaagggaaucauuuucauccugcuuaugcuggugacaccuagcauggcuaugcgcugcgucggcauugggaacagagauuuuguggagggacucuccggcgccacguggguugacgugguccuggagcacgggagcugugugaccacaauggcuaaagauaagcccacccuggacaucgaacuccugaaaacagaggugaccaauccugccguccuucggaagcugugcauugaagcgaaaaucucuaacacgacaaccgauucccgcuguccgacccagggagaggccacacucguugaagaacaggacagcaauuucgugugcagacggaccuuuguggaucgcggcuggggcaacggguguggacuguucggcaaggggucucuucugacaugcgcuaaguuuaaaugcgucacgaagcucgagggaaaaauugugcaguacgaaaaucugaaguauuccguuaucgugaccguccacacaggcgaccagcaucaaguggggaacgagaccacagaacacggaaccaucgccacgauuacaccccaggcuccuacaagcgagauccagcugaccgacuacggcgcccucacacuggauuguucucccagaaccggccuugacuucaaugaaaugguucugcucacgaugaaagagaaguccuggcuggugcauaaacagugguuucuugaucugccucuccccuggacaagcggggccuccaccucucaagagacauggaaccggcaggaccugcuggucaccuucaagaccgcucacgcgaagaaacaggaaguggucgugcucggaagccaagagggcgccaugcacacagcucugacgggggccaccgaaauucagacauccggaaccacaaccaucuuugccggccaucuuaagugccgccugaaaauggauaagcucacgcugaaagggaugagcuauguuauguguacaggcucuuucaagcuggagaaggaaguggcugagacccagcacggaaccguccuugugcagguuaaauacgagggcacagacgccccgugcaagauuccuuucuccgcgcaagaugaaaaaggggugacccagaauggaagacucaucacagcuaaccccaucgucacggacaaggagaaaccugugaauauugaaaccgagccgcccuuuggcgagagcuauaucgugguuggggccggagaaaaggcccugaagcugucuugguucaaaaagggcagcuccauugggaaaauguuugaggcuacagcccggggcgcuagacgcauggccauccucggagauaccgcgugggacuucggcucuauugggggagucuuuacaagcgugggcaagcuggugcaucaggucuucggggccgcuuacggagugcucuuuuccggcguuagcuggaccaugaaaaucgggaucggcauucugcucacguggcugggacugaacucucgguccaccagccuuucuaugacauguaucgccgugggcauggucacccucuaccugggggugaugguucaggcugauuccggaugcgugauuaauuggaagggcagagaacugaagugugggagcggaaucuucgucacaaacgaggugcacaccuggacagaacaauauaaauuucaggccgacuccccuaagcgccucucugcggccauuggcaaggcuugggaggaggggguuugcggcauccggagcgccaccagacuggaaaacauuauguggaagcagaucuccaaugagcuuaaccauauccugcucgaaaaugacaugaaauucacgguggucgugggagaugcuaacggcauucuggcccaggggaagaaaaugauccgcccgcaacccauggagcaccgguacucuuggaaaagcuggggaaaggccaagauuaucggcgcugacauucaaaauuccacauuuaucaucgaugggccugacacccccgaauguccugaugaccagagagcguggaacauuugggagguggaggauuauggauucggcaucuuuaccacaaauauuuggcugaaacuucgcgacagcuacacccagaugugcgaucaccggcucaugucugccgcuaucaaagacuccaaggccguccaugccgauaugggcuauuggauugaaagcgagaaaaacgaaacguggaagcuggcuagagccucuuucaucgagguuaagacauguaucuggcccaaaucccacacccuguggagcaauggggugcucgaaucugagaugauuaucccgaagauguacggaggcccuauuagccaacauaacuaucgccccggguacuucacacagaccgcgggaccuuggcaccugggcaaacuugagcuggacuuugaucucugcgaagggacaaccguggucguggacgagcacugcggaaaucggggccccucccugagaacgaccacaguuaccggcaagaucauucaugaaugguguugccggagcuguacacugccuccccuucgcuucagaggggaggacggaugcugguacggcauggagauccggccggugaaagaaaaggaggaaaaccucgucagaucuaugguguccgcugggagcggagagguugauuccuuuucucugggcauccugugugugagcauuaugaucgaagaggucaugcgcucccgguggucuagaaagaugcucaugaccgggacgcuggccguguuccuucugcucauuaugggacagcugacauggaaugaccugauccgccuuugcauuaugguuggcgccaacgcuagcgauagaaugggcauggggaccacauaucuggcccucauggcgaccuuuaaaaugcggccuauguucgcugugggacugcucuuucgcagacugaccucccgggagguccuucugcucacaaucggccugucucugguggccagcguggaacuucccaauucccuggaggaacucggggacggacuggccaugggcauuaugaugcucaagcugcuuacggaguuccaaccccaccagcuguggaccacacuccugagccugaccuuuaucaaaacaacccuuucucuggauuacgcuuggcgcacgauggccaugguccucuccaucguuagccuguucccucucugucugucuacaaccucccagaagaccacauggcuuccggugcugcuggggagcuuuggaugcaaaccccucaccauguuccugauuacagaaaacaagaucuggggcagaaagucuuggccucuuaacgagggcauuauggcuaucgggauuguguccauccugcucagcucccugcucaaaaaugacgucccccuggccggaccucuuaucgcgggcgggaugcugauugccuguuaugugaucagcggaucuagcgcugaucugucccucgagaaggccgcugaaguuucuugggaggaagaggccgaacauagcggcacgucccacaacauucugguggagguccaggacgaugggaccaugaaaaucaaggacgaggaacgggaugacacacuuaccauucugcucaaagccacacugcucgcuaucucuggaguguaccccaugagcaucccugcgacccuguuuguuugguauuucuggcaaaagaaaaagcagcgcuccggcgugcuuugggauacgcccucuccgccugaggucgaaagagccgugcuggacgacggcauuuaccggauccugcagcgcgggcuccugggaagaagccaggucggcguggggguuuuccaagauggaguguuucauaccauguggcacgucacacggggcgcugugcuuauguaucaggggaagagacuggagcccuccugggccagcguuaaaaaggaccucauuucuuacggaggcggcuggcgcuuccagggguccuggaauaccggagaggaagugcaggucaucgccguggagccuggcaaaaaccccaagaaugugcaaacaaccccggggacauuuaaaacgccugaaggagagguuggcgcuauugcccuggauuucaagcccgggaccagcggaucuccuaucgucaaccgggaaggcaagauugugggccucuacgggaauggaguggucacaaccuccggcaccuaugugagcgcgaucgcucaggccaaaacaucccaggaggggccccugcccgagaucgaagaggaaguuuuuaagaaaagaaaccuuacgauuauggaccugcacccuggaucuggcaagacccgccgguaccugccggccaucgugagagaggcuauuaaacgcaagcuccggacacugauccuugcccccaccagagucguggcgagcgaaauggcugaggcccugaaggggaugccuauucgcuaucaaacaaccgccguuaaauccgagcauacgggccgggaaaucguggaucucaugugccacgcuacauucaccaugagacugcugagccccguccgggugccuaauuacaacaugaucauuauggacgaggcccauuuuaccgaucccgcuucuaucgccgcgcgcggauauauuuccacaagaguuggcaugggggaagccgcugccaucuucaugaccgcuacaccuccgggaagcguggaggccuuuccccagucuaaugccgucauucaggacgaagaacgggauaucccugagcgcagcuggaacuccggcuacgacuggaucaccgauuuccccgggaagacggugugguuugugccuucuauuaaaagcggaaaugacaucgcuaacugucucagaaagaauggcaaacgggucauucagcuuuccagaaagacauucgacaccgaauaucaaaagacacgcaacaacgauugggacuacguugugaccacggauaucucugagaugggggcgaauuuccgggccgacagagugauugauccccgccggugccugaaaccggucauccugaaggacggcccugaaagagugauucucgcuggacccaugcccguuaccguggccagcgccgcucagcgccggggcagaaucgggcgcaaccagaauaaagagggagaucaguacgucuauaugggccaaccucugaacaaugacgaggaucacgcccauuggacagaagcgaagaugcuucuggacaacaucaauacccccgaggggauuaucccugcucucuuugaaccggagagagaaaaauccgccgccauugauggagaguaccggcugcgcggcgaggcuagaaagacauucguggaacugaugcggcgcggggaccuccccguuuggcuuagcuauaagguggccucugagggcuuucaguacuccgauagacgguggugcuucgacggagaaagaaacaaucagguccuggaggaaaacauggacguggagaucuggaccaaagagggcgaacgcaagaaacugcggccuagauggcucgaugcgcgcacauauagcgacccccuggcccuucgggaguuuaaggaguucgcugccgggagacgguccgucucuggagaucugauucucgagaucggcaaacugccucagcaccugacccuccgcgcucaaaaugcccuugacaaccuggugaugcugcacaauagcgaacaagggggaaaggcuuacagacaugccauggaggagcuccccgauacgaucgaaacacugaugcuucuggcgcucauugccguucugaccggcggcgugacccuguuuuuccucuccgggaaaggacuuggcaagacaucuaucgggcugcugugugugauggcuagcuccgcccuccuguggauggcuaacgucgagccgcacuggauugccgccagcaucauucuugaauuuuuccugaugguucuccugaucccugagcccgaccggcagcgcaccccucaggauaaucaacuggcuuauguggugaucggacuccuuuuuaugauucugacagucgcggccaacgagaugggccugcucgaaacgaccaagaaagaccuggggaucggacauguggcugccgagaaccagcaccacgccacaaugcuugauguugaccugagacccgcuucugccuggacccucuacgcgguggccacaaccgucauuacgccuaugaugcggcauaccaucgaaaauacaaccgcuaacauuucccugacagccaucgcuaaucaggccgcgauucugaugggccucgauaagggcuggcccaucagcaaaauggacaucggggugccgcuucuggcccugggaugcuacucucaagucaacccucucacccugacggcugccgugcuuaugcugguugcucacuaugccauuaucggccccgggcuccaggcuaaggccacacgcgaggcgcagaaaagaaccgccgcuggaauuaugaagaaucccacaguggauggcaucgucgccauugaccuggacccugugguuuacgaugcuaaguucgaaaaacagcuggggcaaaucaugcuccuuauccuguguaccucccagauucugcucaugcggaccacaugggcccugugcgagagcaucacgcuugccaccggaccgcugacaacccucugggagggcucucccggcaaguuuuggaacacaaccauugcggugagcauggcuaauaucuuccgcggguccuaucuggccggagcuggccuggccuucucucucaugaaaagccuugggggaggcagacgggggacgggagcccagggcgaaacacugggcgagaaguggaaaagacagcugaaccaacucuccaagagcgaauuuaauaccuacaagcgcuccgggauuauggaggucgaccggucugaagcuaaagagggacugaagagaggcgagaccacaaaacaugccgugagccgcgggaccgcgaaacuucggugguucguggaaagaaaccugguuaaaccugagggaaaggucaucgaucucggcugugggcgcggaggcugguccuauuacugcgccggccugaagaaagugacagaagugaagggguauacgaaaggaggccccgggcacgaggaaccuauccccauggcuaccuacggauggaaucuggucaagcucuacucuggcaaagacguguuuuucacaccuccggagaagugugauacccuucugugcgacauuggggagagcucccccaacccuacaaucgaagagggacggacccugagaguucucaaaaugguggaacccuggcugcgcggcaaucaguuuuguauuaagauccuuaacccuuauaugcccucugucguggagacgcuggagcagaugcagcggaagcauggcgggaugcucguuagaaauccgcugagccgcaacuccacccacgaaauguacugggugagcugcggaacaggcaauauugucucugccgugaacaugaccucccggaugcugcucaacagauucacaaugacccaccgcaaaccuacauaugagagagauguugaccugggggcuggaacccggcauguggccgucgaacccgagguggcgaaucuugauaucauuggccaacgcaucgaaaacaucaagaaugagcacaaaagcacguggcauuacgacgaggauaaccccuauaagacaugggccuaccacgggucuuaugaagugaaaccuuccggaagcgcuucuuccauggucaauggcguugugagacugcucaccaagcccugggacgugauuccuauggucacccagaucgccaugacagacacgaccccguuuggccagcaacggguguucaaggagaaaguugauacaagaacaccccgggcuaagcgcgggacagcccagauuauggaagugaccgcuaaauggcuguggggauuucuuagcagaaacaagaaaccucggaucuguacacgcgaggaguucaccagaaagguccgguccaaugccgcgauuggcgccguguuuguugacgagaaccaguggaauagcgcuaaggaggccguggaagaugagcgcuucugggaccugguccacagagaacgggagcuccauaaacaggggaagugcgcuacgugcguguacaacaugaugggaaaacgcgaaaagaaacugggcgaguuugggaaggccaagggcucuagagccaucugguacauguggcugggagcgcgguuccucgaguucgaagcucugggcuuuaugaaugaggaucacugguucagccgcgaaaacuccuuuucugggguugagggagagggccuucauaaacugggguauauccucagagacauuagcaagauccccggaggcaauauguacgccgaugacaccgccgggugggauacacggauuaccgaagacgaucugcaaaacgaggcuaaaaucacagacauuauggaaccugagcacgcccuucuggcuaccuccaucuucaagcucacguaucagaauaaagugguccgcgugcagagacccgccaagaacggcacagucauggaugugaucucucggagagaccagcgcggaagcggccaaguugggaccuacggacugaacacauuuaccaauauggaagugcagcugauucggcagauggaguccgagggcaucuuccucccgucugaacuggagacgccuaaccuugcggaaagaguccuggacuggcucgagaaacaugggaccgaacgccugaagcggauggccauuagcggagaugacuguguggugaagcccguugaugacagauuugcuacagcccuuaucgcucugaaugauaugggcaaagugcgcaaggacauuccucagugggagcccuccaaaggguggaacgauuggcaacaggucccuuucugcagccaccacuuucaucagcucaucaugaaggacggccgggagaucgugguucccuguagaaaucaggaugaacuggugggacgcgcccgggucucucaaggcgcgggguggucccugagagagaccgccugccucggaaaaagcuaugcucagauguggcagcugauguacuuccaccgccgggaccuuagacuggccgcuaacgccauuuguucugcugugccggucgauugggugccuacaucccggaccacauggagcauccaugcccaccaccaauggaugaccacggaagacaugcucuccguuuggaauagaguguggauugaggaaaaccccuggauggaggacaagacacaugucucuagcugggaggaagugcccuaucugggcaagcgcgaggaucaguggugcgggucccuuaucggacugaccgcgcgggccaccugggcuacaaauauucagguugccaucaaccaggugagacgccucauuggcaaugaaaacuaccuggacuacaugaccagcaugaaaagauuuaagaaugagucugauccugagggggcccugugguga

SEQ ID NO: 18752 - RNA, 9879 nt, Artificial Sequence
  derived and/or modified CDS sequence (opt5) from DENV-1__FJ410181__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcguuggcauuaauaugugcacccugaucgccauggaccucggggagcugugugaagauacaaugaccuacaaaugccccagaauuacagaggcggaacccgacgauguggacuguuggugcaaugcuaccgauacgugggugaccuauggaacauguucccagaccggcgagcacagacgggacaagcgcucugucgcccuggccccucauguggggcucggacuggagacaagaaccgaaacguggaugagcuccgagggcgcuuggaaacagauccagaagguugaaacaugggcccuucggcaccccggcuucaccgugacagcucuguuucucgcccaugcgauugggaccucuaucacccagaagggaaucauuuucauccugcuuaugcuggucacaccuagcauggccaugcgcugcgugggcauugggaacagagauuuuguugagggacucuccggcgcuacguggguggacgucgugcuggagcacgggagcugugugaccacaauggccaaagauaagcccacccuggacaucgaacuccugaaaacagaggucaccaauccugcuguucuucggaagcugugcauugaagccaaaaucucuaacacgacaaccgauucccgcuguccgacccaaggagaggcgacacucguggaggaacaggacagcaauuucgugugcagacggaccuuugucgaucgcggcuggggcaacggguguggacuguucggcaaggggucucuucugacaugcgccaaguuuaaaugcgugacgaagcucgagggaaaaauuguucaguacgaaaaucugaaguauuccgugaucgucaccgugcacacaggcgaccagcaucaaguugggaacgagaccacagaacacggaaccaucgcuacgauuacaccccaggccccuacaagcgagauccagcugaccgacuacggcgcucucacacuggauuguucucccagaaccggccuugacuucaaugaaauggugcugcucacgaugaaagagaaguccuggcugguccauaaacagugguuucuugaucugccucuccccuggacaagcggggccuccaccucucaagagacauggaaccggcaggaccugcuggugaccuucaagaccgcccacgcuaagaaacaggaagucgugguucucggaagccaagagggcgcgaugcacacagcccugacgggggcuaccgaaauucagacauccggaaccacaaccaucuuugccggccaucuuaagugccgccugaaaauggauaagcucacgcugaaagggaugagcuaugugauguguacaggcucuuucaagcuggagaaggaagucgccgagacccagcacggaaccgugcuuguucaggugaaauacgagggcacagacgcuccgugcaagauuccuuucuccgcccaagaugaaaaaggggucacccagaauggaagacucaucacagcgaaccccaucgugacggacaaggagaaaccugugaauauugaaaccgagccgcccuuuggcgagagcuauaucguuauuggggcuggagaaaaggcccugaagcugucuugguucaaaaagggcagcuccaucgggaaaauguuugaggccacagcucggggcgccagacgcauggcuauucucggagauaccgccugggacuucggcucuaucgggggagucuuuacaagcgugggcaagcuggugcaucaggucuucggggcggccuacggagugcucuuuuccggcguuagcuggaccaugaaaaucgggauuggcauccugcucacguggcugggacugaacucucgguccaccagccuuucuaugacauguauugcugugggcauggucacccucuaccugggggugaugguucaggccgauuccggaugcgugaucaauuggaagggcagagaacugaagugugggagcggaauuuucgucacaaacgaggugcacaccuggacagaacaauauaaauuucaggcugacuccccuaagcgccucucugccgcgaucggcaaagccugggaggaggggguuugcggcauucggagcgcuaccagacuggaaaacaucauguggaagcagaucuccaaugagcuuaaccauauucugcucgaaaaugacaugaaauucacgguggucgugggagaugccaacggcauccuggcucaggggaagaaaaugauucgcccgcaacccauggagcaccgguacucuuggaaaagcuggggaaaggccaagaucauuggcgccgacauccagaauacaaccuuuaucauugaugggccugacacccccgaauguccugaugaccagagagcuuggaacaucugggagguggaggauuauggauucggcauuuuuacaaccaauaucuggcugaaacuucgcgacuccuacacgcagaugugcgaucaccggcucaugagcgcggccauuaaagacucuaaggcuguccaugccgauaugggcuauuggaucgaauccgagaaaaacgaaacauggaagcuggccagagcuagcuucaucgagguuaagaccuguauuuggcccaaaucucacacacugugguccaauggggugcucgaaagcgagaugaucauuccgaagaucuacggaggcccuauuucucaacauaacuaucgccccggguacuucacccagacagccggaccuuggcaccugggcaaacuugagcuggacuuugaucucugcgaagggaccacgguggucguggacgagcacugcggaaaucggggccccagccugagaaccacaaccguuacaggcaagaucauccaugaaugguguugccgguccuguacccugccuccccuucgcuucagaggggaggacggaugcugguacggcauggagauucggccggugaaagaaaaggaggaaaaccucgucagaagcauggugucugcgggguccggagagguugauagcuuuucccugggcauccugugugugucuauuaugaucgaagaggucaugcgcagccggugguccagaaagaugcucaugacggggacacuggcuguguuccuucugcucauuaugggacagcugaccuggaaugaccugauccgccuuugcauuaugguuggcgccaacgccucugauagaaugggcauggggacaaccuaucuggcucucauggccaccuuuaaaaugcggccuauguucgcggugggacugcucuuucgcagacugacaagccgggagguccuucugcucacgaucggccugucccugguggcuucuguggaacuucccaauagccuggaggaacucggggacggacuggccaugggcaucaugaugcucaagcugcuuaccgaguuccaaccccaccagcuguggacaacccuccugucccugacauuuauuaaaaccacgcuuagccuggauuacgccuggcgcacaauggcuaugguccucucuaucguuucccuguucccucucugucugagcaccaccucucagaagacaaccuggcuuccggugcugcugggguccuuuggaugcaaaccccucacaauguuccugauuacggaaaacaagaucuggggcagaaagagcuggccucuuaacgagggcauuauggccaucgggaucgugucuauucugcucuccagccugcucaaaaaugacgucccccuggcuggaccucuuaucgccggcgggaugcugauugcguguuaugugaucuccggaagcucugccgaucugagccucgagaaggcugccgaaguuuccugggaggaagaggcugaacauucuggcaccagccacaacauucugguggagguccaggacgaugggacaaugaaaaucaaggacgaggaacgggaugacacccuuacaauccugcucaaagccacccugcucgccguguccggaguuuaccccaugucuauuccugcuacgcuguuugugugguauuucuggcaaaagaaaaagcagcgcagcggcguccuuugggauacccccuccccgccugagguggaaagagcgguccuggacgacggcaucuaccggauucugcagcgcgggcuccugggaagaucucaggugggcguugggguguuccaagauggagucuuucauacaauguggcacgugacccggggcgccguucuuauguaucaggggaagagacuggagcccagcugggcuuccgugaaaaaggaccucaucagcuacggaggcggcuggcgcuuccaggggucuuggaauacaggagaggaaguccaggugauugccguggagccuggcaaaaaccccaagaauguucaaaccacaccggggacguuuaaaaccccugaaggagaggucggcgccaucgcucuggauuucaagcccgggacauccggaagcccuauugugaaccgggaaggcaagaucgugggccucuacgggaauggagucgugaccaccucuggcacauauguuuccgccaucgcgcaggcuaaaacgagccaggaggggccccugcccgagauugaagacgagguguuuaagaaaagaaaccuuaccaucauggaucugcacccuggauccggcaagacacgccgguaccugccggccauugucagagaagccaucaaacgcaagcuccggacccugauucuugcucccacaagagugguugccucugagauggcggaagcucugaaggggaugccuauccgcuaucaaaccacggccgugaaaagcgagcauacaggccgggagaucgucgaccucaugugccacgccaccuucaccaugagacugcugucccccgugcggguuccuaauuacaacaugauuaucauggaugaagcucauuuuacagaccccgccagcauugcugcccgcggauauaucucuaccagagugggcaugggggaggcggccgcuauuuucaugacagccaccccuccgggauccgucgaggcuuuuccccagagcaaugccgugauccaggaugaggaacgggacaucccugagcgcucuuggaacagcggcuacgauuggauuacggacuuccccgggaagacagugugguuugucccuuccaucaaaucuggaaaugacauugccaacugucucagaaagaauggcaaacggguuauccagcuuagcagaaagaccuucgauacagaguaucaaaagaccaaaaacaacgacugggauuacguggugacgaccgacauuuccgaaaugggggcuaauuuccgcgcggaucgggucaucgaccccagacgcugccugaagccggugauucugaaagauggcccugagcggguuauccucgccggacccaugcccgugacagucgcuucugccgcccagagacgcggccggaucgggagaaaccagaauaaggaaggagaccaguacguguauaugggccaaccucugaacaaugaugaggaccacgcucauuggaccgaggccaaaaugcuucuggauaacauuaauacacccgaagggaucauuccugcgcucuuugagccggaacgcgaaaagagcgcugccaucgacggagaauacagacugcggggcgaggcccgcaagaccuucguugagcugaugagaagaggggaucuccccguguggcuuuccuauaaagucgcuagcgaaggcuuucaguacucugaccgcagauggugcuucgacggagagcggaacaaucaggugcuggaagagaacauggaugucgaaauuuggacaaaggagggcgagcgcaagaagcugcgcccucgguggcucgacgccagaaccuauuccgauccccuggcgcuucgcgaauuuaaagaguucgccgcugggcggagaagcguguccggagaccugauccucgaaaucggcaagcugccucagcaccugacgcuccgggcccaaaaugcucuugauaaccugguuaugcugcacaauucugagcaagggggaaaagccuaccgccaugcuauggaagaacuucccgacacaauugagacccugaugcuucuggcccucaucgcggugcugaccggcggcgugacacuguuuuuccucagcgggaagggacuuggcaagaccuccauugggcugcugugugucauggccucuagcgcucuccuguggauggccaacguugaaccgcacuggaucgcugccuccauuauccuugaguuuuuccugauggugcuccugaucccugaacccgauagacagcggacaccucaggacaaucaacuggccuauguggucauuggacuccuuuuuaugauccugacgguggcugcgaacgagaugggccugcucgagaccaccaaaaaggaucuggggauuggacauguugccgcugaaaaccagcaccacgccaccaugcuugacguggaucugcgccccgccagcgcuuggacacucuacgccgucgcgaccacggugaucaccccuaugaugagacauacaauugagaauaccacagccaacaucucucugaccgcuauugccaaucaggcugccauccugaugggccucgacaaaggcuggcccaucuccaagauggauauuggggucccgcuucuggcgcugggaugcuacagccaagugaacccucucacgcugacagccgcuguucuuaugcugguggcccacuaugcuaucauuggccccgggcuccaggccaaagcuacccgggaagcccagaagcgcacagcggccggaaucaugaagaaucccaccgucgacggcauuguggcuaucgaccuggauccuguuguguacgacgccaaauucgagaagcagcuggggcaaaucaugcuccuuauucuguguaccucucagauccugcucaugagaacaacgugggcucugugcgaauccauuacccuugccacaggaccgcugaccacacucugggagggcagccccggcaaauuuuggaacaccacgaucgccgucucuauggcgaauauuuuccgggggagcuaucuggcuggagccggccuggcuuucucccucaugaagucucuugggggaggccgcagagggacaggagcccagggcgagacccugggcgaaaaauggaagcggcagcugaaccaacucagcaaguccgaguuuaauaccuacaaaagaagcgggaucauggaaguggaucgcuccgaggccaaggaaggacugaaacggggcgagacaaccaagcaugcugugucuagagggacagccaaacuucgcugguucguugagcggaaccuggucaagccugaaggaaaggugaucgaccucggcugugggagaggaggcuggagcuauuacugcgcgggccugaaaaaggugacggaggucaaaggguauaccaagggaggccccgggcacgaggagccuauucccauggccacauacggauggaaucugguuaaacucuacuccggcaaggauguguuuuucaccccuccggaaaaaugugacacacuucugugcgauaucggggagucuagccccaacccuaccauugaggaaggacgcacgcugcgggugcucaagauggucgagcccuggcugagaggcaaucaguuuuguaucaagauucuuaacccuuauaugcccuccgugguugaaacccuggagcagaugcagcgcaaacauggcgggaugcucgugcggaauccgcugucuagaaacagcacacacgagauguacugggucuccugcggaaccggcaauaucgugagcgcuguuaacaugacaucucgcaugcugcucaaccgguucaccauggcccacagaaagccuacauaugaacgcgacguggaucugggggcuggaaccagacaugucgccguggagcccgaaguggcgaaucuugacauuaucggccaacggaucgagaacauuaaaaaugaacacaaguccacguggcauuacgaugaggacaaccccuauaaaacaugggccuaccacgggagcuaugaggucaagccuucuggauccgcuagcucuaugguuaauggcguggugcgccugcucaccaagcccugggacgucaucccuauggugacccagauugccaugacagauacgaccccguuuggccagcaaagaguuuucaaagaaaagguggacacacggacccccagagcuaaacgggggacagcccagaucauggaggucaccgcuaaguggcuguggggauuucuuucccgcaacaaaaagccuagaauuuguacacgggaagaguucacccgcaaggugagaagcaaugccgcgaucggcgccguuuuuguggaugaaaaccaguggaacuccgcuaaagaggccgucgaggacgaacgguucugggaucugguguaccgcgagagagaacuccacaagcaggggaaaugcgcuacgugcguuuacaacaugaugggaaagcgggagaaaaagcugggcgaauuugggaaggccaaaggcagccgcgccaucugguauauguggcugggagcgagauuccucgaguucgaggcucugggcuuuaugaaugaagaccauugguucucucgggagaacagcuuuuccgggguggaaggagagggccuucacaagcugggguacauucuccgcgauaucucuaaaauucccggaggcaauauguaugccgacgauaccgccgggugggacacaagaaucaccgaggaugaccugcaaaacgaagcuaagauuacagauaucauggagccugaacaugcccuucuggcuaccagcaucuucaaacucacguaccagaauaaggucgugcggguccagcgccccgccaaaaacggcacagugauggacguuauuuccagacgggaccagagaggaucuggccaaguggggaccuauggacugaacacauuuaccaauauggagguccagcugauccgccagauggaaagcgagggcauuuuccucccguccgagcuggaaacgccuaaccuugcggagcgggugcuggauuggcucgaaaagcacgggaccgagagacugaagcgcauggccaucucuggagacgauugugugguuaaacccguggacgaucgguuugcuacagcccuuauugcucugaaugacaugggcaaggucagaaaagauaucccucagugggaacccagcaagggguggaacgacuggcaacaggugccuuucugcucccaucacuuucaccagcucaucaugaaagauggccgcgagauuguugugcccugucggaaucaggacgagcuggucggacgggcccgcgugagccaaggcgcgggguggucucugcgggaaaccgccugccucggaaaguccuacgcucagauguggcagcugauguauuuccauagacgcgaucuucggcuggccgcuaacgccaucuguagcgcugucccgguggacuggguuccuacaucuagaaccacaugguccauucacgcccaucaccaauggaugaccacggaggacaugcucagcguguggaaucgggucuggaucgaagagaaccccuggauggaagauaagacacacguguccucuugggaggagguucccuaccugggcaaaagagaagaccaguggugcgggagccuuauuggacugaccgcgcgcgccaccugggcuacaaauauccagguggccauuaaccagguccggagacucaucggcaaugagaacuaccuggauuauaugaccuccaugaagcgcuuuaaaaaugaaagcgacccugagggggcccugugguga

SEQ ID NO: 18753 - RNA, 9879 nt, Artificial Sequence
  derived and/or modified CDS sequence (opt5) from DENV-1__FJ547086__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagaagguugaaacaugggcucuucggcaccccggcuucaccgugaucgccuuuuuccuggcgcaugccauugggacaucuaucacccagaagggaaucauuuuuauccuccugaugcuugucaccccuagcauggcuaugcgcugcgugggcauugggaacagagauuucguugagggacuguccggcgccacauggguggacgucgugcucgagcacgggagcugugugacgaccauggcuaaaaauaagcccacacuggauaucgaacugcucaaaaccgaggucacaaacccugccguucugcggaagcuuugcauugaagcgaaaaucucuaauaccacgacagacucccgcuguccgacccaaggagaggccacccugguggaagagcaggaugcuaacuuugugugcagacggacauucgucgaccgcggcuggggcaauggguguggacucuuuggcaaggggagccugcuuaccugcgccaaguucaaaugcgugacaaagcuggagggaaaaauuguucaguacgaaaaccucaaguauucugugaucgucacggugcacaccggcgaucagcaucaaguugggaaugagacaaccgaacacggaacaaucgcuaccauuacgccccaggccccuaccuccgagauccagcugacagacuacggcgcccugacccucgacuguagccccagaacaggccuggauuuuaacgaaauggugcuucugaccaugaaagagaagucuuggcucguccauaaacagugguuccuggaccuuccucugcccuggacguccggggcuagcacaucccaagagaccuggaaucggcaggaucuccuggugacauuuaagaccgcgcacgccaagaaacaggaagucgugguucugggaucucaagagggcgcuaugcacaccgcccucacaggggccacggaaauucagaccagcggaacaaccacaaucuucgcuggccaucugaagugccgccuuaaaauggacaagcugacccucaaagggauguccuaugugauguguacgggcagcuucaagcuggagaaggaagucgccgagacacagcacggaaccgugcugguucaggugaaauacgagggcaccgaugcgccgugcaagauuccuuuuucuacacaagacgaaaaaggggucacccagaacggaagacuuaucacagcuaaucccaucgugacggauaaggagaaaccugugaacauugaaaccgagccccccuucggcgaguccuauaucaugguuggggccggagaaaaggcccucaagcugagcugguuuaaaaagggcucuagcauugggaaaauguucgaggcuacagcccggggcgcuagacgcauggccauccugggagacaccgcgugggauuuuggcuccauugggggagucuucacaucugugggcaagcucgugcaucaggucuuugggaccgccuacggagugcuguucagcggcguuuccuggacgaugaaaaucgggaucggcauucuucugaccuggcucggacugaauagccggucugcuucccugagcaugacauguaucgccgugggcauggucacccuuuaccucggggugaugguucaggcugacucuggaugcgccauuaacuggaagggcagagaacugaaguguggguccggaaucuuugugacaaacgagguccacaccuggacagaacaauauaaauuccaggcggauagcccuaagcgccuguccgccgcuauuggcaaagccugggaggagggggugugcggcauccggucugcuaccagacucgaaaauauuauguggaagcagaucagcaacgagcugaaucauauccuucuggaaaacgacaugaaauuuacgguuguggucggagacgccaauggcauucucgcccaggggaagaaaaugauccgcccgcaacccauggagcacaaguacuccuggaagucuuggggaaaagcuaagauuaucggcgcggauauucagaacacaaccuucaucaucgacgggccugauacccccgaauguccugacgaucagcgggccuggaauauuugggagguggaggacuauggauuuggcaucuucacaaccaacauuuggcugaaacugagagauagcuacacgcagaugugcgaccaccgccuuauguccgcugccaucaaggauagcaaagccgugcaugcugacaugggcuauuggauugaaucugagaagaaugaaacauggaagcucgcccgggcguccuucaucgaggucaaaaccuguaucuggcccaagagccacacacuguggucuaacgggguucuggaauccgagaugauuaucccgaaaauuuacggaggcccuaucagccaacauaauuauagacccggguacuuuacccagacagcuggaccuuggcaccucggcaagcuggagcuugauuucgaccugugcgaagggaccacggugguggucgaugagcacugcggaaaccgcggccccucucuccggaccacaaccgugacaggcaaaauuauccaugaaugguguugcagaagcuguacccugccuccccugcgguuucgcggggaggacggaugcugguacggcauggagaucagaccgguuaaggaaaaggaggaaaaucuugugcgguccauggucagcgccgggucuggagagguggacuccuucagccucggcauucuguguguuuccaucaugauugaagaggugaugagaucucgcuggagccggaaaaugcugaugacggggacacucgccgucuuucugcuucugaucaugggacagcucaccuggaacgaucugauuagacugugcaucauggugggcgcuaaugccuccgaccgcaugggcauggggacaaccuaucuugcgcugauggcuaccuucaagaugagaccuauguuugccguuggacuccuguuccggcgccucacaucuagagaggugcugcuucugacgauuggccucagccuggucgccuccguggaacugcccaacucucuugaggaacugggggauggacucgcuaugggcaucaugaugcugaaacuccugaccgaguuucaaccccaccagcuuuggacaacccugcucagccugacauucaucaagaccacgcugucccuugacuacgccuggaaaacaauggcuauggugcugagcauugucucucucuuuccucugugucucuccaccaccagccagaagacaaccuggcugccgguucuucuggggucuuucggaugcaagccccugacaauguuucucaucacggaaaacaaaauuuggggccggaaguccuggccucugaaugagggcaucauggccauugggaucgugagcauccuucugucuucccuccugaaaaacgaugugccccucgcgggaccucugauugccggcgggaugcuuaucgcuuguuaugucauuagcggauccagcgccgaccugucucuggagaaggcugccgaagugagcugggaggaagaggccgaacauuccggcaccucucacaauauccucguugaggugcaggaugacgggacaaugaaaauuaaggaugaggaacgcgacgauacccugacaauccuucugaaagcuacccuccuggcggucagcggaguguaccccauguccaucccugccacgcucuucguuugguauuucuggcaaaagaagaaacagagaucuggcgugcugugggacacccccagcccgccugaggucgaacgggcugugcuugaugacggcauuuaccgcauccugcagagagggcugcucggacggucccaggucggcguggggguuuuucaagacggaguguuccauacaauguggcacgucacccgcggcgccgugcugauguaucaggggaagagacuugagcccucuugggccagcguuaaaaaggaucugauuuccuacggaggcggcuggcgguuucaggggagcuggaacacaggagaggaagugcaggucaucgcuguggagccuggcaaaaaucccaagaacgugcaaaccacaccggggacguucaagaccccugaaggagagguuggcgccauugcgcucgacuuuaaacccgggacaucuggauccccuaucgucaauagagaaggcaagauugugggccuguacgggaacggaguggucaccaccagcggcacauaugugucugcuaucgcccaggccaaagcuucccagcaagggccccuccccgagaucgaggaugaaguuuucaagaaacgcaaucugacgauuauggaccuucacccuggaagcggcaagacccggagauaccugccggccaucgugcgcgaggcgauuaagcggaaacugagaacacucauccuggcucccacccgcgucguggccuccgaaauggccgaggcucuuaaggggaugccuauucgguaucagacaaccgccguuaaaucugaacauacgggcagagagaucguggaucugaugugccacgcuacauuuaccaugcgccuccugagccccguccgggugccuaacuacaauaugaucauuauggacgaggcccauuucaccgaucccgcguccaucgccgcuagaggauauauuagcacacggguuggcaugggggaagccgcugccaucuuuaugaccgccacaccuccgggaucuguggaggcuuucccccaguccaacgcggucauucaggacgaagagcgcgauaucccugaaagaagcuggaauucuggcuacgacuggaucaccgauuuucccgggaagacggugugguucgugccuagcauuaaauccggaaacgacaucgccaauugucugcggaagaacggcaagcgcgucauucaacucucuagaaaaacauucgacaccgaguaucagaagacaaaaaacaaugauugggacuacguugugaccacggauaucagcgagaugggggcuaacuuucgggccgacagagugauugauccccgccggugccuuaagccggucauccugaaagacggcccugaaagagugauucuggccggacccaugcccguuaccguggcuuccgccgcgcagcgccggggcagaaucgggcgcaaucagaacaaggagggagaucaauacgucuauaugggccagccucucaauaacgacgaagaucacgcucauuggacagaggccaagaugcugcuugacaauaucaacacccccgaggggauuaucccugcccuguucgaaccggagcgggaaaaaucugcugccauugauggagaguacagacuccgcggcgaagcgagaaagacauuuguggagcugaugcggcgcggggaccugcccguuuggcucagcuauaaaguggccuccgagggcuuccaguacagcgauagacgguggugcuuugacggagaacgcaauaaccagguccuugaggaaaauauggacguggagaucuggaccaaggaaggcgagagaaaaaagcugcggccuagauggcuggaugcucgcacauauucugacccccucgcccugcgggaguucaaagaauuugcugccgggagacgcuccgucagcggagaucuuauucuggagaucggcaagcucccucaacaccugacccugcgggcucagaacgcccucgacaaucuugugaugcugcacaacuccgaacaggggggaaaggcguacagacaugccauggaggaacugcccgauacgaucgagacacucaugcugcuugcucugauugccguucucaccggcggcgugacccuguucuuucugucugggaaaggacucggcaagacaagcaucgggcuucugugugugauggcuuccucugcccugcucuggauggccagcgucgagccgcacuggauugcugcguccaucauucuggaauucuuucuuaugguucugcucaucccugagcccgaccggcagcgcaccccucaagauaaucagcuggccuauguggugaucggacugcucuucaugauucuuacagucgcugccaacgaaaugggccugcuggagacgaccaaaaaggaccucgggaucggacauguggccgcugagaaccaccaccaugccacaaugcuggauguugaccuuagacccgcgagcgccuggacccuguacgcuguggccacaaccgucauuacgccuaugaugcggcacaccaucgaaaauacaaccgcuaacauuucucucacagccaucgcgaaucaggccgcuauucugaugggccuggauaaaggcuggcccaucuccaagauggacaucggggugccgcuccuugcccugggaugcuacagccaagucaacccucugacccucacggcugccgugcugaugcuuguugcucauuaugccauuaucggccccgggcugcaggcgaaggccacacgcgaggcucagaaaagaaccgccgcuggaauuaugaagaaucccacaguggauggcaucgucgccauugaccucgacccugugguuuacgaugccaaauuugaaaagcagcuggggcaaaucaugcugcucauccuuuguaccucucagauucugcugaugcggaccacaugggcgcucugcgaguccaucacgcuggcuaccggaccgcuuacaacccugugggaaggcagccccggcaaauucuggaacacaaccauugccgugucuauggcuaauaucuuccgcgggagcuaucucgccggagccggccuggcuuuuucccugaugaagucucucgggggaggcagacgggggacgggagcccagggcgagacacuuggcgagaaguggaaacgccagcugaaccaacugagcaaguccgaauucaauaccuacaaaagaagcgggauuauggaggucgaccgguccgaagcgaaggagggacucaaaagaggcgaaaccacaaagcacgccgugucucgcgggaccgcuaagcugcggugguuuguggagagaaaccuuguuaaaccugagggaaaggucaucgaucugggcugugggcgcggaggcuggagcuauuacugcgccggccucaaaaaggugacagaagugaaaggguauacgaagggaggccccgggcaugaggaaccuauccccauggcuaccuacggauggaaucuggucaaacugcacuccggcaaggacguuuucuuuacaccuccggagaagugugauacccuccuuugcgacauuggggaaucuagccccaacccuacaaucgaggagggacggacccugagagugcugaaaaugguggaacccuggcuccgcggcaaucaguucuguauuaagauccugaacccuuacaugcccuccgucguggagacgcuugaacagaugcagcggaaacacggcgggaugcugguuagaaauccgcucucucgcaacagcacccaugagauguauuggguguccugcggaacaggcaauauugucagcgccgugaacaugaccucucggaugcugcugaacagauuuacaauggcgcaccgcaagccuaccuacgagcgggauguugaccucggggccggaacaagacauguggcugucgaacccgagguggccaaucuggauaucauuggccaacgcaucgaaaacaucaaaaaugagcacaaguccaccuggcacuaugacgaagauaaccccuacaagacgugggcuuaucaugggagcuacgaggugaaaccuucuggauccgccagcucuauggucaauggcguugugagacuucugacaaagcccugggacgugauuccuauggucacccagaucgcuaugaccgacacaacgccguucggccagcaacggguguuuaaagagaagguugauacccgcacacccagagccaaacgggggaccgcgcagauuauggaagugacagccaaguggcucuggggauuccuguccagaaacaagaaaccucggaucuguacccgcgaggaauuuacaagaaagguccggagcaaugcugccauuggcgcuguguucguugacgagaaccaguggaauuccgccaaagaagccguggaggaugagcgcuuuugggaccuuguccacagagaacgggagcugcauaagcaggggaaaugcgcgaccugcguguauaacaugaugggaaagcgcgaaaagaaacucggcgaguucgggaaggcuaaaggcagcagagccaucugguacauguggcugggagcccgguuccuggaauuugaggcucucggcuucaugaaugaggaucacugguuuucucgcgaaaacagccuguccgggguugagggagaaggccuucauaagcugggguacauccucagagacauuucuaaaauccccggaggcaauauguaugccgaugacacggcugggugggauacccggauuacagaggacgaucugcaaaacgaggccaagaucaccgacauuauggaaccugagcacgcgcuucuggccacaagcaucuucaaacucaccuaccagaauaaggugguccgcgugcagagacccgcuaagaacggcacggucauggaugugaucucccggcgcgaccagagaggaucuggccaaguugggacauauggacugaacaccuuuacaaauauggaagugcagcugauucggcagauggagagcgaaggcaucuuccucccgugugagcuggagaccccuaaccuugccgaaagaguccuggacuggcucgagaaacacggggcugaacgccugaagcggauggccauuuccggagaugacugcguggugaaacccaucgaugacagauuugcgacggcccuuauugcucugaaugauaugggcaagguucgcaaagacaucccucagugggagcccucuaagggguggaacgauuggcaacaggugccuuucuguagccaucacuuucaucagcucaucaugaaggacggccgggaaauugucgugcccugcagaaaucaggaugagcugguuggacgcgcccgggugucccaaggcgcuggguggagccugagagagaccgccugucucggaaaaucuuacgcucagauguggcagcugauguauuuccaccgccgggaccuuagacuggccgcgaacgccaucugcuccgcugucccgguggauugggucccuacaagccgcaccacauggucuauucacgcccaucaccaauggaugaccacagaagacaugcucuccguguggaaucggguuuggaucgaggaaaaccccuggauggaggacaagacccaugugagcuccugggaagagguccccuaccugggcaaaagagaggaucaguggugugggucucuuauuggacugacggcccgggcuacaugggccaccaauauccagguggcgauuaaccagguuagacgccucaucggcaaugaaaacuaucuggacuacaugaccagcaugaagcgguuuaaaaaugaguccaacccugaaggggcucugugguga

SEQ ID NO: 18754 - RNA, 9879 nt, Artificial Sequence
  derived and/or modified CDS sequence (opt5) from DENV-1__FJ410183__SS-prME
agcgugaccaugcugcucaugcugcuucccaccgcccuggcuuuccaccucacgaccagaggcggggagccucauaugaucgucuccaagcaggaacggggaaagucucugcuuuuuaagacaagcgccggcauuaacaugugcacccugaucgcgauggaccucggggagcugugugaagauacaaugaccuacaaaugccccagaauuacagaggcugaacccgacgauguugacuguuggugcaaugccaccgauacgugggugaccuauggaacauguucccagaccggcgagcacagacgggacaagcgcucuguggcccuggcuccucaugucgggcucggacuggagacaagaaccgaaacguggaugagcuccgagggcgccuggaaacagauccagaagguggaaacaugggcccuucggcaccccggcuucaccguuacagccuuuuuccuggcgcaugccauugggaccucuaucacccagaagggaaucauuuuuauccuccugaugcuugugacaccuagcauggcuaugcgcugcgucggcauugggaacagagauuucguggagggacuguccggcgccacguggguugacgugguccucgagcacgggagcugugugaccacaauggcuaaagauaagcccacccuggacaucgaacugcucaaaacagaggugaccaauccugccguccugcggaaacuuugcauugaagcgaaaaucucuaacacgacaaccgauucccgcuguccgacccaaggagaggccacacugguugaggaacaggacagcaauuuugugugcagacggaccuucguggaucgcggcuggggcaacggguguggacucuuuggcaaggggucucugcuuacaugcgcuaaguucaaaugcgucacgaagcuggagggaaaaauugugcaguacgaaaaucucaaguauuccguuaucgugaccguccacacaggcgaccagcaucaaguggggaacgagaccacagaacacggaaccaucgccacgauuacaccccaggcuccuacaagcgagauccagcugaccgacuacggcgcccugacacucgauuguucucccagaaccggccuggacuuuaaugaaaugguucuucugacgaugaaagagaaguccuggcucgugcauaaacagugguuccuggaucuuccucugcccuggacaagcggggccuccaccucucaagagacauggaaccggcaggaccuccuggucaccuuuaagaccgcucacgcgaagaaacaggaaguggucgugcugggaagccaagagggcgccaugcacacagcucucacgggggccaccgaaauucagacauccggaaccacaaccaucuucgccggccaucugaagugccgccuuaaaauggauaagcugacgcucaaagggaugagcuauguuauguguacaggcucuuucaagcuggagaaggaaguggcugagacccagcacggaaccguccuggugcagguuaaauacgagggcacagacgccccgugcaagauuccuuuuuccgcgcaagaugaaaaaggggugacccagaauggaagacuuaucacagcuaaccccaucgucacggacaaggagaaaccugugaauauugaaaccgagccgcccuucggcgagagcuauaucgugguuggggccggagaaaaggcccucaagcugucuugguuuaaaaagggcagcuccauugggaaaauguucgaggcuacagcccggggcgcuagacgcauggccauccugggagauaccgcgugggacuuuggcucuauugggggagucuucacaagcgugggcaagcucgugcaucaggucuuuggggccgcuuacggagugcuguucuccggcguuagcuggaccaugaaaaucgggaucggcauucuucugacguggcucggacugaacucucgguccaccagccugucuaugacauguaucgccgugggcauggucacccuuuaccucggggugaugguucaggcugauuccggaugcgugauuaauuggaagggcagagaacugaagugugggagcggaaucuuugucacaaacgaggugcacaccuggacagaacaauauaaauuccaggccgacuccccuaagcgccugucugcggccauuggcaaggcuugggaggaggggguuugcggcauccggagcgccaccagacucgaaaacauuauguggaagcagaucuccaaugagcugaaccauauccuucuggaaaaugacaugaaauuuacgguggucgugggagaugcuaacggcauucucgcccaggggaagaaaaugauccgcccgcaacccauggagcaccgguacucuuggaaaagcuggggaaaggccaaaauuaucggcgcugacauucagaauacaaccuucaucaucgaugggccugacacccccgaauguccugaugaccagagagcguggaacauuugggagguggaggauuauggauuuggcaucuucacaaccaauauuuggcugaagcugcgcgacuccuacacgcagaugugcgaucaccggcuuaugagcgccgcuaucaaagacucuaaggccguccaugccgauaugggcuauuggauugaauccgagaaaaacgaaacauggaagcucgcuagagccagcuucaucgagguuaagaccuguaucuggcccaaaucucacacacugugguccaauggggugcuggaaagcgagaugauuaucccgaagauguacggaggcccuaccucucaacauaacuaucgccccggguacuuuacacagaccgcgggaccuuggcaccucggcaaacuggagcuugacuucgaucugugcgaagggacgaccguggucguggacgagcacugcggaaaucggggccccagccucagaacaaccacaguuaccggcaagauuauccaugaaugguguugccgguccuguacgcugccuccccugcgcuuuagaggggaggacggaugcugguacggcauggagauucggccggugaaagaaaaggaggaaaaccuugucagaagcauggugucugcuggguccggagagauggauagcuucucccucggcauccuguguguuucuaucaugauugaagaggugaugcgcagccggugguccagaaagaugcugaugacagggacccucgccgucuuucugcuucugaucaugggacagcucacauggaaugaccugauucgccugugcaucauggugggcgccaacgcuucugauagaaugggcauggggaccaccuaucuugcccugauggcgacauucaaaaugcggccuauguuugcuguuggacuccuguuccgcagacucacgagccgggaggugcugcuucugaccauuggccucucccuggucgccucuguggaacugcccaauagccuugaggaacugggggacggacucgccaugggcaucaugaugcugaagcuccugacagaguuucaaccccaccagcuuuggaccacacugcucucccugaccuucauuaaaacgacacugagccuugauuacgcuuggcgcaccauggccauggugcugucuaucgucucccucuuuccucugugucucagcaccacaucucagaagaccacauggcugccgguucuucugggguccuucggaugcaaaccccugacgauguuucucaucaccgaaaacaagauuuggggcagaaagagcuggccucugaacgagggcaucauggcuauugggaucgugucuauucuucuguccagccuccugaaaaaugacgugccccucgccggaccucugaucgcgggcgggaugcuuaucgccuguuaugucauuuccggaagcucugcugaucugagccuggagaaggccgcugaaguguccugggaggaagaggccgaacauucuggcacaagccacaacauccucguugaggugcaggacgaugggaccaugaaaauuaaggacgaggaacgggaugacacacugaccauccuucugaaagccacgcuccuggcugucuccggaguguaccccaugucuauuccugcgacccucuucguuugguauuucuggcaaaagaaaaagcagcgcagcggcgugcugugggauacacccuccccgccugaggucgaaagagccgugcuugacgacggcaucuaccggauccugcagcgcgggcugcucggaagaucucaggucggcguggggguuuuucaagauggaguguuccauaccauguggcacgucacacggggcgcugugcugauguaucaggggaagagacuugagcccagcugggccuccguuaaaaaggaccugauuagcuacggaggcggcuggcgcuuucaggggucuuggaauaccggagaggaagugcaggucaucgccguggagccuggcaaaaaccccaagaaugugcaaacaacgccggggaccuucaaaacaccugaaggagagguuggcgcuauugcccucgauuuuaagcccgggaccuccggaagcccuaucgucaaccgggaaggcaagauugugggccuguacgggaauggaguggucaccacaucuggcacguauguguccgcgaucgcucaggccaaaaccagccaggaggggccccuccccgagauugaagacgagguuuucaagaaaagaaaccugacaaucauggaucuucacccuggauccggcaagacccgccgguaccugccggccaucgugagagaagcuauuaaacgcaagcugcggacacucauccuggcccccaccagagucguggcgucugagauggcugaagcccuuaaggggaugccuauucgcuaucaaacgacagccguuaaaagcgagcauaccggccgggagaucguggaccugaugugccacgcuaccuuuacaaugagacuccugucccccguccgggugccuaauuacaacaugauuaucauggaugaagcccauuucaccgaccccgcuagcaucgccgcgcgcggauauauuucuacaagaguuggcaugggggaggccgcugccaucuuuaugaccgcuacgccuccgggauccguggaagccuucccccagagcaaugccgucauucaggaugaggaacgggacaucccugagcgcucuuggaacagcggcuacgauuggauuacagacuuucccgggaagaccgugugguucgugccuuccaucaaaucuggaaaugacaucgcuaacugucugagaaagaauggcaaacgggucauucagcucagcagaaagacauucgauaccgaguaucaaaagacgaaaaacaacgacugggauuacguugugaccacagacaucuccgaaaugggggcgaauuuucgcgccgaucgggugauugaccccagacgcugccuuaagccggucauccugaaagauggcccugagcgggugauucuggcuggacccaugcccguuaccguggccucugccgcucagagacgcggccggaucgggagaaaccagaauaaggaaggagaccaguacgucuauaugggccaaccucucaacaaugaugaggaccacgcccauuggacagaggcgaaaaugcugcuugauaacauuaauacccccgaagggaucaucccugcucuguucgagccggaacgcgaaaagagcgccgccauugacggagaauacagacuccggggcgaggcucgcaagacauuuguggagcugaugagaagaggggaucugcccguuuggcucuccuauaaaguggccagcgaaggcuuccaguacucugaccgcagauggugcuuugacggagagcggaacaaucagguccuugaagagaacauggauguggaaaucuggaccaaggagggcgagcgcaagaagcugcgcccucgguggcuggacgcgagaacguauuccgauccccucgcccugcgcgaguucaaagaguuugcugccgggcggagaagcgucuccggagaccuuauucuggaaaucggcaagcucccucagcaccugacacugcgggcucaaaaugcccucgauaaccuugugaugcugcacaauucugagcaagggggaaaggcuuaccgccaugccauggaggaacugcccgacaccauugagacccucaugcugcuugcgcugaucgccguucucacaggcggcgugacccuguucuuucugagcgggaagggacucggcaagacauccaucgggcuucugugugugauggcuucuagcgcccugcucuggauggcuaacgucgaaccgcacuggauugccgccuccaucauucuggaguucuuucuuaugguucugcucaucccugaacccgauagacagcggacgccucaggacaaucaacuggcuuauguggugauuggacuccuguucaucauccuuaccgucgcggccaacgagaugggccugcuggagacaaccaaaaaggaucucgggauuggacauguggcugccgaaagccagcaccacgccacaaugcuggacguugaucuucgccccgcuucugccuggacccuguacgcgguggccacgaccgucaucacaccuaugaugagacauaccauugagaacacaaccgcuaauaucucccucacggccauugcuaaccaggccgcgauccugaugggccuggacaaaggcuggcccauuagcaagauggauaucggggugccgcuccuugcccugggaugcuacucucaagucaauccucugacacucaccgcugccgugcugaugcuuguugcucacuaugccaucauuggccccgggcugcaggcuaaagccacacgggaagcgcagaagcgcaccgccgcuggaaucaugaagaaccccaccguggacggcauugucgccaucgaccucgauccugugguuuacgacgcuaaauuugagaagcagcuggggcaaauuaugcugcucauccuuuguacaucccagauccugcugaugagaacgaccugggcccucugcgaaagcauuacacuggccaccggaccgcuuacaacccugugggagggcucucccggcaaauucuggaauacgacaaucgcggugagcauggcuaacauuuuccggggguccuaucucgccggagcuggccuggccuuuucucugaugaaaagccucgggggaggccgcagagggaccggagcccagggcgagacccuuggcgaaaaauggaagcggcagcugaaucaacuguccaagagcgaguucaacacauacaaaagauccgggaucauggaagucgaucgcucugaggcuaaggaaggacucaaacggggcgagaccacaaagcaugccgugagcagagggacggcgaaacugcgcugguuuguggagcggaaucuuguuaagccugaaggaaaggucauugaccugggcugugggagaggaggcugguccuauuacugcgccggccucaaaaaggugaccgaggugaaaggguauacaaagggaggccccgggcacgaggaaccuauccccauggcuaccuacggauggaaccuggucaaacuguacucuggcaaggauguuuucuuuacaccuccggaaaaaugugacacccuccuuugcgauaucggggagagcucccccaauccuacgauugaggaaggacgcacccugcgggugcugaagaugguggagcccuggcucagaggcaaccaguucuguaucaagauucugaauccuuauaugcccucugucguggaaacacuugagcagaugcagcgcaaacauggcgggaugcugguucggaacccgcucagcagaaauuccacccacgagauguacugggugagcugcggaacaggcaacaucgucucugccgugaauaugaccucccgcaugcugcugaaccgguuuacaauggcucacagaaagccuaccuaugaacgcgacguugaucucggggccggaacgagacauguggcggucgagcccgaaguggccaaccuggacauuaucggccaacggauugagaauaucaaaaacgaacacaagagcacauggcauuacgaugaggacaaucccuauaaaaccugggcuuaccacgggucuuaugaggugaagccuuccggaagcgccucuuccauggucaacggcguugugcgccuucugaccaagcccugggacgugaucccuauggucacacagauugcuaugacggauaccacaccguucggccagcaaagaguguuuaaagaaaagguugacacccggacacccagagccaaacgggggaccgcucagaucauggaggugacagccaaguggcucuggggauuccugagccgcaauaaaaagccuagaauuuguacccgggaagaguuuacgcgcaaggucagauccaacgcggccaucggcgcuguguucguugaugaaaaucaguggaacagcgccaaagaggcuguggaggacgaacgguuuugggaucuuguccaccgcgagagagaacugcauaagcaggggaaaugcgcuaccugcguguacaauaugaugggaaagcgggagaaaaagcucggcgaguucgggaaggccaaaggcucucgcgcgauuugguacauguggcugggagcuagauuccuggaguuugaggcccucggcuucaugaacgaagaccacugguuuagccgggaaaauuccuucucugggguugaaggagagggccugcauaaacuuggguauauccugcgcgauaucagcaaaauucccggaggcaacauguacgccgacgauacagcugggugggacaccagaaucacagaggaugaccuccaaaaugaagccaagauuaccgauaucauggagccugaacacgcucugcuugccacguccauuuuuaaacugacauaucagaacaaggugguccgggugcagcgccccgcgaaaaauggcaccgucauggacgugaucucuagacgggaccagagaggaagcggccaaguugggacauacggacucaacaccuucacgaacauggaggugcagcugauccgccagauggaauccgagggcauuuuucugccgucugagcucgaaaccccuaaucuggccgagcggguccuugauuggcuggaaaagcaugggacagagagacucaagcgcauggcuaucagcggagacgauuguguggugaaacccguugacgaucgguucgccaccgcucugauugcccuuaacgacaugggcaaggugagaaaagauaucccucagugggaacccuccaagggguggaaugacuggcaacaggucccuuuuugcagccaccacuuccaucagcugauuaugaaagauggccgcgagaucgugguucccugucggaaccaggacgagcucgugggacgggcgcgcgucucucaaggcgccggguggucccugcgggaaacagcuugccugggaaagagcuaugcccagauguggcagcucauguacuuucacagacgcgaucugcggcuugcugccaaugcuaucuguucugccgugccggucgacugggugccuaccuccagaacaaccuggagcauucaugcgcaccaccaauggaugacgacagaggacaugcuguccguuuggaaccggguguggaucgaagagaaucccuggauggaagauaagacccaugucucuagcugggaggaggugcccuaucucggcaaaagagaagaccaguggugcgggucccugauuggacuuaccgcccgcgcuacaugggccaccaacauccagguugccauuaaucaggugcggagacugaucggcaacgagaauuaccucgauuacaugacaagcaugaagcgcuucaaaaacgaaucugacccugagggggcucugugguga

SEQ ID NO: 18755 - RNA, 9879 nt, Artificial Sequence
  derived and/or modified CDS sequence (opt5) from DENV-1__FJ410184__SS-prME
agcgugaccaugcugcugaugcugcuucccacagcucuggcuuuccaccucacgacccggggcggggagccucauaugaucgucuccaagcaggaacggggaaaaucucugcuuuuuaagaccagcgcuggcauuaacaugugcacccugaucgcgauggaccucggggagcugugugaagauacaaugaccuacaaaugccccagaauuacagaggcugaacccgacgauguugacuguuggugcaaugccaccgauacgugggugaccuauggaacauguucccaaaccggcgagcacagacgggacaagcgcucuguggcccuggcuccucaugucgggcucggacuggagacaagaaccgaaacguggaugagcuccgagggcgccuggaaacagauccagaagguggaaacaugggcccuucggcaccccggcuucaccguuauugcccuguuucucgcgcaugccaucgggacaucuaucacccagaagggaauuaucuucauucugcuuaugcuggugaccccuagcauggcuaugcgcugcgucggcaucgggaacagagauuuuguggagggacucuccggcgccacauggguugacgugguccuggagcacgggagcugugugacgaccauggcuaaagauaagcccacacuggacauugaacuccugaaaaccgaggugacaaauccugccguccuucggaagcugugcaucgaagcgaaaauuucuaacaccacgacagauucccgcuguccgacccaaggagaggccacccucguugaggaacaagacgcuaauuucgugugcagacggacauuuguggaucgcggcuggggcaacggguguggacuguucggcaaggggagccuucugaccugcgccaaguuuaaaugcgucacaaagcucgagggaaaaaucgugcaguacgaaaaucugaaguauucuguuaucgugacgguccacaccggcgaccagcaucaaguggggaacgagacaaccgaacacggaacaauugcuaccaucacgccccaggccccuaccuccgagauucagcugacagacuacggcgcccucacccuggauuguagccccagaacaggccuugacuucaaugaaaugguucugcucaccaugaaagagaagucuuggcuggugcauaaacagugguuucuugaucugccucuccccuggacguccggggcuagcacaucccaagagaccuggaaccggcaggaccugcuggucacauucaagaccgcgcacgccaagaaacaggaaguggucgugcucggaucucaagagggcgcuaugcacaccgcccugacaggggccacggaaauccagaccagcggaacaaccacaauuuuugcuggccaucuuaagugccgccugaaaauggauaagcucacccugaaagggauguccuauguuauguguacgggcagcuucaagcuggagaaggaaguggccgagacacagcacggaaccguccuugugcagguuaaauacgagggcaccgacgcgccgugcaagaucccuuucucugcucaagaugaaaaaggggugacacagaauggaagacucaucaccgccaaccccauugucacagacaaggagaaaccugugaauaucgaaacggagccgcccuuuggcgaguccuauauugugguuggggccggagaaaaggcucugaagcugagcugguucaaaaagggcucuagcaucgggaaaauguuugaggccaccgcucggggcgccagacgcauggcgauucucggagauacagccugggacuucggcuccaucgggggagucuuuaccucugugggcaagcuggugcaucaggucuucgggacagcuuacggagugcuuuuuagcggcguuuccuggaccaugaaaaucgggauuggcauccugcucacguggcugggacugaacagccggucuaccucccuuagcaugacauguauugccgugggcauggucacccucuaccugggggugaugguucaggcugauucuggaugcgugaucaauuggaagggcagagaacugaaguguggguccggaauuuucgucacaaacgaggugcacaccuggacagaacaauauaaauuucaggccgacagcccuaagcgccucuccgcggccaucggcaaggcuugggaggaggggguuugcggcauucggucugccaccagacuggaaaacaucauguggaagcagaucagcaaugagcuuaaccauauucugcucgaaaaugacaugaaauucacgguggucgugggagaugcuaacggcauccuggcccaggggaagaaaaugauucgcccgcaacccauggagcaccgguacuccuggaagucuuggggaaaggccaaaaucauuggcgcugacauccagaauacaaccuuuaucauugaugggccugacacccccgaauguccugaugaccagagagcguggaacaucugggagguggaggauuauggauucggcauuuuuacaaccaauaucuggcugaaacuucgcgacagcuacacgcagaugugcgaucaccggcucauguccgccgcuauuaaagacagcaaggccguccaugccgauaugggcuauuggaucgaaucugagaaaaacgaaacauggaagcuggcuagagccuccuucaucgagguuaagaccuguauuuggcccaaaagccacacacuguggucuaauggggugcucgaauccgagaugaucauuccgaagaucuacggaggcccuauuagccaacauaacuaucgccccggguacuucacccagacagcgggaccuuggcaccugggcaaacuugagcuggacuuugaucucugcgaagggaccacgguggucguggacgagcacugcggaaaucggggccccucucugagaaccacaaccguuacaggcaagaucauccaugaaugguguugccggagcuguacccugccuccccuucgcuucagaggggaggacggaugcugguacggcauggagauucggccggugaaagaaagagaggaaaaccucgucaaguccauggugagcgcugggcugggagagguugauucuuuuucccugggcauccucugugugagcauuaugaucgaagaggucaugcgcucccgguggucuagaaagaugcugaugacggggacacuugccguguuccugcuccugauuaugggacagcugaccuggaaugaccuuauccgccugugcauuaugguuggcgccaacgcuagcgauagaaugggcauggggacaaccuaucucgcccugauggcgaccuuuaaaaugcggccuauguucgcugugggacuccuguuucgcagacuuacaucccgggagguccugcuccugacgaucggccugucucuuguggccagcguggaacugcccaauucccucgaggaacugggggacggacucgccaugggcaucaugaugcugaaacuucugaccgaguuccaaccccaccagcucuggacaacccugcugucucuuacauuuauuaaaaccacgcugagccucgauuacgcuuggaagacaauggccaugguccuguccaucguuagccucuucccucugugucuuucuaccaccucccagaaaacaaccuggcugccggugcugcucgggagccugggaugcaagccccuuacaauguuucugauuacggaaaacaagaucuggggccgcaaaucuuggccucucaacgagggcauuauggcuaucgggaucguguccauucugcucagcucucugcuuaagaaugacgucccccuggccggaccucugaucgcgggcgggaugcucauugccuguuaugugaucuccggaagcuccgcugaucugagccuugagaaagccgcugaaguuucuugggaggaagaggccgaacauagcggcaccucccacaacauucugguggagguccaggacgaugggacaaugaagaucaaagacgaggaaagagaugacacccucacaauccugcucaaggccacccugcuugcugugucuggaguuuaccccaugagcauuccugcgacgcuguucgugugguauuuuuggcagaagaagaagcagcgguccggcguccugugggauacccccucuccgccugagguggaacgcgccguccucgacgacggcaucuaccgcauucugcagcgggggcuucugggacgcagccaggugggcguugggguguuccaagauggagucuuccauacaauguggcacgugaccagaggcgcuguucucauguaucaggggaaacggcuggagcccuccugggccucugugaagaaagaccucaucagcuacggaggcggcuggagauuucagggggccuggaauacaggagaggaaguccaggugauugcuguggagccuggcaagaaccccaaaaauguucaaaccacaccggggacguucaagaccccugaaggagaggucggcgccaucgcgcuggauuuuaagcccgggacauccggaagcccuauugugaaccgcgaaggcaaaaucgugggccuuuacgggaauggagucgugaccaccucuggcacauauguuuccgcuaucgcccaggccaagacgagccaggaggggucucugcccgagauugaagacgagguguucaaaaagcggaaccugaccaucauggaucuccaccccggauccggcaaaacaagacgcuaccugccugcuauuguccgggaagccaucaagagaaaacuucgcacccugauucucgcgccgacacgggugguugcuagcgagauggccgaagcccugaaagggaugcccaucagauaucaaaccacggcugugaaguccgagcauacaggccgcgagaucgucgaccugaugugccacgccaccuuuaccaugcggcuccuuucuccugugagaguucccaauuacaacaugauuaucauggaugaagcucauuucacagacccugccagcauugcggcccggggauauaucuccacccgcgugggcaugggggaggcugccgcuauuuuuaugacagccacacccccuggaagcgucgaagccuucccgcagucuaaugcugugauccaggaugaggaaagagacauccccgagcgguccuggaacagcggcuacgauuggauuacggacuuuccugggaaaacagugugguucguccccucuaucaagagcggaaaugacauugcgaacugucugcgcaaaaauggcaagagaguuauccagcugucccggaagaccuuugauacagaguaucagaagaccaagaacaacgacugggauuacguggugacgaccgacauuucugaaaugggggccaauuucagagcugaucgcgucaucgacccucggagaugccucaaacccgugauucugaaggauggcccggagcgcguuauccuugccggaccuaugcccgugacagucgccagcgcugcccagcggagaggccgcaucgggcggaaccagaauaaagaaggagaccaguacguguauaugggccaaccccugaacaaugaugaggaccacgcgcauuggaccgaggcuaagaugcuccuggauaacauuaauacaccugaagggaucauucccgcccuguucgagccugaaagagagaaguccgccgcuaucgacggagaauaccgccucagaggcgaggcccggaaaaccuuuguugagcuuaugcgcagaggggaucugccgguguggcugucuuauaaggucgcgagcgaaggcuuccaguacuccgaccggcgcuggugcuuugacggagagagaaacaaucaggugcucgaagagaacauggaugucgaaauuuggacaaaagagggcgagcggaagaaacugagaccccgcuggcuugacgcccggaccuauagcgauccucuggcucucagagaguucaaggaguuugccgcugggcgccggucuguguccggagaccugauccuggaaaucggcaaacucccccagcaccuuacgcugagagcccaaaaugcucuggauaaccucguuaugcugcacaauagcgagcaagggggaaaggccuaccggcaugcgauggaagaacuuccugacacaauugagacccugaugcuccuggcccugaucgcugugcucaccggcggcgugacacuuuucuuucuguccgggaagggacugggcaaaaccucuauugggcuccugugugucauggccagcuccgcccuucuguggauggccucuguugaaccccacuggaucgccgcuagcauuauccucgaguucuuucugauggugcugcucaucccggaaccugaucgccagagaacaccccaggacaaccaacuugcguauguggucauuggacugcuguucaugauccucacgguggccgcuaaugagaugggccugcuugagaccacaaagaaagaucuggggauuggauacguugccgccgaaaaccaucaccacgcuaccaugcucgacguggaucugcggccugccuccgcguggacacuguacgccgucgcuaccacggugaucacccccaugaugcgccauacaauugagaacaccacagccaauaucagccucaccgcuauugccaaccaggcggccauccuuaugggccuggacaagggcuggccuaucucuaaaauggauauuggggucccccugcucgcucugggaugcuauucccaggugaauccgcuuacgcugacagccgcuguucucaugcugguggcccacuacgcuaucauuggcccugggcugcaagccaaggcgaccagagaagcccagaagcggacagcugccggaaucaugaaaaaccccaccgucgacggcauuguggcuaucgaccucgaucccguuguguaugacgccaaguuugagaaacagcuugggcagaucaugcugcugauucucuguaccagccaaauccugcuuaugcgcacaacgugggcccugugcgaaucuauuacccucgcgacaggaccucugaccacacugugggagggcuccccgggcaaguucuggaauaccacgaucgcugucagcauggccaacauuuuuagagggucuuaccucgcuggagccggccuugccuucagccugaugaaaucccucgggggaggccggcgcgggacaggagcucagggcgagacccucggcgaaaaguggaagagacagcugaaucagcuuucuaaaagcgaguucaacaccuauaagcgguccgggaucauggaaguggauagaagcgaggccaaagaaggacugaagcgcggcgagacaaccaaacaugcggugucccgggggacagccaagcucagaugguuuguugagcgcaaucuggucaagcccgaaggaaaagugaucgaccugggcugugggcggggaggcuggucuuacuauugcgcuggccucaagaaagugacggaggucaagggguacaccaaaggaggcccugggcacgaggaacccauuccuauggccacauacggauggaaccuuguuaagcugcauagcggcaaagauguguucuuuacacccccugaaaagugugacacccugcucugcgauaucggggaguccucuccgaaucccaccauugaggaaggaagaacgcugcgcgugcuuaagauggucgagccuuggcugcggggcaaccaauucuguaucaaaauucucaaucccuauaugccuagcgugguugaaacccuggagcagaugcagagaaagcacggcgggaugcuggugcgcaacccccucuccagaaauucuacacacgagauguacugggucagcugcggaaccggcaacaucguguccgcuguuaauaugacaagcagaaugcugcuuaaccgcuuuaccauggcccaucggaaaccgacauaugaaagagacguggaucugggggcgggaacccgccacgucgccguggagccugaaguggcuaaccucgacauuaucggccagagaaucgagaauauuaagaacgaacauaaaucuacguggcacuacgaugaggacaaucccuauaagacaugggccuaccacggguccuaugaggucaagcccagcggaucugcuuccagcaugguuaacggcguggugcggcugcuuaccaaaccuugggacgucauccccauggugacccaaauugccaugacagauacgaccccuuucggccagcagcgcguuuuuaaggaaaaaguggacacaagaaccccgcgggcuaagagagggacagcccaaaucauggaggucaccgcgaaauggcuguggggauuccucucucggaauaagaagccccgcauuuguacaagagaagaguuuacccggaaagugcgcuccaacgccgcuaucggcgccguuuucguggaugaaaaucaguggaacagcgcuaaggaggccgucgaggacgaaagauuuugggaucuggugcaucgggagcgcgaacugcacaaacaggggaagugcgccacgugcguuuacaauaugaugggaaaaagagagaagaagcucggcgaguucgggaaagcgaagggcucccgggcuaucugguacauguggcugggagcccgcuuucuugaguucgaggcccugggcuucaugaacgaagaccauugguuuagcagagaaaauucuuucagcgggguggaaggagagggccuccacaaacugggguauauucuucgggauaucuccaagauuccuggaggcaacauguacgcugacgauaccgccgggugggacacacgcaucaccgaggaugaccugcagaaugaagcuaaaauuacagauaucauggagcccgaacaugcccuccuggcgaccucuaucuuuaagcugacguaucaaaacaaagucgugagaguccagcggccugccaagaauggcacagugauggacguuauuagccgcagagaccagcggggauccggccagguggggaccuacggacucaacacauucaccaacauggagguccaacugaucagacagauggaaucugagggcauuuuucuucccagcgagcuggaaacgccgaaucucgcugagcgcgugcuggauuggcuugaaaagcacgggaccgagcggcugaaaagaauggccaucuccggagacgauugugugguuaagccuguggacgaucgcuucgcuacagcccucauugcgcugaacgacaugggcaaaguccggaaggauaucccccagugggaaccuucuaaaggguggaaugacuggcagcaagugcccuuuugcagccaccauuuccaccagcugaucaugaaggauggcagagagauuguugugccuugucgcaaccaggacgagcucgucggacgggccagagugucccagggcgcuggguggagccugcgcgaaaccgccugccuuggaaagucuuaugcucaaauguggcagcugauguacuuucaucggagagaucuccgccuggccgcuaaugccaucuguuccgcgguccccguggacuggguuccgacaagccggaccacauggucuauucacgcccaccaucaguggaugaccacggaggacaugcuuuccguguggaacagagucuggaucgaagagaauccuuggauggaagauaaaacacacgugagcuccugggaggagguucccuaucugggcaagcgggaagaccaauggugcgggucucucauuggacugaccgcuagagccaccugggccacaaacauccagguggcuauuaaucagguccgccggcugaucggcaacgagaauuaccucgauuacaugaccagcaugaaaagauucaagaacgaauccgaccccgagggggcccugugguga

SEQ ID NO: 18756 - RNA, 9879 nt, Artificial Sequence
  derived and/or modified CDS sequence (opt5) from DENV-1__FJ410185__SS-prME
agcgugacaaugcugcuuaugcugcuucccacagcccuggcuuuccaccucacgaccagaggcggggaaccucauaugaucgucuccaagcaggaacggggaaaaucucugcuuuuuaagacaagcguuggcauuaacaugugcacccugaucgccauggaccucggggagcugugugaagauacaaugaccuacaaaugccccagaauuacagaggcggaacccgacgauguggacuguuggugcaaugcuaccgauacgugggugaccuauggaacauguucccaaaccggcgagcacagacgggacaagcgcucugucgcccuggccccucauguggggcucggacuggagacaagaaccgaaacguggaugagcuccgagggcgcuuggaaacagauccagaagguugaaacaugggcccuucggcaccccggcuucaccgugauugcucuguuucucgcccaugcgaucgggacaucuaucacccagaagggaauuaucuucauucugcuuaugcuggucaccccuagcauggccaugcgcugcgugggcaucgggaacagagauuuuguugagggacucuccggcgcuacauggguggacgucgugcuggagcacgggagcugugugacgaccauggccaaagauaagcccacacuggacauugaacuccugaaaaccgaggucacaaauccugcuguucuucggaagcugugcaucgaagccaaaauuucuaacaccacgacagauucccgcuguccgacccaaggagaggcgacccucguggaagaacaggacagcaauuucgugugcagacggacauuugucgaucgcggcuggggcaacggguguggacuguucggcaaggggucucuucugaccugcgccaaguuuaaaugcgugacaaagcucgagggaaaaaucguucaguacgaaaaucugaaguauuccgugaucgucacggugcacaccggcgaccagcaucaaguugggaacgagacaaccgaacacggaacaauugcuaccaucacgccccaggccccuaccagcgagauucagcugacagacuacggcgcucucacccuggauuguucucccagaacaggccuugacuucaaugaaauggugcugcucaccaugaaagagaaguccuggcugguccauaaacagugguuucuugaucugccucuccccuggacgagcggggccuccacaucucaagagaccuggaaccggcaggaccugcuggugacauucaagaccgcccacgcuaagaaacaggaagucgugguucucggaagccaagagggcgcgaugcacaccgcccugacaggggcuacggaaauccagaccuccggaacaaccacaauuuuugccggccaucuuaagugccgccugaaaauggauaagcucacccugaaagggaugagcuaugugauguguacgggcucuuucaagcuggagaaggaagucgccgagacacagcacggaaccgugcuuguucaggugaaauacgagggcaccgacgcuccgugcaagaucccuuucuccgcccaagaugaaaaaggggucacacagaauggaagacucaucaccgcgaaccccauugugacagacaaggagaaaccugugaauaucgaaacggagccgcccuuuggcgagagcuauauuguuaucggggcuggagaaaaggcccugaagcugucuugguucaaaaagggcagcuccauugggaaaauguuugaggccaccgcucggggcgccagacgcauggcuauccucggagauacagccugggacuucggcucuaucgggggagucuuuaccagcgugggcaagcuggugcaucaggucuucggggcggccuacggagugcucuuuuccggcguuagcuggacaaugaaaauugggaucggcauucugcucaccuggcugggacugaacucucgguccacgagccuuucuaugaccuguaucgcugugggcauggucacacucuaccugggggugaugguucaggccgauuccggaugcgugauuaauuggaagggcagagaacugaagugugggagcggaaucuucgucaccaacgaggugcacacauggaccgaacaauauaaauuucaggcugacuccccuaagcgccucucugccgcgauuggcaaagccugggaggaggggguuugcggcauccggagcgcuacaagacuggaaaacaucauguggaagcagauuuccaaugagcuuaaccauauccugcucgaaaaugacaugaaauucaccguggucgugggagaugccaacggcauucuggcucaggggaagaaaaugauccgcccgcaacccauggagcaccgguacucuuggaaaagcuggggaaaggccaagauuaucggcgccgacauccagaauacgacauuuauuaucgaugggccugacacccccgaauguccugaugaccagagagcuuggaacauuugggagguggaggauuauggauucggcaucuuuaccacaaauauuuggcugaaacuucgcgacuccuacacccagaugugcgaucaccggcucaugagcgcggccaucaaagacucuaaggcuguccaugccgauaugggcuauuggaucgaauccgagaaaaacgaaacguggaagcuggccagagcuagcuucauugagguuaagacauguaucuggcccaaaucucacacccugugguccaauggggugcucgaaagcgagaugauuaucccgaagauuuacggaggcccuaucucucaacauaacuaucgccccggguacuucacacagaccgccggaccuuggcaccugggcaaacuugagcuggacuuugaucucugcgaagggacaaccguggucguggacgagcacugcggaaaucggggccccagccugagaacgaccacaguuaccggcaagaucauucaugaaugguguugccgguccuguacacugccuccccuucgcuucagaggggaggacggaugcugguacggcauggagauccggccggugaaagaaaaggaggaaaaccucgucagaagcauggugucugcgggguccggagagguugauagcuuuucccugggcauucugugugugucuaucaugauugaagaggucaugcgcagccggugguccagaaagaugcucaugaccgggacgcuggcuguguuccuucugcucaucaugggacagcugacauggaaugaccugauucgccuuugcaucaugguuggcgccaacgccucugauagaaugggcauggggaccacauaucuggcucucauggccaccuuuaaaaugcggccuauguucgcggugggacugcucuuucgcagacugaccagccgggagguccuucugcucacaaucggccugucccugguggcuucuguggaacuucccaauagccuggaggaacucggggacggacuggccaugggcauuaugaugcucaagcugcuuacggaguuccaaccccaccagcuguggaccacacuccugucccugaccuuuaucaaaacaacccuuagccuggauuacgccuggcgcacgauggcuaugguccucucuauuguuucccuguucccucucugucugagcacaaccucucagaagaccacauggcuuccggugcugcugggguccuuuggaugcaaaccccucaccauguuccugaucacagaaaacaagauuuggggcagaaagagcuggccucuuaacgagggcaucauggccaucgggauugugucuauccugcucuccagccugcucaaaaaugacgucccccuggcuggaccucuuauugccggcgggaugcugaucgcguguuaugugauuuccggaagcucugccgaucugagccucgagaaggcugccgaaguuuccugggaggaagaggcugaacauucuggcacgagccacaacauccugguggagguccaggacgaugggaccaugaaaaucaaggacgaggaacgggaugacacacuuaccauucugcucaaagccacacugcucgccguguccggaguuuaccccaugucuaucccugcuacccuguuugugugguauuucuggcaaaagaaaaagcagcgcagcggcguccuuugggauacgcccuccccgccugagguggaaagagcgguccuggacgacggcauuuaccggauccugcagcgcgggcuccugggaagaucucaggugggcguugggguguuccaagauggagucuuucauaccauguggcacgugacacggggcgccguucuuauguaucaggggaagagacuggagcccagcugggcuuccgugaaaaaggaccucauuagcuacggaggcggcuggcgcuuccaggggucuuggaauaccggagaggaaguccaggugaucgccguggagccuggcaaaaaccccaagaauguucaaacaaccccggggacauuuaaaacgccugaaggagaggucggcgccauugcucuggauuucaagcccgggaccuccggaagcccuaucgugaaccgggaagagaagaucgugggccucuacggcaauggggucgugacaaccucuggaaccuauguuuccgccauugcgcaggcuaaaacaagccaggagggcccccugcccgaaaucgaggacgaaguguuuaagaaaagaaaccuuacgauuauggaucugcacccuggguccggaaagacccgccgguaccugccggccaucgucagagaggccauuaaacgcaagcuccggacacugauccuugcucccaccagagugguugccucugaaauggcggaggcucugaagggcaugccuauccgcuaucaaacaaccgccgugaaaagcgagcauacggggcgggaaauugucgaccucaugugccacgccacauucaccaugagacugcugucccccgugcggguuccuaauuacaacaugaucauuauggaugaggcucauuuuaccgaccccgccagcaucgcugcccgcggcuauauuucuacaagagugggaaugggcgaagcggccgcuaucuucaugaccgccacaccuccgggguccgucgaggcuuuuccccagagcaaugccgugauccaggaugaagaacgggacauuccugagcgcucuuggaacagcggauacgauuggaucaccgacuuccccggcaagacggugugguuugucccuuccauuaaaucugggaaugacaucgccaacugucucagaaagaauggaaaacggguuauucagcuuagcagaaagacauucgauaccgaauaucaaaagaccaagaauaacgacugggauuacguggugaccacggacaucuccgagaugggcgcuaauuuccgcgcggaucgggucauugaccccagacgcugccugaagccggugauccugaaagaugggccugaacggguuauccucgccggccccaugcccgugaccgucgcuucugccgcccagagacgcggacggauuggcagaaaccagaauaaggagggggaccaguacguguauaugggacaaccucugaacaaugaugaggaccacgcucauuggacagaagccaaaaugcuucuggauaacaucaauacccccgagggcauuaucccugcgcucuuugaaccggagcgcgaaaagagcgcugccauugacggggaguacagacugcggggagaggcccgcaagacauucguugaacugaugagacggggcgaucuccccguguggcuuuccuauaaagucgcuagcgagggguuucaguacucugaccgcagauggugcuucgacggcgaacggaacaaucaggugcuggaggaaaacauggaugucgagaucuggaccaaggagggagaacgcaagaagcugcgcccucgguggcucgacgccagaacauauuccgauccccuggcgcuucgcgaguuuaaagaguucgccgcuggccggagaagcguguccggggaccugauccucgagauuggaaagcugccucagcaccugacccuccgggcccaaaaugcucuugauaaccugguuaugcugcacaauucugaacagggcgggaaagccuaccgccaugcuauggaggagcuccccgacacgaucgaaacacugaugcuucuggcccucauugcggugcugaccggaggcgugacccuguuuuuccucagcggcaaggggcuuggaaagacauccaucggccugcugugugucauggccucuagcgcucuccuguggauggccaacguugagccgcacuggauugcugccuccaucauccuugaauuuuuccugauggugcuccugauuccugagcccgauagacagcggaccccucaggacaaucaacuggccuauguggucaucgggcuccuuuuuaugauucugacaguggcugcgaacgagaugggacugcucgaaacgaccaaaaaggaucugggcaucgggcauguugccgcugagaaccagcaccacgccacaaugcuugacguggaucugcgccccgccagcgcuuggacccucuacgccgucgcgacaaccgugauuacgccuaugaugagacauaccaucgaaaauacaaccgccaacauuucucugacagcuaucgccaaucaggcugccauccugaugggacucgacaaaggcuggcccauuuccaagauggauaucggcgucccgcuucuggcgcuggggugcuacagccaagugaacccucucacccugacggccgcuguucuuaugcugguggcccacuaugcuauuaucggacccggccuccaggccaaagcuacacgggaggcccagaagcgcaccgcggccgggauuaugaagaaucccacagucgacggaaucguggcuaucgaccuggauccuguuguguacgacgccaaauucgaaaagcagcugggccaaauuaugcuccuuauccuguguaccucucagauucugcucaugagaaccacaugggcucugugcgaguccaucacgcuugccaccgggccgcugacaacccucugggagggaagccccggcaaauuuuggaacacaaccauugccgucucuauggcgaauaucuuccggggcagcuaucuggcuggggccggacuggcuuucucccucaugaagucucuuggcgggggacgcagaggcacgggggcccagggagaaacacugggcgagaaauggaagcggcagcugaaccaacucagcaaguccgaauuuaauaccuacaaaagaagcggcaucauggagguggaucgcuccgaagccaaggaggggcugaaacggggagagaccacaaagcaugcugugucuagaggcaccgccaaacuucgcugguucguugaacggaaccuggucaagccugaggggaaggugauugaccucggauguggcagagggggauggagcuauuacugcgcgggccugaaaaaggugacagaagucaaaggcuauacgaaagggggacccggccacgaggaaccuauccccauggccaccuacggguggaaucugguuaaacucuacuccggaaaggauguguuuuucacaccuccggagaaaugugacacccuucugugcgauauuggcgagucuagccccaacccuacaaucgaagaggggcgcacccugcgggugcucaagauggucgaacccuggcugagaggaaaucaguuuuguauuaagauccuuaacccuuauaugcccuccgugguugagacgcuggagcagaugcagcgcaaacauggcggcaugcucgugcggaauccgcugucuagaaacagcacccacgaaauguacugggucuccugcgggacaggaaauauugugagcgcuguuaacaugaccucucgcaugcugcucaaccgguucacaauggcccacagaaagccuaccuaugagcgcgacguggaucugggcgcugggacaagacaugucgccguggaacccgagguggcgaaucuugacaucaucggacaacggauugaaaacaucaaaaaugagcacaaguccaccuggcauuacgaugaggacaaccccuauaaaacgugggccuaccacggcagcuaugaagucaagccuucuggguccgcuagcucuaugguuaauggaguggugcgccugcucacaaagcccugggacgucauuccuauggugacccagaucgccaugaccgauacaacgccguuuggccagcaaagaguuuucaaagagaagguggacacccggacacccagagcuaaacggggcaccgcccagauuauggaagucacagcuaaguggcuguggggguuucuuucccgcaacaaaaagccuagaaucuguacccgggaggaguucacacgcaaggugagaagcaaugccgcgaucggagccguuuuuguggaugagaaccaguggaacuccgcuaaagaggccgucgaagacgagcgguucugggaucuggugcaccgcgaaagagagcuccauaagcagggcaaaugcgcuaccugcguuuacaacaugauggggaagcgggagaaaaagcugggagaguuuggcaaggccaaagggagccgcgccauuugguacauguggcugggcgcgagauuccucgaguucgaagcucugggauuuaugaaugaggaccacugguucucucgggaaaacagcuuuuccggcguggagggggagggacuucauaagcugggcuauauccuccgcgauauuucuaaaauccccgggggaaauauguacgccgacgauacggccggcugggacaccagaauuacagaagaugaccugcaaaacgaggcuaagaucaccgauaucauggaaccugagcacgcccuucuggcuacaagcauuuucaaacucaccuaucagaauaaggucgugcggguccagcgccccgccaaaaacgggacggugauggacguuaucuccagacgggaccagagaggcucuggacaagugggcacauacgggcugaacaccuuuacaaauauggaaguccagcugauucgccagauggagagcgagggaaucuuccucccguccgaacuggagaccccuaaccuugcggaacgggugcuggauuggcucgagaagcauggcacggaaagacugaagcgcauggccauuucuggggacgauugugugguuaaacccguggacgaucgguuugcuaccgcccuuaucgcucugaaugacaugggaaaggucagaaaagauaucccucagugggagcccagcaagggcuggaacgacuggcaacaggugccuuucugcucccaccacuuucaucagcucauuaugaaagaugggcgcgagaucguugugcccugucggaaucaggacgaacuggucggcagagcccgcgugagccaaggagcgggcuggucucugcgggagacagccugccucgggaaguccuaugcucagauguggcagcugauguacuuccacagacgcgaucuucggcuggccgcuaacgccauuuguagcgcugucccgguggacuggguuccuaccucuagaacaaccugguccauccaugcccaccaccaauggaugacaaccgaagacaugcucagcguguggaaucgggucuggauugaggaaaaccccuggauggaggauaagacgcauguguccucuugggaggaaguucccuaucugggaaaaagagaggaccaguggugcggcagccuuaucgggcugacagcgcgcgccaccugggcuaccaauauucagguggccaucaaccagguccggagacucaucggaaaugaaaacuaccuggauuacaugacauccaugaagcgcuuuaaaaaugagagcgacccugagggcgcccugugguga

SEQ ID NO: 18757 - RNA, 9879 nt, Artificial Sequence
  derived and/or modified CDS sequence (opt5) from DENV-1__FJ547087__SS-prME
agcgugacaaugcugcucaugcugcuucccacagcucuggcuuuccaccucacgaccagaggcggggaaccucauaugaucgucuccaagcaggaacggggaaaaucucugcuuuuuaagacaagcgcuggcguuaauaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggaaacagauucagaagguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaaaaccgaggucacaaacccugccguucuucggaagcugugcauugaagcgaaaaucucuaauaccacgacagacucccgcuguccgacccaaggagaggccacccucguggaagaacaggaugcuaacuucgugugcagacggacauuugucgaccgcggcuggggcaauggguguggacuguucggcaaggggagccuucugaccugcgccaaguuuaaaugcgugacaaagcucgagggaaaaauuguucaguacgaaaaccugaaguauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagccccagaacaggccuugauuucaacgaaauggugcugcucaccaugaaagagaagucuuggcugguccauaaacagugguuucuugaccugccucuccccuggacguccggggcuagcacaucccaagagaccuggaaucggcaggaucugcuggugacauucaagaccgcgcacgccaagaaacaggaagucgugguucucggaucucaagagggcgcuaugcacaccgcccugacaggggccacggaaauucagaccagcggaacaaccacaaucuuugcuggccaucuuaagugccgccugaaaauggacaagcucacccugaaagggauguccuaugugauguguacgggcagcuucaagcuggagaaggaagucgccgagacacagcacggaaccgugcuuguucaggugaaauacgagggcaccgaugcgccgugcaagauuccuuucucuacacaagacgaaaaaggggucacccagaacggaagacucaucacagcuaaucccaucgugacggauaaggagaaaccugugaacauugaaaccgagccgcccuuuggcgaguccuauaucaugguuggggccggagaaaaggcccugaagcugagcugguucaaaaagggcucuagcauugggaaaauguuugaggcuacagcccggggcgcuagacgcauggccauccucggagacaccgcgugggauuucggcuccauugggggagucuuuacaucugugggcaagcuggugcaucaggucuucgggaccgccuacggagugcuuuuuagcggcguuuccuggacgaugaaaaucgggaucggcauucugcucaccuggcugggacugaauagccggucugcuucccuuagcaugacauguaucgccgugggcauggucacccucuaccugggggugaugguucaggcugacucuggaugcgugauuaacuggaagggcagagaacugaaguguggguccggaaucuucgucacaaacgaggugcacaccuggacagaacaauauaaauuucaggccgauagcccuaagcgccucuccgcggccauuggcaaggcuugggaggaggggguuugcggcauccggucugccaccagacuggaaaauauuauguggaagcagaucagcaacgagcuuaaucauauccugcucgaaaacgacaugaaauucacgguggucgugggagacgcuaauggcauucuggcccaggggaagaaaaugauccgcccgcaacccauggagcacaaguacuccuggaagucuuggggaaaagccaagauuaucggcgcugauauucagaacacaaccuuuaucaucgacgggccugauacccccgaauguccugacgaucagcgggcguggaauauuugggagguggaggacuauggauucggcaucuuuacaaccaacauuuggcugaaacuuagagauagcuacacgcagaugugcgaccaccgccucauguccgccgcuaucaaggauagcaaagccguccaugccgacaugggcuauuggauugaaucugagaagaaugaaacauggaagcuggcucgggccuccuucaucgagguuaaaaccuguaucuggcccaagagccacacacuguggucuaacggggugcucgaauccgagaugauuaucccgaaaauuuacggaggcccuaucagccaacauaauuauagacccggguacuucacccagacagcgggaccuuggcaccugggcaaacuugagcuggauuuugaccucugcgaagggaccacgguggucguggaugagcacugcggaaaccgcggccccucucugcggaccacaaccguuacaggcaaaauuauccaugaaugguguugcagaagcuguacccugccuccccuucgguuccgcggggaggacggaugcugguacggcauggagaucagaccggugaaggaaaaggaggaaaaucucguccgguccauggugagcgcugggucuggagagguugacuccuuuagccugggcauucuguguguguccaucaugauugaagaggucaugagaucucgcuggagccggaaaaugcucaugacggggacacuggccguguuccuucugcucaucaugggacagcugaccuggaacgaucugauuagacuuugcaucaugguuggcgccaaugcuuccgaccgcaugggcauggggacaaccuaucuggcccucauggcgaccuuuaagaugagaccuauguucgcugugggacugcucuuucggcgccugacaucuagagagguccuucugcucacgauuggccugagccugguggccuccguggaacuucccaacucucuggaggaacucggggauggacuggccaugggcaucaugaugcucaaacugcuuaccgaguuccaaccccaccagcuguggacaacccuccugagccugacauuuaucaagaccacgcuuucccuggacuacgcuuggaaaacaauggccaugguccucagcauuguuucucuguucccucucugucuguccaccaccagccagaagacaaccuggcuuccggugcugcuggggucuuuuggaugcaagccccucacaauguuccugaucacggaaaacaaaauuuggggccggaaguccuggccucuuaaugagggcaucauggcuauugggaucgugagcauccugcucucuucccugcucaaaaacgaugucccccuggccggaccucuuauugcgggcgggaugcugaucgccuguuaugugauuagcggauccagcgcugaccugucucucgagaaggccgcugaaguuagcugggaggaagaggccgaacauuccggcaccucucacaauauccugguggagguccaggaugacgggacaaugaaaauuaaggaugaggaacgcgacgauacccuuacaauccugcucaaagccacccugcucgcugugagcggaguuuaccccauguccaucccugcgacgcuguuugugugguauuucuggcaaaagaagaaacagagaucuggcguccuuugggacacccccagcccgccugagguggaacgggccguccuggaugacggcauuuaccgcauccugcagagagggcuccugggacggucccaggugggcguugggguguuccaagacggagucuuucauacaauguggcacgugacccgcggcgcuguucuuauguaucaggggaagagacuggagcccucuugggccagcgugaaaaaggaucucauuuccuacggaggcggcuggcgguuccaggggagcuggaacacaggagaggaaguccaggugaucgccguggagccuggcaaaaaucccaagaacguucaaaccacaccggggacguuuaagaccccugaaggagaggucggcgcuauugcccuggacuucaaacccgggacaucuggauccccuaucgugaauagagaaggcaagauugugggccucuacgggaacggagucgugaccaccagcggcacauauguuucugcgaucgcucaggccaaagccucccaggaugggccccugcccgagaucgaggacgaaguguuuaagaaacgcaaucuuacgauuauggaucugcacccuggaagcggcaagacccggagauaccugccggcuaucguccgcgaggccauuaagcggaaacucagaacacugauccuugcgcccacccgcgugguugcuuccgaaauggccgaggcccugaaggggaugccuauucgguaucaaacaaccgcugugaaaucugaacauacgggcagagagaucgucgaccucaugugccacgccacauucaccaugcgccugcugagccccgugcggguuccuaacuacaauaugaucauuauggaugaggcucauuuuaccgaccccgccuccaucgcggccagaggauauauuagcacacgggugggcaugggggaagcugccgcuaucuucaugaccgccacaccuccgggaucugucgaggccuuuccccaguccaacgcugugauucaggaugaagaaagagacaucccugaaagaagcuggaacucuggcuacgauuggaucaccgacuuccccgggaagacggugugguuugucccuagcauuaaauccggaaacgacaucgcgaauugucuccggaagaacggcaagcgcguuauucagcuuucuagaaaaacauucgauaccgaguaucaaaagaccaaaaauaaugacugggauuacguggugaccacggacaucagcgagaugggggccaacuuccgggcugauagagucauugacccccgccggugccugaagccggugauccugaaagauggcccugaaagaguuauucucgccggacccaugcccgugaccgucgccuccgcugcccagcgccggggcagaaucgggcgcaaucagaacaaggagggagaccaguacguguauaugggccaaccucugaauaacgaugaagaccacgcgcauuggacagaggcuaagaugcuucuggauaauaucaacacccccgaggggauuaucccugcccucuuugaaccggagcgggaaaaaucugccgcuauugacggagaguacagacugcgcggcgaagccagaaagacauucguugagcugaugcggcgcggggaucuccccguguggcuuagcuauaaagucgcguccgagggcuuucaguacagcgacagacgguggugcuucgacggagaacgcaauaaccaggugcuggaggaaaauauggaugucgagaucuggaccaaggaaggcgagcgcaaaaagcugcggccuagauggcucgacgcccgcacauauucugauccccuggcccuucgggaguuuaaagaguucgccgcugggagacgcuccgugagcggagaccugauucucgagaucggcaagcugccucagcaccugaccauccgggcccaaaacgcucucgauaaucuuguuaugcugcacaacuccgaacaagggggaaaggccuacagacaugcgauggaggaacugcccgacacgauugagacacucaugcugcuugcccugaucgcugugcucaccggcggcgugacccuguuuuuccugucugggaaaggacucggcaagacaagcauugggcuucugugugucauggccuccucugcucugcucuggauggccagcguugagccgcacuggaucgccgcuuccauuauccuggaauuuuuccuuauggugcugcucaucccugagcccgaucggcagcgcaccccucaggacaaucaacuggcguauguggucauuggacugcucuuuaugauccuuacaguggccgcuaacgaaaugggccugcuggagacgaccaaaaaggaucucgggauuggacauguugccgccgagaaccaccaccaugcuacaaugcuggacguggaucuuagacccgccagcgcguggacccuguacgccgucgcuacaaccgugaucacgccuaugaugcggcacaccauugaaaauacaaccgccaacaucucucucacagcuauugccaaucaggcggccauccugaugggccuggacaaaggcuggcccaucuccaagauggauauuggggucccgcuccuugcucugggaugcuacagccaggugaacccucugacccucacggccgcuguucugaugcuuguggcccauuaugcuaucauuggccccgggcugcaagccaaggcgacacgcgaggcccagaaaagaaccgcugccggaaucaugaagaaucccacagucgacggcauuguggcuaucgaccucgauccuguuguguacgacgccaaauucgaaaagcagcuggggcagaucaugcugcucauucuuuguaccucucaaauccugcugaugcggaccacaugggcccucugcgaguccauuacgcuggcgaccggaccgcuuacaacccugugggaaggcagccccggcaaauuuuggaacacaaccaucgcugucucuauggccaauauuuuccgcgggagcuaucucgcuggagccggccuggccuucucccugaugaagucucucgggggaggcagacgggggacgggagcucagggcgagacacuuggcgagaaguggaaacgccagcugaaccagcugagcaaguccgaauuuaauaccuacaaaagaagcgggaucauggagguggaucgguccgaagccaaggagggacucaaaagaggcgaaaccacaaagcacgcggugucucgcgggaccgccaagcugcggugguucguugagagaaaccuugucaaaccugagggaaaggugaucgaccugggcugugggcgcggaggcuggagcuauuacugcgcuggccucaaaaaggugacagaagucaaaggguauacgaagggaggccccgggcaugaggaaccuauucccauggccaccuacggauggaaucugguuaaacugcacuccggcaaggauguguuuuucacaccuccggagaagugugacacccuccuuugcgauaucggggaaucuagccccaacccuacaauugaggagggacggacccugagagugcugaaaauggucgaacccuggcuccgcggcaaucaauuuuguaucaagauucugaacccuuacaugcccuccgugguugagacgcuugaacagaugcagcggaaacacggcgggaugcuggugagaaauccgcucucucgcaacagcacccaugagauguauugggucuccugcggaacaggcaauaucgugagcgcuguuaacaugaccucucggaugcugcugaacagauucacaauggcccaccgcaagccuaccuacgagcgggacguggaucucggggcgggaacaagacaugucgccguggaacccgagguggcuaaucuggacauuaucggccagcgcaucgaaaacauuaaaaaugagcacaaguccaccuggcacuaugaugaagacaaccccuacaagacgugggccuaucaugggagcuacgaggucaaaccuucuggauccgcuagcucuaugguuaauggcguggugagacuucugacaaagcccugggacgucaucccuauggugacccaaauugccaugaccgauacaacgccguuuggccagcagcggguuuucaaagagaagguggacacccgcacacccagagcuaaacgggggaccgcccaaaucauggaagucacagcgaaguggcucuggggauuucuguccagaaacaagaaaccucggauuuguacccgcgaggaguucacaagaaaggugcggagcaaugccgcuaucggcgccguuuuuguggaugagaaccaguggaacuccgcuaaagaagccgucgaggacgagcgcuucugggaucuugugcacagagaacgggagcugcauaagcaggggaaaugcgcgaccugcguuuauaacaugaugggaaagcgcgaaaagaaacucggcgaguuugggaaggccaaaggcagcagagcuaucugguacauguggcugggagcccgguuccuggaguucgaggcccucggcuuuaugaaugaggaccacugguucucucgcgaaaacagccuguccgggguggagggagaaggccuucauaagcugggguacauucucagagauaucucuaaaauucccggaggcaauauguaugcugacgauacggccgggugggacacccggaucacagaggaugaccugcagaacgaggcuaagauuaccgauaucauggaaccugagcacgcccuucuggcgacaagcaucuuuaaacucaccuaccaaaauaaggucgugcgcguccagagacccgccaagaacggcacggugauggacguuauuucccggcgcgaccagagaggaucuggccagguggggacauauggacugaacaccuucacaaauauggaaguccaacugauccggcagauggagagcgaaggcauuuuucucccgugugagcuggagaccccuaaccuugcugaaagagugcuggauuggcucgagaaacacggggccgaacgccugaagcggauggcuaucuccggagacgauugcgugguuaaacccauugacgauagauucgccacggcgcuuaucgcccugaaugacaugggcaaggugcgcaaagauaucccucagugggagcccucuaagggguggaacgacuggcagcaagucccuuuuuguagccaucacuuccaucagcucauuaugaaggauggccgggaaaucgugguucccugcagaaaucaggacgagcuggugggacgcgcucgggucucccagggcgccggguggagccugagagagaccgcuugucucggaaaaucuuacgcccaaauguggcagcugauguauuuucaccgccgggaucuuagacuggcugccaacgcgauuugcuccgccgugccggucgacugggugccuacaagccgcaccacauggucuauccacgcucaucaccaguggaugaccacagaagacaugcucuccguuuggaaucggguguggauugaggaaaaccccuggauggaggauaagacccaugucagcuccugggaagaggugcccuaccugggcaaaagagaggaccaauggugugggucucuuaucggacugacggcccgggccacaugggcuaccaauauucagguugccaucaaccaggugagacgccucaucggcaaugaaaacuaucuggauuacaugaccagcaugaagcgguucaaaaaugaguccgacccugaaggggcgcugugguga

SEQ ID NO: 18758 - RNA, 9879 nt, Artificial Sequence
  derived and/or modified CDS sequence (opt5) from DENV-1__FJ410186__SS-prME
agcgugaccaugcugcucaugcugcuucccacagcccuggcuuuccaccucacgaccagaggcggggagccucauaugaucguguccaagcaggaacggggaaaaucucugcuuuuuaagacaagcgccggcguuaacaugugcacccugauugcgauggaccucggggagcugugugaagauacaaugaccuacaaaugccccagaaucacagagguggaacccgacgauguggacuguuggugcaaugcuaccgauacgugggucaccuauggaacauguucccagaccggcgagcacagacgggacaagcgcucuguggcccuggccccucauguugggcucggacuggagacaagaaccgaaacguggaugagcuccgagggcgcuuggaaacagauucagaagguggaaacaugggcccuucggcaccccggcuucaccgucaucgccuuuuuccuggcccaugcgauugggacaucuaucacccagaagggaaucauuuuuauccuccugaugcuugugaccccuagcauggccaugcgcugcguuggcauugggaacagagauuucguggagggacuguccggcgcuacaugggucgacguggugcucgagcacgggagcugugucacgaccauggccaaaaauaagcccacacuggauaucgaacugcucaaaaccgagguuacaaacccugcugugcugcggaaacuuugcauugaagccaaaaucucuaauaccacgacagacucccgcuguccgacccaaggagaggcgacccugguggaagaacaggaugccaacuuugucugcagacggacauucguggaccgcggcuggggcaauggguguggacucuuuggcaaggggagccugcuuaccugcgcuaaguucaaaugcguuacaaagcuggagggaaaaauugugcaguacgaaaaccucaaguauucugucaucgugacgguucacaccggcgaucagcaucaaguggggaaugagacaaccgaacacggaacaaucgccaccauuacgccccaggcuccuaccuccgagauccagcugacagacuacggcgcccugacccucgacuguagccccagaacaggccuggauuuuaacgaaaugguccuucugaccaugaaagagaagucuuggcucgugcauaaacagugguuccuggaccuuccucugcccuggacguccggggccagcacaucccaagagaccuggaaucggcaggaucuccuggucacauuuaagaccgcucacgcgaagaaacaggaagugguugugcugggaucucaagagggcgccaugcacaccgcucucacaggggccacggaaauucagaccagcggaacaaccacaaucuucgccggccaucugaagugccgccuuaaaauggacaagcugacccucaaagggauguccuaugucauguguacgggcagcuucaagcuggagaaggaaguggcugagacacagcacggaaccguucuggugcaggucaaauacgagggcaccgaugccccgugcaagauuccuuuuucuacacaagacgaaaaaggggugacccagaacggaagacuuaucacagcgaaucccaucgugacggauaaggagaaaccuguuaacauugaaaccgagccgcccuucggcgaguccuauaucauugucggggcuggagaaaaggcccucaagcugagcugguuuaaaaagggcucuagcaucgggaaaauguucgaggccacagcucggggcgccagacgcauggcuauucugggagacaccgccugggauuuuggcuccaucgggggaguguucacaucugugggcaagcucguccaucagguguuugggaccgcguacggaguucuguucagcggcguguccuggacgaugaaaaucgggauuggcauccuucugaccuggcucggacugaauagccggucugccucccugagcaugacauguauugcugucggcauggugacccuuuaccucgggguuauggugcaggccgacucuggaugcgucaucaacuggaagggcagagaacugaaguguggguccggaauuuuugugacaaacgagguucacaccuggacagaacaauauaaauuccaggcugauagcccuaagcgccuguccgccgcgaucggcaaagccugggaggagggggugugcggcauucggucugcuaccagacucgaaaauaucauguggaagcagaucagcaacgagcugaaucauauucuucuggaaaacgacaugaaauuuacggucguggugggagacgccaauggcauccucgcucaggggaagaaaaugauucgcccgcaacccauggagcacaaguacuccuggaagucuuggggaaaagccaagaucauuggcgccgauauccagaacacaaccuucaucauugacgggccugauacccccgaauguccugacgaucagcgggcuuggaauaucugggaggucgaggacuauggauuuggcauuuucacaaccaacaucuggcugaaacugagagauagcuacacgcagaugugcgaccaccgccuuauguccgcggccauuaaggauagcaaagcuguucaugccgacaugggcuauuggaucgaaucugagaagaaugaaacauggaagcucgcccgggcuuccuucaucgaggugaaaaccuguauuuggcccaagagccacacacuguggucuaacggggugcuggaauccgagaugaucauuccgaaaaucuacggaggcccuaccagccaacauaauuauagacccggguacuuuacacagaccgccggaccuuggcaccucggcaagcuggagcuugauuucgaccugugcgaagggacgaccgucgugguugaugagcacugcggaaaccgcggccccucucuccggacaaccacagugaccggcaaaauuauccaugaaugguguugcagaagcuguacgcugccuccccugcgguuucgcggggaggacggaugcugguacggcauggagaucagaccggucaaggaaaaggaggaaaaucuugugcgguccaugguuagcgcggggucuggagagguggacuccuucagccucggcauucugugugucuccaucaugauugaagaggugaugagaucucgcuggagccggaaaaugcugaugacagggacccucgcuguuuuucugcuucugaucaugggacagcucacauggaacgaucugauuagacugugcaucauggugggcgccaaugccuccgaccgcaugggcauggggaccaccuaucuugcucugauggccacauucaagaugagaccuauguuugcggucggacuccuguuccggcgccucacgucuagagaggugcugcuucugaccauuggccucagccugguggcuuccgucgaacugcccaacucucuugaggaacugggggauggacucgccaugggcaucaugaugcugaaacuccugacagaguuucaaccccaccagcuuuggaccacacugcucagccugaccuucaucaagacgacacugucccuugacuacgccuggaaaaccauggcuaugguucugagcauugugucucucuuuccucugugucucuccaccacaagccagaagaccacauggcugccggugcuucuggggucuuucggaugcaagccccugacgauguuucucaucaccgaaaacaaaauuuggggccggaaguccuggccucugaaugagggcaucauggccauugggaucgucagcauccuucugucuucccuccugaaaaacgaugugccccucgcuggaccucugauugccggcgggaugcuuaucgcguguuauguuauuagcggauccagcgccgaccugucucuggagaaggcugccgaagugagcugggaggaagaggcugaacauuccggcacaucucacaauauccucgucgaggugcaggaugacgggaccaugaaaauuaaggaugaggaacgcgacgauacacugaccauccuucugaaagccacgcuccuggccguuagcggaguguaccccauguccaucccugcuacccucuucgucugguauuucuggcaaaagaagaaacagagaucuggcgugcugugggacacacccagcccgccugaggucgaacgggcggugcuugaugacggcauuuaccgcauccugcagagagggcugcucggacggucccagguuggcgugggggucuuucaagacggaguguuccauaccauguggcacguuacacgcggcgccgugcugauguaucaggggaagagacuugagcccucuugggcuagcgucaaaaaggaucugauuuccuacggaggcggcuggcgguuucaggggcucuggaacaccggagaggaaguccaggugaucgccguugagccuggcaaaaaucccaagaacguccaaacaacgccggggaccuucaagacaccugaaggagaggugggcgccauugcucuggacuuuaaacccgggaccagcggaucuccuaucgugaauagagaaggcaagauugucggccucuacgggaacggagugguuaccacauccggcacguaugugagcgccaucgcgcaggcuaaagccucucaggaggggccccugcccgagaucgaagaugaggucuucaagaaacgcaaucuuaccauuauggaccugcacccuggauccggcaagacacggagauaccugccggccaucgugcgcgaagcuauuaagcggaaacucagaacccugauccuugcccccacacgcguuguggcgagcgagauggcugaagcccugaaggggaugccuauucgguaucaaaccacggccgucaaauccgagcauacaggcagagagaucguggaucucaugugccacgcuaccuuuaccaugcgccugcugucucccguucgggugccuaacuacaauaugaucauuauggacgaagcccauuucacagaucccgcuagcaucgccgcgagaggauauauuuccacccgggucggcaugggggaggccgcugccaucuuuaugacagcuaccccuccgggaagcguggaagccuucccccagucuaacgccgugauucaggacgaggaacgcgauaucccugagagauccuggaauagcggcuacgacuggaucacggauuuucccgggaagacagucugguucguuccuucuauuaaaagcggaaacgacaucgcuaauugucuccggaagaacggcaagcgcgugauucagcuuuccagaaaaaccuucgacacagaguaucaaaagaccaaaaacaaugauugggacuacguggucacgaccgauaucucugaaaugggggcgaacuuucgggccgacagagugauugauccccgccggugccugaagccgguuauccugaaagacggcccugagagagugauucucgcuggacccaugcccgucacaguggccagcgccgcucagcgccggggcagaaucgggcgcaaucagaacaaggaaggagaucaguacguuuauaugggccaaccucugaauaacgacgaggaucacgcccauuggaccgaggcgaagaugcuucuggacaauaucaacacacccgaagggauuaucccugcucucuucgagccggaacgggagaaauccgccgccauugauggagaauacagacugcgcggcgaggcuagaaagaccuuuguggagcugaugcggcgcggggaccuccccgucuggcuuucuuauaaaguggccagcgaaggcuuccaguacuccgauagacgguggugcuuugacggagagcgcaauaaccagguccuggaagagaauauggacguggaaaucuggacaaaggagggcgagcgcaagaagcugcggccuagauggcucgaugcgcgcaccuauagcgacccccuggcccuucgggaguucaaagaguuugcugccgggagacgcucuguuuccggagaucugauucucgaaaucggcaagcugccucagcaccugacgcuccgggcucaaaacgcccuugacaaucuggugaugcugcacaacagcgagcaagggggaaaggcuuacagacaugccauggaagaacuccccgauacaaucgagacccugaugcuucuggcgcucauugccgugcugaccggcggcgucacacuguucuuucucuccgggaaaggacuuggcaagaccucuaucgggcugcuguguguuauggcuagcuccgcccuccuguggauggcuucuguggaaccgcacuggauugccgccagcaucauucuugaguucuuucugauggugcuccugaucccugaacccgaccggcagcgcacaccucaggauaaucaacuggcuuaugucgugaucggacuccuuuucaugauucugacgguugcggccaacgagaugggccugcucgagaccaccaagaaggaccuggggaucggacauguggcugccgaaaaccaccaccaugccaccaugcuugaugucgaccugagacccgcuuccgccuggacacucuacgcgguggccaccacggucauuaccccuaugaugcggcacacaaucgagaauaccacagcuaacauuagccugaccgccaucgcuaaucaggccgcgauucugaugggccucgauaaaggcuggcccaucucuaagauggacaucggggugccgcuucuggcccugggaugcuacucccagguuaacccucucacgcugacagcugccgugcuuaugcuggucgcucauuaugccauuaucggccccgggcuccaagcucgcgccaccagagaagcgcagaagcggacagccgcuggaauuaugaaaaaucccaccguggauggcaucguugccauugaccuggacccuguggucuacgaugcuaaguuugagaaacagcuggggcagaucaugcuccuuauccuguguaccagccaaauucugcucaugcgcacaacgugggcccugugcgaaucuaucacccuugccacaggaccgcugaccacacucugggagggcucccccggcaaguucuggaacaccacgauugcggugagcauggcuaauaucuucagagggucuuaucuggccggagcuggccuggccuuuagccucaugaaaucccuugggggaggccggcgcgggacaggagcccagggcgagacccugggcgaaaaguggaagagacagcugaaccagcucucuaaaagcgaguucaauaccuacaagcgguccgggauuauggaaguggacagaagcgaggcuaaagaaggacugaagcgcggcgagacaaccaaacacgccguuucccgggggacagcgaaacuuagaugguuugucgagcgcaaccuggugaagccugaaggaaaagugaucgaucucggcugugggcggggaggcuggucuuauuacugcgccggccugaagaaagucacggagguuaagggguauaccaaaggaggccccgggcaugaggaaccuauccccauggcuacauacggauggaaucuggugaagcuccacagcggcaaagacguguucuuuaccccuccggaaaagugugauacacuucugugcgacauuggggaguccucucccaacccuaccaucgaggaaggaagaacgcugcgcguccucaagaugguggagcccuggcugcggggcaaucaauucuguauuaaaauccuuaacccuuacaugcccagcguuguggaaacccuggagcagaugcagagaaagcacggcgggaugcucguccgcaauccgcugucccggaacucuacacaugagauguauugggugagcugcggaaccggcaauauuguuuccgccgugaacaugacaagcagaaugcugcucaaccgcuuuaccauggcucaccggaaaccuacauacgaaagagaugucgaccugggggccggaacccgccauguggcgguggagcccgaagucgccaaucuugauaucauuggccagagaaucgagaacaucaagaaugaacacaaaucuacguggcacuaugacgaggauaaccccuacaagacaugggcuuaucauggguccuacgagguuaagccuagcggaucugccuccagcauggugaauggcgugguccggcugcucaccaaacccugggacgugauuccuaugguuacccaaaucgcuaugacagacacgaccccguucggccagcagcgcguguuuaaggaaaaagucgauacaagaacaccccgggccaagagagggacagcucaaauuauggaggugaccgccaaauggcuguggggauuccuuucucggaacaagaagccucgcaucuguacaagagaagaguuuacccggaaaguucgcuccaaugcggccauuggcgcuguguucgucgacgaaaaccaguggaauagcgccaaggaggcuguggaggaugaaagauuuugggaccugguucggcgcgagagagaacuccacaaacaggggaagugcgccacgugcguguauaacaugaugggaaaacgggagaagaagcugggcgaguucgggaaagccaagggcucccgcgcgaucugguacauguggcugggagcuagauuccucgaguuugaggcccugggcuucaugaaugaagaucauugguuuagccgggagaacucucuuagcggggucgaaggagagggccugcacaaacucggguacauccugcgcgacauuuccaagauccccggaggcaauauguaugccgaugacaccgcugggugggauacaagaauuaccgaggacgaucuucagaacgaagccaaaaucacagacauuauggagccugaacaugcucugcucgccaccucuaucuucaagcugacguaccaaaauaaagugguccgggugcagcgccccgcgaagaacggcacaguuauggaugugaucagcagacgggaccagagaggauccggccaggucgggaccuauggacugaacacauuuaccaauauggaggugcaacucauucgccagauggaaucugagggcaucuuccugccgagcgagcuugaaacgccuaaccuggccgagcgggugcucgacuggcuggaaaagcacggggcugagagacuuaaacgcauggccauuuccggagaugacuguguugugaagcccgucgaugaccgguuugcuaccgcccugaucgcgcucaaugauaugggcaaagugagaaaggacauuccucagugggaacccucuaaaggguggaacgauuggcagcaaguuccuuucugcagccaccauuuucaccagcugaucaugaaggacggccgcgagaucgugguccccugucggaaucaggaugagcuggugggcagagcucgcgucucccagggagcuggguggagccuccgggaaacagccugccugggaaagucuuacgcucaaauguggcagcuuauguauuuccauagacgcgaccugcggcucgccgcuaacgccauuuguuccgcggauccgguggacuggguuccuaccagcagaacaaccuggucuauccacgcccaccaucaguggaugacaaccgaggacaugcuguccguguggaaucgggucuggauugaagagaaccccuggauggaagauaaaacgcacgugagcuccugggaggagguucccuaccuuggcaagagagaagaccaauggugcgggucucugaucggacucacagcucgcgccaccugggccaccaauauucagguggcuaucaaccagguccggagacugauuggcaaugagaacuaucuggauuacaugaucagcaugaaacgcuuuaagaaugaauccgacccugagggggcccucugguga

SEQ ID NO: 18759 - RNA, 9879 nt, Artificial Sequence
  derived and/or modified CDS sequence (opt5) from DENV-1__FJ410187__SS-prME
agcgugaccaugcugcuuaugcugcuucccaccgcucuggcuuuccaccucacgaccagaggcggggagccucauaugaucgucuccaagcaggaacggggaaagucucugcuuuuuaagaccagcgccggcauuaacaugugcacccugaucgcgauggaccucggggagcugugugaagauacaaugaccuacaaaugcccccgcauuacagaggcugaacccgacgauguugacuguuggugcaaugccaccgauacgugggugaccuauggaacauguucccagaccggcgagcacagacgggacaagcgcucuguggcccuggcuccucaugucgggcucggacuggagacaagaaccgaaacguggaugagcuccgagggcgccuggaaacagauccagaagguggaaacaugggcccuucggcaccccggcuucaccguuacagcccuguuucucgcgcaugccauugggaccucuaucacccagaagggaaucauuuucauccugcuuaugcuggugacaccuagcauggcuaugcgcugcgucggcauugggaacagagauuuuguggagggacucuccggcgccacguggguugacgugguccuggagcacgggagcugugugaccacaauggcuaaagauaagcccacccuggacaucgaacuccugaaaacagaggugaccaauccugccguccuucggaagcugugcauugaagcgaaaaucucuaacacgacaaccgauucccgcuguccgacccagggagaggccacacucguugaagaacaggacagcaauuucgugugcagacggaccuuuguggaucgcggcuggggcaacggguguggacuguucggcaaggggucucuucugacaugcgcuaaguuuaaaugcgucacgaagcucgagggaaaaauugugcaguacgaaaaucugaaguauuccguuaucgugaccguccacacaggcgaccagcaucaaguggggaacgagaccacagaacacggaaccaucgccacgauuacaccccaggcuccuacaagcgagauccagcugaccgacuacggcgcccucacacuggauuguucucccagaaccggccuugacuucaaugaaaugguucugcucacgaugaaagagaaguccuggcuggugcauaaacagugguuucuugaucugccucuccccuggacaagcggggccuccaccucucaagagacauggaaccggcaggaccugcuggucaccuucaagaccgcucacgcgaagaaacaggaaguggucgugcucggaagccaagagggcgccaugcacacagcucugacgggggccaccgaaauucagacauccggaaccacaaccaucuuugccggccaucuuaagugccgccugaaaauggauaagcucacgcugaaagggaugagcuauguuauguguacaggcucuuucaagcuggagaaggaaguggcugagacccagcacggaaccguccuugugcagguuaaauacgagggcacagacgccccgugcaagauuccuuucuccgcgcaagaugaaaaaggggugacccagaauggaagacucaucacagcuaaccccaucgucacggacaaggagaaaccugugaauauugaaaccgagccgcccuuuggcgagagcuauaucgugguuggggccggagaaaaggcccugaagcugucuugguucaaaaagggcagcuccauugggaaaauguuugaggcuacagcccggggcgcuagacgcauggccauccucggagauaccgcgugggacuucggcucuauugggggagucuuuacaagcgugggcaagcuggugcaucaggucuucggggccgcuuacggagugcucuuuuccggcguuagcuggaccaugaaaaucgggaucggcauucugcucacguggcugggacugaacucucgguccaccagccuuucuaugacauguaucgccgugggcauggucacccucuaccugggggugaugguucaggcugauuccggaugcgugauuaauuggaagggcagagaacugaagugugggagcggaaucuucgucacaaacgaggugcacaccuggacagaacaauauaaauuucaggccgacuccccuaagcgccucucugcggccauuggcaaggcuugggaggaggggguuugcggcauccggagcgccaccagacuggaaaacauuauguggaagcagaucuccaaugagcuuaaccauauccugcucgaaaaugacaugaaauucacgguggucgugggagaugcuaacggcauucuggcccaggggaagaaaaugauccgcccgcaacccauggagcaccgguacucuuggaaaagcuggggaaaggccaagauuaucggcgcugacauucaaaauuccacauuuaucaucgaugggccugacacccccgaauguccugaugaccagagagcguggaacauuugggagguggaggauuauggauucggcaucuuuaccacaaauauuuggcugaaacuucgcgacagcuacacccagaugugcgaucaccggcucaugucugccgcuaucaaagacuccaaggccguccaugccgauaugggcuauuggauugaaagcgagaaaaacgaaacguggaagcuggcuagagccucuuucaucgagguuaagacauguaucuggcccaaaucccacacccuguggagcaauggggugcucgaaucugagaugauuaucccgaagauuuacggaggcccuaucagccaacauaacuaucgccccggguacuucacacagaccgcgggaccuuggcaccugggcaaacuugagcuggacuuugaucucugcgaagggacaaccguggucguggacgagcacugcggaaaucggggccccucccugagaacgaccacaguuaccggcaagauuauccaugaaugguguugccggagcuguacacugccuccccuucgcuucagaggggaggacggaugcugguacggcauggagauccggccggugaaagaaaaggaggaaaaccucgucagaucuaugguguccgcugggagcggagagguugauuccuuuucucugggcauucugugugugagcaucaugauugaagaggucaugcgcucccgguggucuagaaagaugcucaugaccgggacgcuggccguguuccuucugcucaucaugggacagcugacauggaaugaccugauucgccuuugcaucaugguuggcgccaacgcuagcgauagaaugggcauggggaccacauaucuggcccucauggcgaccuuuaaaaugcggccuauguucgcugugggacugcucuuucgcagacugaccucccgggagguccuucugcucacaauuggccugucucugguggccagcguggaacuucccaauucccuggaggaacucggggacggacuggccaugggcaucaugaugcucaagcugcuuacggaguuccaaccccaccagcuguggaccacacuccugagccugaccuuuaucaaaacaacccuuucucuggauuacgcuuggcgcacgauggccaugguccucuccauuguuagccuguucccucucugucugucuacaaccucccagaagaccacauggcuuccggugcugcuggggagcuuuggaugcaaaccccucaccauguuccugaucacagaaaacaagauuuggggcagaaagucuuggccucuuaacgagggcaucauggcuauugggaucguguccauccugcucagcucccugcucaaaaaugacgucccccuggccggaccucuuauugcgggcgggaugcugaucgccuguuaugugauuagcggaucuagcgcugaucugucccucgagaaggccgcugaaguuucuugggaggaagaggccgaacauagcggcacgucccacaacauccugguggagguccaggacgaugggaccaugaaaauuaaggacgaggaacgggaugacacacuuaccauccugcucaaagccacacugcucgcugugucuggaguuuaccccaugagcaucccugcgacccuguuugugugguauuucuggcaaaagaaaaagcagcgcuccggcguccuuugggauacgcccucuccgccugagguggaaagagccguccuggacgacggcauuuaccggauccugcagcgcgggcuccugggaagaagccaggugggcguugggguguuccaagauggagucuuucauaccauguggcacgugacacggggcgcuguucuuauguaucaggggaagagacuggagcccuccugggccagcgugaaaaaggaccucauuucuuacggaggcggcuggcgcuuccagggguccuggaauaccggagaggaaguccaggugaucgccguggagccuggcaaaaaccccaagaauguucaaacaaccccggggacauuuaaaacgccugaaggagaggucggcgcuauugcccuggauuucaagcccgggaccagcggaucuccuaucgugaaccgggaaggcaagauugugggccucuacgggaauggagucgugacaaccuccggcaccuauguuagcgcgaucgcucaggccaaaacaucccaggaggggccccugcccgagaucgaagaggaaguguuuaagaaaagaaaccuuacgauuauggaccugcacccuggaucuggcaagacccgccgguaccugccggccaucgucagagaggcuauuaaacgcaagcuccggacacugauccuugcccccaccagagugguugcgagcgaaauggcugaggcccugaaggggaugccuauucgcuaucaaacaaccgccgugaaauccgagcauacgggccgggaaaucgucgaucucaugugccacgcuacauucaccaugagacugcugagccccgugcggguuccuaauuacaacaugaucauuauggacgaggcccauuuuaccgaucccgcuucuaucgccgcgcgcggauauauuuccacaagagugggcaugggggaagccgcugccaucuucaugaccgcuacaccuccgggaagcgucgaggccuuuccccagucuaaugccgugauucaggacgaagaacgggauaucccugagcgcagcuggaacuccggcuacgacuggaucaccgauuuccccgggaagacggugugguuugucccuucuauuaaaagcggaaaugacaucgcuaacugucucagaaagaauggcaaacggguuauucagcuuuccagaaagacauucgacaccgaauaucaaaagacacgcaacaacgauugggacuacguggugaccacggauaucucugagaugggggcgaauuuccgggccgacagagucauugauccccgccggugccugaaaccggugauccugaaggacggcccugaaagaguuauucucgcuggacccaugcccgugaccgucgccagcgccgcucagcgccggggcagaaucgggcgcaaccagaauaaagagggagaucaguacguguauaugggccaaccucugaacaaugacgaggaucacgcccauuggacagaagcgaagaugcuucuggacaacaucaauacccccgaggggauuaucccugcucucuuugaaccggagagagaaaaauccgccgccauugauggagaguaccggcugcgcggcgaggcuagaaagacauucguugaacugaugcggcgcggggaccuccccguguggcuuagcuauaaggucgccucugagggcuuucaguacuccgauagacgguggugcuucgacggagaaagaaacaaucaggugcuggaggaaaacauggacgucgagaucuggaccaaagagggcgaacgcaagaaacugcggccuagauggcucgaugcgcgcacauauagcgacccccuggcccuucgggaguuuaaggaguucgcugccgggagacgguccgugucuggagaucugauucucgagaucggcaaacugccucagcaccugacccuccgcgcucaaaaugcccuugacaaccugguuaugcugcacaauagcgaacaagggggaaaggcuuacagacaugccauggaggagcuccccgauacgaucgaaacacugaugcuucuggcgcucauugccgugcugaccggcggcgugacccuguuuuuccucuccgggaaaggacuuggcaagacaucuaucgggcugcugugugucauggcuagcuccgcccuccuguggauggcuaacguugagccgcacuggauugccgccagcaucauucuugaauuuuuccugauggugcuccugaucccugagcccgaccggcagcgcaccccucaggauaaucaacuggcuuauguggucaucggacuccuuuuuaugauucugacaguggcggccaacgagaugggccugcucgaaacgaccaagaaagaccuggggaucggacauguugcugccgagaaccagcaccacgccacaaugcuugauguggaccugagacccgcuucugccuggacccucuacgcggucgccacaaccgugauuacgccuaugaugcggcauaccaucgaaaauacaaccgcuaacauuucccugacagccaucgcuaaucaggccgcgauucugaugggccucgauaagggcuggcccaucagcaaaauggacaucggggucccgcuucuggcccugggaugcuacucucaagugaacccucucacccugacggcugccguucuuaugcugguggcucacuaugccauuaucggccccgggcuccaggcuaaggccacacgcgaggcgcagaaaagaaccgccgcuggaauuaugaagaaucccacagucgauggcaucguggccauugaccuggacccuguuguguacgaugcuaaguucgaaaaacagcuggggcaaaucaugcuccuuauccuguguaccucccagauucugcucaugcggaccacaugggcccugugcgagagcaucacgcuugccaccggaccgcugacaacccucugggagggcucucccggcaaguuuuggaacacaaccauugcggucagcauggcuaauaucuuccgcggguccuaucuggccggagcuggccuggccuucucucucaugaaaagccuugggggaggcagacgggggacgggagcccagggcgaaacacugggcgagaaguggaaaagacagcugaaccaacucuccaagagcgaauuuaauaccuacaagcgcuccgggauuauggagguggaccggucugaagcuaaagagggacugaagagaggcgagaccacaaaacaugccgugagccgcgggaccgcgaaacuucggugguucguugaaagaaaccuggucaaaccugagggaaaggugaucgaucucggcugugggcgcggaggcugguccuauuacugcgccggccugaagaaagugacagaagucaagggguauacgaaaggaggccccgggcacgaggaaccuauccccauggcuaccuacggauggaaucugguuaagcucuacucuggcaaagacguguuuuucacaccuccggagaagugugauacccuucugugcgacauuggggagagcucccccaacccuacaaucgaagagggacggacccugagagugcucaaaauggucgaacccuggcugcgcggcaaucaguuuuguauuaagauccuuaacccuuauaugcccucugugguugagacgcuggagcagaugcagcggaagcauggcgggaugcucgugagaaauccgcugagccgcaacuccacccacgaaauguacugggucagcugcggaacaggcaauauugugucugccguuaacaugaccucccggaugcugcucaacagauucacaaugacccaccgcaaaccuacauaugagagagauguggaccugggggcuggaacccggcaugucgccguggaacccgagguggcgaaucuugauaucauuggccaacgcaucgaaaacaucaagaaugagcacaaaagcacguggcauuacgacgaggauaaccccuauaagacaugggccuaccacgggucuuaugaagucaaaccuuccggaagcgcuucuuccaugguuaauggcguggugagacugcucaccaagcccugggacgucauuccuauggugacccagaucgccaugacagacacgaccccguuuggccagcaacggguuuucaaggagaaaguggauacaagaacaccccgggcuaagcgcgggacagcccagauuauggaagucaccgcuaaauggcuguggggauuucuuagcagaaacaagaaaccucggaucuguacacgcgaggaguucaccagaaaggugcgguccaaugccgcgauuggcgccguuuuuguggacgagaaccaguggaauagcgcuaaggaggccgucgaagaugagcgcuucugggaccuggugcacagagaacgggagcuccauaaacaggggaagugcgcuacgugcguuuacaacaugaugggaaaacgcgaaaagaaacugggcgaguuugggaaggccaagggcucuagagccaucugguacauguggcugggagcgcgguuccucgaguucgaagcucugggcuuuaugaaugaggaucacugguucagccgcgaaaacuccuuuucugggguggagggagagggccuucauaaacugggguauauccucagagacauuagcaagauccccggaggcaauauguacgccgaugacaccgccgggugggauacacggauuaccgaagacgaucugcaaaacgaggcuaaaaucacagacauuauggaaccugagcacgcccuucuggcuaccuccaucuucaagcucacguaucagaauaaagucgugcgcguccagagacccgccaagaacggcacagugauggauguuaucucucggagagaccagcgcggaagcggccaaguggggaccuacggacugaacacauuuaccaauauggaaguccagcugauucggcagauggaguccgagggcaucuuccucccgucugaacuggagacgccuaaccuugcggaaagagugcuggacuggcucgagaaacaugggaccgaacgccugaagcggauggccauuagcggagaugacugugugguuaagcccguggaugacagauuugcuacagcccuuaucgcucugaaugauaugggcaaaguccgcaaggacauuccucagugggagcccuccaaaggguggaacgauuggcaacaggugccuuucugcagccaccacuuucaucagcucaucaugaaggacggccgggagaucguugugcccuguagaaaucaggaugaacuggucggacgcgcccgggugucucaaggcgcgggguggucccugagagagaccgccugccucggaaaaagcuaugcucagauguggcagcugauguacuuccaccgccgggaccuuagacuggccgcuaacgccauuuguucugcugucccgguggauuggguuccuacaucccggaccacauggagcauccaugcccaccaccaauggaugaccacggaagacaugcucuccguguggaauagagucuggauugaggaaaaccccuggauggaggacaagacacaugugucuagcugggaggaaguucccuaucugggcaagcgcgaggaucaguggugcgggucccuuaucggacugaccgcgcgggccaccugggcuacaaauauucagguggccaucaaccaggucagacgccucauuggcaaugaaaacuaccuggacuacaugaccagcaugaaaagauuuaagaaugagucugauccugagggggcccugugguga

SEQ ID NO: 18760 - RNA, 9879 nt, Artificial Sequence
  derived and/or modified CDS sequence (opt5) from DENV-1__FJ478457__SS-prME
agcgugaccaugcugcucaugcugcuucccacagcucuggcuuuccaccucacgaccagaggcggggagccucauaugaucgucuccaagcaggaacggggaaagucucugcuuuuuaagaccagcgccggcguuaacaugugcacccugauugcgauggaccucggggagcugugugaagauaccaugaccuacaaaugcccccgcaucacagaggcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggaaacagauucagaagguugaaacaugggcccuucggcaccccggcuucaccgugaucgcccuguuucucgcgcaugccauugggacaucuaucacccagaagggaaucauuuucauccugcuuaugcuggucaccccuagcauggcuaugcgcugcgugggcauugggaacagagauuuuguugagggacucuccggcgccacauggguggacgucgugcuggagcacgggagcugugugacgaccauggcuaaaaauaagcccacacuggauaucgaacuccugaaaaccgaggucacaaacccugccguucuucggaagcugugcauugaagcgaaaaucucuaauaccacgacagacucccgcuguccgacccaaggagaggccacccucguggaggaacaagaugcuaacuucgugugcagacggacauuugucgaccgcggcuggggcaauggguguggacuguucggcaaggggagccuucugaccugcgccaaguuuaaaugcgugacaaagcucgagggaaaaauuguucagcacgaaaaccugaaguacucugugaucgucacggugcauaccggcgaucagcaccaaguugggaaugagacaaccgaacauggaacaaucgcuaccauuacgccccaggccccuaccuccgagauccagcugacagacuauggcgcccucacccuggacuguagccccagaacaggccuugauuucaacgaaauggugcugcucaccaugaaagagaagucuuggcugguccacaaacagugguuucuugaccugccucuccccuggacguccggggcuagcacaucccaagagaccuggaaucggcaggaucugcuggugacauucaagaccgcgcacgccaagaaacaggaagucgugguucucggaucucaagagggcgcuaugcauaccgcccugacaggggccacggaaauucagaccagcggaacaaccacaaucuuugcuggccaccuuaagugccgccugaaaauggacaagcucacccugaaagggauguccuacgugauguguacgggcagcuucaagcuggagaaggaagucgccgagacacagcauggaaccgugcuuguucaggugaaauaugagggcaccgaugcgccgugcaagauuccuuucucuacacaagacgaaaaaggggucacccagaacggaagacucaucacagcuaaucccaucgugacggauaaggagaaaccugugaacauugaaaccgagccgcccuuuggcgaguccuacaucguugucggggccggagaaaaggcccugaagcugagcugguucaaaaagggcucuagcauugggaaaauguuugaggcuacagcccggggcgcuagacgcauggccauccucggagacaccgcgugggauuucggcuccauugggggaauguuuacaucugugggcaagcuggugcaccaggucuucgggaccgccuauggagugcuuuuuagcggcguuuccuggacgaugaaaaucgggaucggcauucugcucaccuggcugggacugaauagccggucuacaucccuuagcaugaccuguaucgcugugggcauggucacacucuaccugggggugaugguucaggccgacucuggaugcgugauuaacuggaagggcagagaacugaaguguggguccggaaucuucgucaccaacgaggugcauacauggaccgaacaauacaaauuucaggcugauagcccuaagcgccucuccgccgcgauuggcaaagccugggaggaggggguuugcggcauccggucugcuacgagacuggaaaauauuauguggaagcagaucagcaacgagcuuaaucacauccugcucgaaaacgacaugaaauucacaguggucgugggagacgccuccggcauucuggcucaggggaagaaaaugauccgcccgcaacccauggagcacaaguauucuuggaaaagcuggggaaaggccaagauuaucggcgccgauauucagaauaccaccuuuaucaucgacgggccugauacacccgaauguuccgacgaucagcgggcuuggaacauuugggagguggaggacuacggauucggcaucuuuaccacgaauauuuggcugaaacuuagagauagcuauacacagaugugcgaccaucgccucaugucugcggccaucaaggauuccaaagcuguccacgccgacaugggcuacuggauugaaagcgagaagaacgaaaccuggaagcuggcccgggcuucuuucaucgagguuaaaacauguaucuggccuaagucccauacccuguggagcaauggggugcucgaaucugagaugauuauccccaaaauuuauggaggcccgaucagccaacacaacuacagaccuggguauuucacacagaccgccggacccuggcaccugggcaaacuugagcuggauuuugaccucugcgaagggacgaccgugauugucgaugagcauugcggaaaucgcggcccuucccugcggacaaccacagugaccggcaaaaucauccacgaaugguguugcagaagcuguacgcugcccccucuucgguuccgcggggaggacggaugcugguacggcauggagauuagacccguuaaggaaaaggaggaaaaccucgugcggucuauggucuccgcggggagcggagagguggacuccuuuucucugggcauccuguguguuagcauuaugaucgaagaggugaugagaucccgcuggucucggaaaaugcucaugacagggacccuggcugucuuccuucugcucauuaugggacagcugacauggaaugaucugaucagacuuugcauuauggugggcgccaacgccagcgaccgcaugggcauggggaccaccuaccuggcucucauggccacauuuaagaugagaccgauguucgcgguuggacugcucuuucggcgccugacguccagagaggugcuucugcucaccaucggccugucucuggucgcuagcguggaacuuccuaauucccuggaggaacucggggauggacuggccaugggcaucaugaugcucaaacugcuuacagaguuccaaccccaucagcuguggaccacacuccugagccugaccuuuauuaagacgacacuuucucuggacuaugccuggaaaaccauggcuauggcccucuccaucgugagccuguucccccucugucugucuaccacaucccagaagaccacauggcuuccuguccugcuggggagcuuuggaugcaagccgcucacgauguuccugauuaccgaaaacaaaaucuggggccggaagucuuggccccuuaacgagggcauuauggcuaucgggaucguuuccauucugcucagcucccugcucaaaaaugaugugccucuggccggaccccuuaucgcgggcgggaugcugauugccuguuacgugaucagcggaucuagcgcugaccugucccucgagaaggccgcugaagucucuugggaggaagaggccgaacacagcggcacaucccauaacaugcugguggagguucaggaugacgggaccaugaaaauuaaggaugaggaacgcgacgauacacuuaccauccugcucaaagccacgcugcucgcugugucuggagucuauccuaugagcauccccgcgacccuguuugugugguacuucuggcaaaagaagaaacagagauccggcguucuuugggacacaccuucucccccggagguggaacgggccguccuggaugacggcauuuaucgcauccugcagagagggcuccugggacggagccaggugggcgucgggguguuccaagacggaguuuuucacaccauguggcacgugacacgcggcgcuguccuuauguaccaggggaagagacuggagccuuccugggccagcgugaaaaaggaucucauuucuuauggaggcggcuggcgguuccagggguccuggaauaccggagaggaaguucaggugaucgccgucgagcccggcaaaaacccuaagaaugugcaaacaacgcccgggaccuuuaagacaccggaaggagaggugggcgcuauugcccuggacuucaaaccugggaccagcggaucucccaucguuaacagagaaggcaagauugucggccucuacgggaauggaguggugaccacauccggcacguacgucagcgcgaucgcucaggccaaagccucccaggaggggccucugcccgagaucgaagaugagguguuucgcaagcggaaccuuaccauuauggaccugcaucccggaucuggcaaaacaagacgcuaucugccugcuaucguucgggaagccauuaagagaaagcuccgcacccugauccuugcgccgacacggguggucgcuagcgagauggccgaagcccugaaagggaugcccauuagauaccaaaccacggcugugaaguccgagcacacaggccgcgagaucguugaucucaugugccaugccaccuucaccaugcggcugcugagcccugugagaguccccaauuauaacaugaucauuauggacgaagcucacuuuacagauccugccucuaucgcggcccggggauacauuuccacccgcgugggcaugggggaggcugccgcuaucuucaugacagccacacccccuggaagcguugaagccuuuccgcagucuaaugcugugauucaggacgaggaaagagauauccccgagcggagcuggaacuccggcuaugacuggaucacggauuucccugggaaaacagucugguuugugcccucuauuaagagcggaaaugacaucgcgaacugucuccgcaaaaauggcaagagagugauucagcuuucccggaagaccuucgacacagaguaccagaagaccaagaacaacgauugggacuaugucguuacgaccgauaucucugaaaugggggccaauuucagagcugaccgcgugauugauccucggagaugccugaaacccgugauccugaaggacggcccggagcgcgucauucucgccggaccuaugcccgugacaguugccagcgcugcccagcggagaggccgcaucgggcggaaccagaauaaagaaggagaucaguacguguacaugggccaaccccugaacaaugacgaggaucaugcgcacuggaccgaggcuaagaugcuucuggacaacaucaauacaccugaagggauuauccccgcccucuuugagccugaaagagagaaguccgccgcuauugauggagaauaucgccugagaggcgaggcccggaaaaccuucgucgagcugaugcgcagaggggaccucccgguguggcuuagcuacaagguugcgucugaaggcuuucaguauuccgaucggcgcuggugcuucgacggagagagaaacaaucaggugcuggaagagaacauggacgucgaaaucuggacaaaagagggcgagcggaagaaacugagaccccgcuggcucgaugcccggaccuacagcgacccucuggcucuuagagaauuuaaggaguucgccgcugggcgccgguccgugucuggagaucugauucucgaaaucggcaaacugccccagcaccugacgcucagagcccaaaaugcucuugacaaccuggucaugcugcauaauagcgagcaagggggaaaggccuaucggcacgcgauggaggaacucccugauacaaucgagacccugaugcuucuggcccucauugcugugcugaccggcggcguuacacuguuuuuccucuccgggaagggacuuggcaaaaccucuaucgggcugcugugugugauggccagcuccgcucuccuguggauggccagcguggaaccccauuggauugccgcuucuaucauucuugaguuuuuccugaugguccuccugaucccggaaccugaccgccagagaacaccccaggauaaccaacuggcguacguugugaucggacuccuuuuuaugauucugacgguggccgcuaaugagaugggccugcucgagaccacaaagaaagaccuggggaucggacacgucgccgccgaaaaccaccaucacgcuaccaugcuugauguggaccugcggccugccuccgcguggacacucuaugccguugcuaccacggugauuacccccaugaugcgccauacaaucgagaacaccacagccaauauuagccugaccgcuaucgccaaccaggcggccauucugaugggccucgauaagggcuggccuaucucuaaaauggacaucggggucccccuucuggcucugggaugcuacucccaggugaauccgcucacgcugacagccgcuguccuuaugcugguggcccacuacgcuauuaucggcccugggcuccaagccaaggcgaccagagaagcccagaagcggacagcugccggaauuaugaaaaaccccaccguugauggcaucguggcuauugaccuggaccccgucguguaugaugccaaguucgagaaacagcuggggcagaucaugcuccuuauccuguguaccagccaaauucugcucaugcgcacaacgugggcccugugcgaaucuaucacccuugcgacaggaccucugaccacacucugggagggcagcccgggcaaguuuuggaauaccacgauugcuguuuccauggccaacaucuucagagggucuuaccuggcuggagccggccuggccuucagccucaugaaaucccuugggggaggccggcgcgggacaggagcucagggcgagacccugggcgaaaaguggaagagacagcugaaucagcucagcaaauccgaguuuaacaccuauaagcggucugggauuauggaaguggacagaagcgaggccaaagaaggacugaagcgcggcgagacaaccaaacaugcggucucccgggggacagccaaacuuagaugguucguggagcgcaaucuggugaagcccgaaggaaaaguuaucgaucucggcugugggcggggaggcuggucuuacuauugcgcuggccugaagaaagucacggaggugaagggguacaccaaaggaggcccugggcacgaggagcccaucccuauggccacauauggauggaaccuggugaagcuccacagcggcaaagacgucuuuuucacacccccugaaaagugugauacacuucugugcgacauuggggaguccucuccgaaucccaccaucgaggaaggaagaacgcugcgcguucucaagaugguggagccuuggcugcggggcaaccaauuuuguauuaaaauccuuaaucccuacaugccuagcguggucgaaacccuggagcagaugcagagaaagcauggcgggaugcucgugcgcaacccccugucccggaauagcacacacgagauguacuggguuucuugcggaaccggcaacauuguguccgcugucaauaugacaagcagaaugcugcucaaccgcuucaccauggcccaucggaaaccgacauaugaaagagauguggaccugggggcgggaacccgccacguugccguggagccugaagucgcuaaccuugauaucauuggccagagaaucgagaauaucaagaacgaacacaaaucuacguggcauuacgacgaggauaaucccuauaagacaugggccuaccacggguccuaugaggugaagcccagcggaucugcuuccagcauggugaacggcgucguucggcugcucaccaaaccuugggacgugauucccauggugacccaaaucgccaugacagacacgaccccuuuuggccagcagcgcgucuucaaggaaaaaguggauacaagaaccccgcgggcuaagagagggacagcccaaguuauggaggugaccgcgaaauggcuguggggauuucuuucccggaauaagaagccccgcauuuguacaagagaagaguucacccggaaaguccgcagcaacgccgcuaucggcgccguguuuguugacgaaaaucaguggaacucugcuaaggaggccguggaggaugaaaaauucugggaccugguccauagagagcgggaacuccacaagcaggggaaaugcgccacgugcguguacaauaugaugggaaagcgcgagaagaaacugggcgaauuugggaaggcgaaaggcagcagagcuauuugguauauguggcugggagcccgguuccucgaguucgaggcccugggcuuuaugaacgaagaucauugguucucccgcgaaaauucucuuagcgggguugaaggagagggccugcacaagcucggguacauccugagagacaucuccaaaauuccuggaggcaacauguacgcugaugacaccgccgggugggauacacggaucaccgaggacgaucuucagaaugaagcuaagauuacagacaucauggagcccgaacacgcccugcucgcgaccucuauuuuuaaacugacguaucaaaacaaggugguccgcgugcagagaccugccaagaauggcacagucauggaugugaucagccggcgcgaccagagaggauccggccagguugggaccuacggacugaacacauucaccaacauggaggugcaacucauccggcagauggaaucugagggcauuuuucugcccagcgagcuugaaacgccgaaucuggcugagagaguccucgacuggcuggaaaaacaugggaccgagcgccuuaagcggauggccaucuccggagaugacuguguggugaaaccuauugaugacagauucgcuacagcccugaucgcgcucaacgauaugggcaagguucgcaaagacauuccccagugggaaccuagcaagggguggaaugaguggcagcaagugcccuuuugcucucaccauuuccaccagcugaucaugaaggauggccgggagaucgucgugccuuguagaaaccaggacgaacugguuggacgcgcccgggugucccagggcgcuggguggagccucagagagaccgccugccugggaaaaucuuaugcucaaauguggcagcuuauguacuuucaccgccgggaucugagacucgccgcuaaugccauuuguuccgcgguccccguggacugggucccgacaagccgcaccacaugguccauccaugcccaccaucaguggaugaccacggaagauaugcugucuguguggaaccggguuuggauugaggaaaauccuuggauggaggacaagacacacgugagcuccugggaggaaguccccuaucuuggcaaaagagaggaccaauggugcgggagccugaucggacucaccgcucgggccaccugggccacaaacauucagguggcuaucaaucagguuagacgccugauuggcaacgaaaauuaccuggauuauaugaccucuaugaagcgguucaaaaacgaguccgaccccgagggggcccucugguga

SEQ ID NO: 18761 - RNA, 9879 nt, Artificial Sequence
  derived and/or modified CDS sequence (opt5) from DENV-1__FJ410188__SS-prME
agcgugaccaugcugcucaugcugcuucccacaguccuggccuuccaccucacgaccagaggcggggagccucauaugaucguuuccaagcaggaacggggaaagucucugcuuuuuaagaccagcgcuggcgugaacaugugcacccugauugccauggaccucggggagcugugugaagauaccaugaccuacaaaugcccccgcaucacagaggcggaacccgacgauguggacuguuggugcaaugcuaccgauacguggguuaccuauggaacauguucccagaccggcgagcacagacgggacaagcgcucuguggcccuggccccucauguugggcucggacuggagacaagaaccgaaacguggaugagcuccgagggcgcuuggaaacagauucagaagguggaaacaugggcccuucggcaccccggcuucaccgucaucgcucuguuucucgcccaugcgauugggacaucuaucacccagaagggaaucauuuucauccugcuuaugcuggugaccccuagcauggccaugcgcugcguuggcauugggaacagagauuuuguggagggacucuccggcgcuacaugggucgacguggugcuggagcacgggagcugugucacgaccauggccaaaaauaagcccacacuggauaucgaacuccugaaaaccgagguuacaaacccugcugugcuucggaagcugugcauugaagccaaaaucucuaauaccacgacagacucccgcuguccgacccaaggagaggcgacccucguggaggaacaagaugccaacuucgucugcagacggacauuuguggaccgcggcuggggcaauggguguggacuguucggcaaggggagccuucugaccugcgcuaaguuuaaaugcguuacaaagcucgagggaaaaauugugcagcacgaaaaccugaaguacucugucaucgugacgguucauaccggcgaucagcaccaaguggggaaugagacaaccgaacauggaacaaucgccaccauuacgccccaggcuccuaccuccgagauccagcugacagacuauggcgcccucacccuggacuguagccccagaacaggccuugauuucaacgaaaugguccugcucaccaugaaagagaagucuuggcuggugcacaaacagugguuucuugaccugccucuccccuggacguccggggccagcacaucccaagagaccuggaaucggcaggaucugcuggucacauucaagaccgcucacgcgaagaaacaggaagugguugugcucggaucucaagagggcgccaugcauaccgcucugacaggggccacggaaauucagaccagcggaacaaccacaaucuuugccggccaccuuaagugccgccugaaaauggacaagcucacccugaaagggauguccuacgucauguguacgggcagcuucaagcuggagaaggaaguggcugagacacagcauggaaccguucuugugcaggucaaauaugagggcaccgaugccccgugcaagauuccuuucucuacacaagacgaaaaaggggugacccagaacggaagacucaucacagcgaaucccaucgugacggauaaggagaaaccuguuaacauugaaaccgagccgcccuuuggcgaguccuacaucgucgugggggcuggagaaaaggcccugaagcugagcugguucaaaaagggcucuagcauugggaaaauguuugaggccacagcucggggcgccagacgcauggcuauccucggagacaccgccugggauuucggcuccauugggggaauguuuacaucugugggcaagcugguccaccagguguucgggaccgcguauggaguucuuuuuagcggcguguccuggacgaugaaaaucgggaucggcauucugcucaccuggcugggacugaauagccggucuacaucccuuagcaugaccuguaucgccgucggcauggugacacucuaccuggggguuauggugcaggcugacucuggaugcgucauuaacuggaagggcagagaacugaaguguggguccggaaucuucgugaccaacgagguucauacauggaccgaacaauacaaauuucaggccgauagcccuaagcgccucuccgcugccauuggcaaagcgugggaggagggggugugcggcauccggucugccacgagacuggaaaauauuauguggaagcagaucagcaacgagcuuaaucacauccugcucgaaaacgacaugaaauucacagucguggugggagacgcuuccggcauucuggcccaggggaagaaaaugauccgcccgcaacccauggagcacaaguauucuuggaaaagcuggggaaaggcuaagauuaucggcgccgauauucagaauaccaccuuuaucaucgacgggccugauacacccgaauguuccgacgaucagcgggccuggaacauuugggaggucgaggacuacggauucggcaucuuuaccacgaauauuuggcugaaacuuagagauagcuauacacagaugugcgaccaucgccucaugucugcugcgaucaaggauuccaaagccguucacgcugacaugggcuacuggauugaaagcgagaagaacgaaaccuggaagcuggcccgggccucuuucaucgaggugaaaacauguaucuggccuaagucccauacccuguggagcaauggggugcucgaaucugagaugauuauccccaaaauuuauggaggcccgaucagccaacacaacuacagaccuggguauuucacacagaccgcuggacccuggcaccugggcaaacuugagcuggauuuugaccucugcgaagggacgaccgucauuguggaugagcauugcggaaaucgcggcccuucccugcggacaaccacaguuaccggcaaaaucauccacgaaugguguugcagaagcuguacgcugcccccucuucgguuccgcggggaggacggaugcugguacggcauggagauuagacccgugaaggaaaaggaggaaaaccucguccggucuaugguguccgccgggagcggagagguugacuccuuuucucugggcauccugugugugagcauuaugaucgaagaggucaugagaucccgcuggucucggaaaaugcucaugacagggacccuggcgguguuccuucugcucauuaugggacagcugacauggaaugaucugaucagacuuugcauuaugguuggcgcuaacgccagcgaccgcaugggcauggggaccaccuaccuggcccucauggcuacauuuaagaugagaccgauguucgccgugggacugcucuuucggcgccugacguccagagagguccuucugcucaccaucggccugucucugguggcgagcguggaacuuccuaauucccuggaggaacucggggauggacuggcuaugggcaucaugaugcucaaacugcuuacagaguuccaaccccaucagcuguggaccacacuccugagccugaccuuuauuaagacgacacuuucucuggacuaugccuggaaaaccauggccauggcucucuccaucgucagccuguucccccucugucugucuaccacaucccagaagaccacauggcuuccuguucugcuggggagcuuuggaugcaagccgcucacgauguuccugauuaccgaaaacaaaaucuggggccggaagucuuggccccuuaacgagggcauuauggccaucgggaucguguccauucugcucagcucccugcucaaaaaugaugugccucuggcuggaccccuuaucgccggcgggaugcugauugcguguuacgucaucagcggaucuagcgccgaccugucccucgagaaggcugccgaagugucuugggaggaagaggcugaacacagcggcacaucccauaacaugcugguugaggugcaggaugacgggaccaugaaaauuaaggaugaggaacgcgacgauacacuuaccauccugcucaaagccacgcugcucgccgucucuggaguguauccuaugagcauccccgcuacccuguuuguuugguacuucuggcaaaagaagaaacagagauccggcgugcuuugggacacaccuucucccccggaggucgaacgggcggugcuggaugacggcauuuaucgcauccugcagagagggcuccugggacggagccaggucggcguggggguuuuccaagacggaguguuucacaccauguggcacgucacacgcggcgccgugcuuauguaccaggggaagagacuggagccuuccugggcuagcguuaaaaaggaucucauuucuuauggaggcggcuggcgguuccagggguccuggaauaccggagaggaagugcaggucaucgccguggagcccggcaaaaacccuaagaaugugcaaacaacgcccgggaccuuuaagacaccggaaggagagguuggcgccauugcucuggacuucaaaccugggaccagcggaucucccaucgucaacagagaaggcaagauugugggccucuacgggaauggaguggucaccacauccggcacguacgugagcgccaucgcgcaggcuaaagccucccaggaggggccucugcccgagaucgaagaugagguuuuucgcaagcggaaccuuaccauuauggaccugcaucccggaucuggcaaaacaagacgcuaucugccugccaucgugcgggaagcuauuaagagaaagcuccgcacccugauccuugccccgacacgggucguggcgagcgagauggcugaagcccugaaagggaugcccauuagauaccaaaccacggccguuaaguccgagcacacaggccgcgagaucguggaucucaugugccaugcuaccuucaccaugcggcugcugagcccugucagagugcccaauuauaacaugaucauuauggacgaagcccacuuuacagauccugcuucuaucgccgcgcggggauacauuuccacccgcguuggcaugggggaggccgcugccaucuucaugacagcuacacccccuggaagcguggaagccuuuccgcagucuaaugccgucauucaggacgaggaaagagauauccccgagcggagcuggaacuccggcuaugacuggaucacggauuucccugggaaaacagugugguuugugcccucuauuaagagcggaaaugacaucgcuaacugucuccgcaaaaauggcaagagagucauucagcuuucccggaagaccuucgacacagaguaccagaagaccaagaacaacgauugggacuauguugugacgaccgauaucucugaaaugggggcgaauuucagagccgaccgcgugauugauccucggagaugccugaaacccgucauccugaaggacggcccggagcgcgugauucucgcuggaccuaugcccguuacaguggccagcgccgcucagcggagaggccgcaucgggcggaaccagaauaaagaaggagaucaguacgucuacaugggccaaccccugaacaaugacgaggaucaugcccacuggaccgaggcgaagaugcuucuggacaacaucaauacaccugaagggauuauccccgcucucuuugagccugaaagagagaaguccgccgccauugauggagaauaucgccugagaggcgaggcucggaaaaccuucguggagcugaugcgcagaggggaccucccgguuuggcuuagcuacaagguggccucugaaggcuuucaguauuccgaucggcgcuggugcuucgacggagagagaaacaaucagguccuggaagagaacauggacguggaaaucuggacaaaagagggcgagcggaagaaacugagaccccgcuggcucgaugcgcggaccuacagcgacccucuggcccuuagagaauuuaaggaguucgcugccgggcgccgguccgucucuggagaucugauucucgaaaucggcaaacugccccagcaccugacgcucagagcucaaaaugcccuugacaaccuggugaugcugcauaauagcgagcaagggggaaaggcuuaucggcacgccauggaggaacucccugauacaaucgagacccugaugcuucuggcgcucauugccguucugaccggcggcgugacacuguuuuuccucuccgggaagggacuuggcaaaaccucuaucgggcugcugugugugauggcuagcuccgcccuccuguggauggcuagcgucgaaccccauuggauugccgccucuaucauucuugaguuuuuccugaugguucuccugaucccggaaccugaccgccagagaacaccccaggauaaccaacuggcuuacguggugaucggacuccuuuuuaugauucugacggucgcggccaaugagaugggccugcucgagaccacaaagaaagaccuggggaucggacacguggcugccgaaaaccaccaucacgccaccaugcuugauguugaccugcggccugcuuccgccuggacacucuaugcgguggccaccacggucauuacccccaugaugcgccauacaaucgagaacaccacagcuaauauuagccugaccgccaucgcuaaccaggccgcgauucugaugggccucgauaagggcuggccuaucucuaaaauggacaucggggugccccuucuggcccugggaugcuacucccaggucaauccgcucacgcugacagcugccgugcuuaugcugguugcucacuacgccauuaucggcccugggcuccaagcuaaggccaccagagaagcgcagaagcggacagccgcuggaauuaugaaaaaccccaccguggauggcaucgucgccauugaccuggaccccgugguuuaugaugcuaaguucgagaaacagcuggggcagaucaugcuccuuauccuguguaccagccaaauucugcucaugcgcacaacgugggcccugugcgaaucuaucacccuugccacaggaccucugaccacacucugggagggcagcccgggcaaguuuuggaauaccacgauugcgguguccauggcuaacaucuucagagggucuuaccuggccggagcuggccuggccuucagccucaugaaaucccuugggggaggccggcgcgggacaggagcccagggcgagacccugggcgaaaaguggaagagacagcugaaucagcucagcaaauccgaguuuaacaccuauaagcggucugggauuauggaagucgacagaagcgaggcuaaagaaggacugaagcgcggcgagacaaccaaacaugccgugucccgggggacagcgaaacuuagaugguucguggagcgcaaucugguuaagcccgaaggaaaagucaucgaucucggcugugggcggggaggcuggucuuacuauugcgccggccugaagaaagugacggaggugaagggguacaccaaaggaggcccugggcacgaggagcccaucccuauggcuacauauggauggaaccuggucaagcuccacagcggcaaagacgucuuuuucacacccccugaaaagugugauacacuucugugcgacauuggggaguccucuccgaaucccaccaucgaggaaggaagaacgcugcgcgugcucaagaugguggagccuuggcugcggggcaaccaauuuuguauuaaaauccuuaaucccuacaugccuagcgucguggaaacccuggagcagaugcagagaaagcauggcgggaugcucguucgcaacccccugucccggaauagcacacacgagauguacugggugucuugcggaaccggcaacauugucuccgccgugaauaugacaagcagaaugcugcucaaccgcuucaccauggcucaucggaaaccgacauaugaaagagauguugaccugggggccggaacccgccacguggcggucgagccugaaguggccaaccuugauaucauuggccagagaaucgagaauaucaagaacgaacacaaaucuacguggcauuacgacgaggauaaucccuauaagacaugggcuuaccacggguccuaugaggugaagcccagcggaucugccuccagcauggucaacggcguugugcggcugcucaccaaaccuugggacgugauucccauggucacccaaaucgcuaugacagacacgaccccuuuuggccagcagcgcguguucaaggaaaaaguugauacaagaaccccgcgggccaagagagggacagcucaagugauggaggucaccgccaaauggcuguggggauuucuuucccggaauaagaagccccgcauuuguacaagagaagaguucacccggaaagugcgcagcaacgcggccaucggcgcuguuuuuguggacgaaaaucaguggaacucugccaaggaggcugucgaggaugaaaaauucugggaccuggugcauagagagcgggaacuccacaagcaggggaaaugcgccacgugcguuuacaauaugaugggaaagcgcgagaagaaacugggcgaauuugggaaggccaaaggcagcagagcgauuugguauauguggcugggagcucgguuccucgaguucgaggcccugggcuuuaugaacgaagaucauugguucucccgcgaaaauucucuuagcgggguggaaggagagggccugcacaagcucggguacauccugagagacaucuccaaaauuccuggaggcaacauguacgccgaugacaccgcugggugggauacacggaucaccgaggacgaucuucagaaugaagccaagauuacagacaucauggagcccgaacacgcucugcucgccaccucuauuuuuaaacugacguaucaaaacaaggucgugcgcguccagagaccugcgaagaauggcacagugauggauguuaucagccggcgcgaccagagaggauccggccagguggggaccuacggacugaacacauucaccaacauggagguccaacucauccggcagauggaaucugagggcauuuuucugcccagcgagcuugaaacgccgaaucuggccgagagagugcucgacuggcuggaaaaacaugggaccgagcgccuuaagcggauggcuaucuccggagaugacugugugguuaaaccuauugaugacagauucgccacagcucugaucgcccucaacgauaugggcaaggugcgcaaagacauuccccagugggaaccuagcaagggguggaaugaguggcagcaaguccccuuuugcucucaccauuuccaccagcugaucaugaaggauggccgggagaucgugguuccuuguagaaaccaggacgaacuggugggacgcgcgcgggucucccagggcgccggguggagccucagagagaccgcuugccugggaaaaucuuaugcccaaauguggcagcuuauguacuuucaccgccgggaucugagacucgcugccaaugcuauuuguuccgccgugcccgucgacugggugccgacaagccgcaccacaugguccauccaugcgcaccaucaguggaugaccacggaagauaugcugucuguuuggaaccggguguggauugaggaaaauccuuggauggaggacaagacacacgucagcuccugggaggaagugcccuaucuuggcaaaagagaggaccaauggugcgggagccugaucggacucaccgcccgggcuaccugggccacaaacauucagguugccaucaaucaggugagacgccugauuggcaacgaaaauuaccuggauuauaugaccucuaugaagcgguucaaaaacgaguccgaccccgagggggcucucugguga

SEQ ID NO: 18762 - RNA, 9879 nt, Artificial Sequence
  derived and/or modified CDS sequence (opt5) from DENV-1__FJ478458__SS-prME
agcgugaccaugcugcuuaugcugcuucccacagcucuggcuuuccaccucacgaccagaggcggggaaccucauaugaucgucuccaagcaggaacggggaaaaucucugcuuuuuaagacaagcgccggcauuaauaugugcacccugaucgcgauggaccucggggagcugugugaagauacaaugaccuacaaaugcccccgcauuacagaggcugaacccgacgauguugacuguuggugcaaugccaccgauacgugggugaccuauggaacauguucccagaccggcgagcacagacgggacaagcgcucuguggcccuggcuccucaugucgggcucggacuggagacaagaaccgaaacguggaugagcuccgagggcgccuggaaacagauccagaagguggaaacaugggcccuucggcaccccggcuucaccguuacagcccuguuucucgcgcaugccauugggaccucuaucacccagaagggaaucauuuucauccugcuuaugcuggugacaccuagcauggcuaugcgcugcgucggcauugggaacagagauuuuguggagggacucuccggcgccacguggguugacgugguccuggagcacgggagcugugugaccacaauggcuaaagauaagcccacccuggacaucgaacuccugaaaacagaggugaccaauccugccauucuucggaagcugugcaucgaagcgaaaauuucuaacacgacaaccgauucccgcuguccgacccaaggagaggccacacucgucgaagaacaggacagcaauuucguuugcagacggaccuuuguggaucgcggcuggggcaacggguguggacuguucggcaaggggucucuucugacaugcgcuaaguuuaaaugcgugacgaagcucgagggaaaaaucguccaguacgaaaaucugaaguauuccgugaucguuaccgugcacacaggcgaccagcaucaagucgggaacgagaccacagaacacggaaccauugccacgaucacaccccaggcuccuacaagcgagauucagcugaccgacuacggcgcccucacacuggauuguucucccagaaccggccuugacuucaaugaaauggugcugcucacgaugaaagagaaguccuggcugguucauaaacagugguuucuugaucugccucuccccuggacaagcggggccuccaccucucaagagacauggaaccggcaggaccugcuggugaccuucaagaccgcucacgcgaagaaacaggaagucgugguccucggaagccaagagggcgccaugcacacagcucugacgggggccaccgaaauccagacauccggaaccacaaccauuuuugccggccaucuuaagugccgccugaaaauggauaagcucacgcugaaagggaugagcuaugugauguguacaggcucuuucaagcuggagaaggaaguugcugagacccagcacggaaccgugcuuguccaggugaaauacgagggcacagacgccccgugcaagaucccuuucuccgcgcaagaugaaaaagggguuacccagaauggaagacucaucacagcuaaccccauugugacggacaaggagaaaccugucaauaucgaaaccgagccgcccuuuggcgagagcuauauuguggugggggccggagaaaaggcccugaagcugucuugguucaaaaagggcagcuccaucgggaaaauguuugaggcuacagcccggggcgcuagacgcauggccauucucggagauaccgcgugggacuucggcucuaucgggggaguuuuuacaagcgucggcaagcuggugcaucagguguucggggccgcuuacggaguccucuuuuccggcgugagcuggaccaugaaaaucgggauuggcauccugcucacguggcugggacugaacucucgguccaccagccuuucuaugacauguauugccguuggcauggugacccucuaccugggggucauggugcaggcugauuccggaugcguuaucaauuggaagggcagagaacugaagugugggagcggaauuuucgugacaaacgagguccacaccuggacagaacaauauaaauuucaggccgacuccccuaagcgccucucugcggccaucggcaaggcuugggaggagggggugugcggcauucggagcgccaccagacuggaaaacaucauguggaagcagaucuccaaugagcuuaaccauauucugcucgaaaaugacaugaaauucacgguuguggucggagaugcuaacggcauccuggcccaggggaagaaaaugauucgcccgcaacccauggagcaccgguacucuuggaaaagcuggggaaaggccaagaucauuggcgcugacauccagaauacaaccuuuaucauugaugggccugacacccccgaauguccugaugaccagagagcguggaacaucugggagguggaggauuauggauucggcauuuuuacaaccaauaucuggcugaaacuucgcgacuccuacacgcagaugugcgaucaccggcucaugagcgccgcuauuaaagacucuaaggccgugcaugccgauaugggcuauuggaucgaauccgagaaaaacgaaacauggaagcuggcuagagccagcuucaucgaggucaagaccuguauuuggcccaaaucucacacacugugguccaaugggguucucgaaagcgagaugaucauuccgaagaucuacggaggcccuauuucucaacauaacuaucgccccggguacuucacccagacagcgggaccuuggcaccugggcaaacuugagcuggacuuugaucucugcgaagggaccacggugguggucgacgagcacugcggaaaucggggccccagccugagaaccacaaccgugacaggcaagaucauccaugaaugguguugccgguccuguacccugccuccccuucgcuucagaggggaggacggaugcugguacggcauggagauucggccgguuaaagaaaaggaggaaaaccucgugagaagcauggucucugcuggguccggagagguggauagcuuuucccugggcauccuguguguuucuauuaugaucgaagaggugaugcgcagccggugguccagaaagaugcucaugacggggacacuggccgucuuccuucugcucauuaugggacagcugaccuggaaugaccugauccgccuuugcauuauggugggcgccaacgcuucugauagaaugggcauggggacaaccuaucuggcccucauggcgaccuuuaaaaugcggccuauguucgcuguuggacugcucuuucgcagacugacaagccgggaggugcuucugcucacgaucggccugucccuggucgccucuguggaacuucccaauagccuggaggaacucggggacggacuggccaugggcaucaugaugcucaagcugcuuaccgaguuccaaccccaccagcuguggacaacccuccugucccugacauuuauuaaaaccacgcuuagccuggauuacgcuuggcgcacaauggccauggugcucucuaucgcuucccuguucccucucugucugagcaccaccucucagaagacaaccuggcuuccgguccugcugggguccuuuggaugcaaaccccucacaauguuccugauuacggaaaacaagaucuggggcagaaagagcuggccucuuaacgagggcauuauggccaucgggaucguuucuauucugcucuccagccugcucaaaaaugacgugccccuggcgggaccucuuaucgccggcgggaugcugauugcuuguuaugugaucuccggaagcucugccgaucugagccucgagaaggcugccgaagucuccugggaggaagaggccgaacauucuggcaccagccacaacauucugguggagguucaggacgaugggacaaugaaaaucaaggacgaggaacgggaugacacccuuacaauccugcucaaagcuacccugcucgcgguguccggagucuaccccaugucuauuccugccacgcuguuugugugguauuucuggcaaaagaaaaagcagcgcagcggcguucuuugggauacccccuccccgccugagguggaaagagcuguccuggacgacggcaucuaccggauucugcagcgcgggcuccugggaagaucucaggugggcgucgggguguuccaagauggaguuuuucauacaauguggcacgugacccggggcgccguccuuauguaucaggggaagagacuggagcccagcugggccuccgugaaaaaggaccucaucagcuacggaggcggcuggcgcuuccaggggucuuggaauacaggagaggaaguucaggugauugcugucgagccuggcaaaaaccccaagaaugugcaaaccacaccggggacguuuaaaaccccugaaggagaggugggcgccaucgcgcuggauuucaagcccgggacauccggaagcccuauuguuaaccgggaaggcaagaucgucggccucuacgggaauggaguggugaccaccucuggcacauaugucuccgcuaucgcccaggccaaaacgagccaggaggggccccugcccgagauugaagaggaaguguuuaagaaaagaaaccuuaccaucauggaccugcacccuggauccggcaagacacgccgguaccugccggcuauuguuagagaggccaucaaacgcaagcuccggacccugauucuugcgcccacaagaguggucgcuucugaaauggccgaggcccugaaggggaugccuauccgcuaucaaaccacggcugugaaaagcgagcauacaggccgggaaaucguugaucucaugugccacgccaccuucaccaugagacugcugucccccgugcgggucccuaauuacaacaugauuaucauggacgaggcucauuuuacagaucccgccagcauugcggcccgcggauauaucucuaccagagugggcaugggggaagcugccgcuauuuucaugacagccaccccuccgggauccguugaggccuuuccccagagcaaugcugugauccaggacgaagaacgggauaucccugagcgcucuuggaacagcggcuacgacuggauuacggauuuccccgggaagacagucugguuugugccuuccaucaaaucuggaaaugacauugcgaacugucucagaaagaauggcaaacgggugauccagcuuagcagaaagaccuucgacacagaauaucaaaagaccaaaaacaacgauugggacuacgucguuacgaccgauauuuccgagaugggggccaauuuccgcgcugaccgggugaucgaucccagacgcugccugaagccggugauucugaaagacggcccugaacgggucauccucgccggacccaugcccgugacaguugccucugcugcccagagacgcggccggaucgggagaaaccagaauaaggagggagaucaguacguguauaugggccaaccucugaacaaugacgaggaucacgcgcauuggaccgaagcuaaaaugcuucuggacaacauuaauacacccgaggggaucauuccugcccucuuugaaccggagcgcgaaaagagcgccgcuaucgauggagaguacagacugcggggcgaggcccgcaagaccuucgucgaacugaugagaagaggggaccuccccguguggcuuuccuauaaaguugcgagcgagggcuuucaguacucugaucgcagauggugcuucgacggagaacggaacaaucaggugcuggaggaaaacauggacgucgagauuuggacaaaggagggcgaacgcaaaaagcugcgcccucgguggcucgaugccagaaccuauuccgacccccuggcucuuagagaguuuaaagaguucgccgcugggcggagaagcguguccggagaucugauccucgagaucggcaagcugccucagcaccugacgcuccgggcccaaaaugcucuugacaaccuggucaugcugcacaauucugaacaagggggaaaagccuaccgccaugcgauggaggagcuccccgauacaauugaaacccugaugcuucuggcccucaucgcugugcugaccggcggcguuacacuguuuuuccucagcgggaagggacuuggcaagaccuccauugggcugcugugugugauggccucuagcgcucuccuguggauggccaacguggagccgcacuggaucgccgcuuccauuauccuugaauuuuuccugaugguccuccugaucccugagcccgacagacagcggacaccucaggauaaucaacuggcguauguugugauuggacuccuuuuuaugauccugacgguggccgcuaacgagaugggccugcucgaaaccaccaaaaaggaccuggggauuggacaugucgccgccgagaaccagcaccacgcuaccaugcuugauguggaccugcgccccgccagcgcguggacacucuacgccguugcuaccacggugaucaccccuaugaugagacauacaauugaaaauaccacagccaacaucucucugaccgcuauugccaaucaggcggccauccugaugggccucgauaaaggcuggcccaucuccaagauggacauuggggucccgcuucuggcucugggaugcuacagccaagugaacccucucacgcugacagccgcuguccuuaugcugguggcccacuaugcuaucauuggccccgggcuccaggccaaagcgacccgggaggcccagaagcgcacagcugccggaaucaugaagaaucccaccguugauggcauuguggcuaucgaccuggacccugucguguacgaugccaaauucgaaaagcagcuggggcaaaucaugcuccuuauucuguguaccucucagauccugcucaugagaacaacgugggcccugugcgaguccauuacccuugcgacaggaccgcugaccacacucugggagggcagccccggcaaauuuuggaacaccacgaucgcuguuucuauggccaauauuuuccgggggagcuaucuggcuggagccggccuggccuucucccucaugaagucucuugggggaggccgcagagggacaggagcucagggcgaaacccugggcgagaaauggaagcggcagcugaaccaacucagcaaguccgaauuuaauaccuacaaaagaagcgggaucauggagguggaccgcuccgaagccaaggagggacugaaacggggcgagacaaccaagcaugcggucucuagagggacagccaaacuucgcugguucguggaacggaaccuggugaagccugagggaaagguuaucgaucucggcugugggagaggaggcuggagcuauuacugcgcuggccugaaaaaggucacggaagugaaaggguauaccaagggaggccccgggcacgaggaaccuauucccauggccacauacggauggaaucuggugaaacucuacuccggcaaggacgucuuuuucaccccuccggagaaaugugauacacuucugugcgacaucggggagucuagccccaacccuaccauugaagagggacgcacgcugcggguucucaagaugguggaacccuggcugagaggcaaucaguuuuguaucaagauucuuaacccuuauaugcccuccguggucgagacccuggagcagaugcagcgcaaacauggcgggaugcucgugcggaauccgcugucuagaaacagcacacacgaaauguacuggguuuccugcggaaccggcaauaucgugagcgcugucaacaugacaucucgcaugcugcucaaccgguucaccaugacacacagaaagccuaccuaugagcgcgauguggaccugggggccggaacgagacauguugcgguggaacccgaggucgccaaucuugauauuaucggccaacggaucgaaaacauuaaaaaugagcacaaguccacauggcauuacgacgaggauaaccccuauaaaaccugggcuuaccacgggagcuaugaagugaagccuucuggauccgccagcucuauggugaauggcgucguucgccugcucaccaagcccugggacgugaucccuauggugacacagauugcuaugacggacaccacaccguuuggccagcaaagagucuucaaagagaagguggauacccggacacccagagccaaacgggggaccgcucagaucauggaaguuacagccaaguggcuguggggauuucuuucccgcaacaaaaagccuagaauuuguacccgggaggaguucacgcgcaaggugagaagcaaugcggccaucggcgcugucuuuguggacgagaaccaguggaacuccgccaaagaggcuguugaagaugagcgguucugggaccuggugcaccgcgaaagagagcuccauaagcaggggaaaugcgcuaccugcgucuacaacaugaugggaaagcgggagaaaaagcugggcgaguuugggaaggccaaaggcagccgcgcgaucugguacauguggcugggagcuagauuccucgaguucgaagcccugggcuuuaugaaugaggaucacugguucucucgggaaaacagcuuuuccgggguggagggagagggccuucauaagcugggguauauucuccgcgacaucucuaaaauucccggaggcaauauguacgccgaugacacagcugggugggauaccagaaucacagaagacgaucugcaaaacgaggccaagauuaccgacaucauggaaccugagcacgcccuucuggccacgagcaucuucaaacucacauaucagaauaagguugugcggguccagcgccccgcgaaaaacggcaccgugauggaugucauuuccagacgggaccagagaggaucuggccaaguggggacauacggacugaacaccuuuacgaauauggaaguucagcugauccgccagauggagagcgagggcauuuuccucccguccgaacuggagaccccuaaccuugccgaacgggugcuggacuggcucgagaagcaugggacagaaagacugaagcgcauggcuaucucuggagaugacugugucgugaaacccguggaugaccgguuugccaccgcucuuauugcccugaaugauaugggcaagguuagaaaagacaucccucagugggagcccagcaagggguggaacgauuggcaacaggugccuuucugcucccaccacuuucaucagcucaucaugaaagacggccgcgagauugucgugcccugucggaaucaggaugaacugguuggacgggcgcgcgugagccaaggcgccggguggucucugcgggagacagcuugccucggaaaguccuaugcccagauguggcagcugauguacuuccacagacgcgaccuucggcuggcugccaacgcuaucuguagcgccgucccgguggauugggucccuaccucuagaacaaccugguccauucaugcgcaccaccaauggaugacgacagaagacaugcucagcguguggaaucggguuuggaucgaggaaaaccccuggauggaggacaagacccauguguccucuugggaggaaguccccuaucugggcaaaagagaggaucaguggugcgggagccuuauuggacugaccgcccgcgcuacaugggccaccaauauccagguggccauuaaccagguucggagacucaucggcaaugaaaacuaccuggacuacaugacauccaugaagcgcuuuaaaaaugagagcgauccugagggggcucugugguga

SEQ ID NO: 18763 - RNA, 9879 nt, Artificial Sequence
  derived and/or modified CDS sequence (opt5) from DENV-1__FJ410190__SS-prME
agcgugacaaugcugcuuaugcugcuucccacagcccuggcuuuccaccucacgaccagaggcggggaaccucauaugaucgucuccaagcaggaacggggaaaaucucugcuuuuuaagacaagcguuggcauuaacaugugcacccugaucgccauggaccucggggagcugugugaagauacaaugaccuacaaaugccccagaauuacagaggcggaacccgacgauguggacuguuggugcaaugcuaccgauacgugggugaccuauggaacauguucccagaccggcgagcacagacgggacaagcgcucugucgcccuggccccucauguggggcucggacuggagacaagaaccgaaacguggaugagcuccgagggcgcuuggaaacagauccagaagguugaaacaugggcccuucggcaccccggcuucaccgugauugcucuguuucucgcccaugcgaucgggacaucuaucacccagaagggaauuaucuucauucugcuuaugcuggucaccccuagcauggccaugcgcugcgugggcaucgggaacagagauuuuguugagggacucuccggcgcuacauggguggacgucgugcuggagcacgggagcugugugacgaccauggccaaagauaagcccacacuggacauugaacuccugaaaaccgaggucacaaauccugcuguucuucggaagcugugcaucgaagccaaaauuucuaacaccacgacagauucccgcuguccgacccaaggagaggcgacccucguggaagaacaggacagcaauuucgugugcagacggacauuugucgaucgcggcuggggcaacggguguggacuguucggcaaggggucucuucugaccugcgccaaguuuaaaugcgugacaaagcucgagggaaaaaucguucaguacgaaaaucugaaguauuccgugaucgucacggugcacaccggcgaccagcaucaaguugggaacgagacaaccgaacacggaacaauugcuaccaucacgccccaggccccuaccagcgagauucagcugacagacuacggcgcucucacccuggauuguucucccagaacaggccuugacuucaaugaaauggugcugcucaccaugaaagagaaguccuggcugguccauaaacagugguuucuugaucugccucuccccuggacgagcggggccuccacaucucaagagaccuggaaccggcaggaccugcuggugacauucaagaccgcccacgcuaagaaacaggaagucgugguucucggaagccaagagggcgcgaugcacaccgcccugacaggggcuacggaaauccagaccuccggaacaaccacaauuuuugccggccaucuuaagugccgccugaaaauggauaagcucacccugaaagggaugagcuaugugauguguacgggcucuuucaagcuggagaaggaagucgccgagacacagcacggaaccgugcuuguucaggugaaauacgagggcaccgacgcuccgugcaagaucccuuucuccgcccaagaugaaaaaggggucacacagaauggaagacucaucaccgcgaaccccauugugacagacaaggagaaaccugugaauaucgaaacggagccgcccuuuggcgagagcuauauuguuaucggggcuggagaaaaggcccugaagcugucuugguucaaaaagggcagcuccauugggaaaauguuugaggccaccgcucggggcgccagacgcauggcuauccucggagauacagccugggacuucggcucuaucgggggagucuuuaccagcgugggcaagcuggugcaucaggucuucggggcggccuacggagugcucuuuuccggcguuagcuggacaaugaaaauugggaucggcauucugcucaccuggcugggacugaacucucgguccacgagccuuucuaugaccuguaucgcugugggcauggucacacucuaccugggggugaugguucaggccgauuccggaugcgugauuaauuggaagggcagagaacugaagugugggagcggaaucuucgucaccaacgaggugcacacauggaccgaacaauauaaauuucaggcugacuccccuaagcgccucucugccgcgauuggcaaagccugggaggaggggguuugcggcauccggagcgcuacaagacuggaaaacaucauguggaagcagauuuccaaugagcuuaaccauauccugcucgaaaaugacaugaaauucaccguggucgugggagaugccaacggcauucuggcucaggggaagaaaaugauccgcccgcaacccauggagcaccgguacucuuggaaaagcuggggaaaggccaagauuaucggcgccgacauccagaauacgacauuuauuaucgaugggccugacacccccgaauguccugaugaccagagagcuuggaacauuugggagguggaggauuauggauucggcaucuuuaccacaaauauuuggcugaaacuucgcgacuccuacacccagaugugcgaucaccggcucaugagcgcggccaucaaagacucuaaggcuguccaugccgauaugggcuauuggaucgaauccgagaaaaacgaaacguggaagcuggccagagcuagcuucauugagguuaagacauguaucuggcccaaaucucacacccugugguccaauggggugcucgaaagcgagaugauuaucccgaagauuuacggaggcccuaucucucaacauaacuaucgccccggguacuucacacagaccgccggaccuuggcaccugggcaaacuugagcuggacuuugaucucugcgaagggacaaccguggucguggacgagcacugcggaaaucggggccccagccugagaacgaccacaguuaccggcaagaucauucaugaaugguguugccgguccuguacacugccuccccuucgcuucagaggggaggacggaugcugguacggcauggagauccggccggugaaagaaaaggaggaaaaccucgucagaagcauggugucugcgggguccggagagguugauagcuuuucccugggcauucugugugugucuaucaugauugaagaggucaugcgcagccggugguccagaaagaugcucaugaccgggacgcuggcuguguuccuucugcucaucaugggacagcugacauggaaugaccugauucgccuuugcaucaugguuggcgccaacgccucugauagaaugggcauggggaccacauaucuggcucucauggccaccuuuaaaaugcggccuauguucgcggugggacugcucuuucgcagacugaccagccgggagguccuucugcucacaaucggccugucccugguggcuucuguggaacuucccaauagccuggaggaacucggggacggacuggccaugggcauuaugaugcucaagcugcuuacggaguuccaaccccaccagcuguggaccacacuccugucccugaccuuuaucaaaacaacccuuagccuggauuacgccuggcgcacgauggcuaugguccucucuauuguuucccuguucccucucugucugagcacaaccucucagaagaccacauggcuuccggugcugcugggguccuuuggaugcaaaccccucaccauguuccugaucacagaaaacaagauuuggggcagaaagagcuggccucuuaacgagggcaucauggccaucgggauugugucuauccugcucuccagccugcucaaaaaugacgucccccuggcuggaccucuuauugccggcgggaugcugaucgcguguuaugugauuuccggaagcucugccgaucugagccucgagaaggcugccgaaguuuccugggaggaagaggcugaacauucuggcacgagccacaacauccugguggagguccaggacgaugggaccaugaaaaucaaggacgaggaacgggaugacacacuuaccauucugcucaaagccacacugcucgccguguccggaguuuaccccaugucuaucccugcuacccuguuugugugguauuucuggcaaaagaaaaagcagcgcagcggcguccuuugggauacgcccuccccgccugagguggaaagagcgguccuggacgacggcauuuaccggauccugcagcgcgggcuccugggaagaucucaggugggcguugggguguuccaagauggagucuuucauaccauguggcacgugacacggggcgccguucuuauguaucaggggaagagacuggagcccagcugggcuuccgugaaaaaggaccucauuagcuacggaggcggcuggcgcuuccaggggucuuggaauaccggagaggaaguccaggugaucgccguggagccuggcaaaaaccccaagaauguucaaacaaccccggggacauuuaaaacgccugaaggagaggucggcgccauugcucuggauuucaagcccgggaccuccggaagcccuaucgugaaccgggaagagaagaucgugggccucuacggcaauggggucgugacaaccucuggaaccuauguuuccgccauugcgcaggcuaaaacaagccaggagggcccccugcccgaaaucgaggacgaaguguuuaagaaaagaaaccuuacgauuauggaucugcacccuggguccggaaagacccgccgguaccugccggccaucgucagagaggccauuaaacgcaagcuccggacacugauccuugcucccaccagagugguugccucugaaauggcggaggcucugaagggcaugccuauccgcuaucaaacaaccgccgugaaaagcgagcauacggggcgggaaauugucgaccucaugugccacgccacauucaccaugagacugcugucccccgugcggguuccuaauuacaacaugaucauuauggaugaggcucauuuuaccgaccccgccagcaucgcugcccgcggcuauauuucuacaagagugggaaugggcgaagcggccgcuaucuucaugaccgccacaccuccgggguccgucgaggcuuuuccccagagcaaugccgugauccaggaugaagaacgggacauuccugagcgcucuuggaacagcggauacgauuggaucaccgacuuccccggcaagacggugugguuugucccuuccauuaaaucugggaaugacaucgccaacugucucagaaagaauggaaaacggguuauucagcuuagcagaaagacauucgauaccgaauaucaaaagaccaagaauaacgacugggauuacguggugaccacggacaucuccgagaugggcgcuaauuuccgcgcggaucgggucauugaccccagacgcugccugaagccggugauccugaaagaugggccugaacggguuauccucgccggccccaugcccgugaccgucgcuucugccgcccagagacgcggacggauuggcagaaaccagaauaaggagggggaccaguacguguauaugggacaaccucugaacaaugaugaggaccacgcucauuggacagaagccaaaaugcuucuggauaacaucaauacccccgagggcauuaucccugcgcucuuugaaccggagcgcgaaaagagcgcugccauugacggggaguacagacugcggggagaggcccgcaagacauucguugaacugaugagacggggcgaucuccccguguggcuuuccuauaaagucgcuagcgagggguuucaguacucugaccgcagauggugcuucgacggcgaacggaacaaucaggugcuggaggaaaacauggaugucgagaucuggaccaaggagggagaacgcaagaagcugcgcccucgguggcucgacgccagaacauauuccgauccccuggcgcuucgcgaguuuaaagaguucgccgcuggccggagaagcguguccggggaccugauccucgagauuggaaagcugccucagcaccugacccuccgggcccaaaaugcucuugauaaccugguuaugcugcacaauucugaacagggcgggaaagccuaccgccaugcuauggaggagcuccccgacacgaucgaaacacugaugcuucuggcccucauugcggugcugaccggaggcgugacccuguuuuuccucagcggcaaggggcuuggaaagacauccaucggccugcugugugucauggccucuagcgcucuccuguggauggccaacguugagccgcacuggauugcugccuccaucauccuugaauuuuuccugauggugcuccugauuccugagcccgauagacagcggaccccucaggacaaucaacuggccuauguggucaucgggcuccuuuuuaugauucugacaguggcugcgaacgagaugggacugcucgaaacgaccaaaaaggaucugggcaucgggcauguugccgcugagaaccagcagcacgccacaaugcuugacguggaucugcgccccgccagcgcuuggacccucuacgccgucgcgacaaccgugauuacgccuaugaugagacacaccaucgaaaauacaaccgccaacauuucucugacagcuaucgccaaucaagcugccauccugaugggacucgacaaaggcuggcccauuuccaagauggauaucggcgucccgcuucuggcgcuggggugcuacagccaggugaacccucucacccugacggccgcuguucuuaugcugguggcccauuaugcuauuaucggacccggccuccaggccaaagcuacacgggaggcccagaagcgcaccgcggccgggauuaugaagaaucccacagucgacggaaucguggcuaucgaccuggauccuguuguguacgacgccaaauucgaaaagcaacugggccagauuaugcuccuuauccuguguaccucucagauucugcucaugagaaccacaugggcucugugcgaguccaucacgcuugccaccgggccgcugacaacccucugggagggaagccccggcaaauuuuggaacacaaccauugccgucucuauggcgaauaucuuccggggcagcuaucuggcuggggccggacuggcuuucucccucaugaagucucuuggcgggggacgcagaggcacgggggcccagggagaaacacugggcgagaaauggaagcggcaacugaaccagcucagcaaguccgaauuuaauaccuacaaaagaagcggcaucauggagguggaucgcuccgaagccaaggaggggcugaaacggggagagaccacaaagcacgcugugucuagaggcaccgccaaacuucgcugguucguugaacggaaccuggucaagccugaggggaaggugauugaccucggauguggcagagggggauggagcuauuacugcgcgggccugaaaaaggugacagaagucaaaggcuauacgaaagggggacccggccaugaggaaccuauccccauggccaccuacggguggaaucugguuaaacucuacuccggaaaggauguguuuuucacaccuccggagaaaugugacacccuucugugcgauauuggcgagucuagccccaacccuacaaucgaagaggggcgcacccugcgggugcucaagauggucgaacccuggcugagaggaaaucaguuuuguauuaagauccuuaacccuuauaugcccuccgugguugagacgcuggagcagaugcaacgcaaacacggcggcaugcucgugcggaauccgcugucuagaaacagcacccaugaaauguacugggucuccugcgggacaggaaauauugugagcgcuguuaacaugaccucucgcaugcugcucaaccgguucacaauggcccacagaaagccuaccuaugagcgcgacguggaucugggcgcugggacaagacacgucgccguggaacccgagguggcgaaucuugacaucaucggacagcggauugaaaacaucaaaaaugagcauaaguccaccuggcacuacgaugaggacaaccccuauaaaacgugggccuaccauggcagcuaugaagucaagccuucuggguccgcuagcucuaugguuaauggaguggugcgccugcucacaaagcccugggacgucauuccuauggugacccagaucgccaugaccgauacaacgccguuuggccaacagagaguuuucaaagagaagguggacacccggacacccagagcuaaacggggcaccgcccagauuauggaagucacagcuaaguggcuguggggguuucuuucccgcaacaaaaagccuagaaucuguacccgggaggaguucacacgcaaggugagaagcaaugccgcgaucggagccguuuuuguggaugagaaccaguggaacuccgcuaaagaggccgucgaagacgagcgguucugggaucuggugcaccgcgaaagagagcuccacaagcaaggcaaaugcgcuaccugcguuuacaacaugauggggaagcgggagaaaaagcugggagaguuuggcaaggccaaagggagccgcgccauuugguacauguggcugggcgcgagauuccucgaguucgaagcucugggauuuaugaaugaggaccauugguucucucgggaaaacagcuuuuccggcguggagggggagggacuucacaagcugggcuauauccuccgcgauauuucuaaaauccccgggggaaauauguacgccgacgauacggccggcugggacaccagaauuacagaagaugaccugcagaacgaggcuaagaucaccgauaucauggaaccugagcaugcccuucuggcuacaagcauuuucaaacucaccuaucagaauaaggucgugcggguccagcgccccgccaaaaacgggacggugauggacguuaucuccagacgggaccaaagaggcucuggacaggugggcacauacgggcugaacaccuuuacaaauauggaaguccagcugauucgccagauggagagcgagggaaucuuccucccguccgaacuggagaccccuaaccuugcggaacgggugcuggauuggcucgagaagcacggcacggaaagacugaagcgcauggccauuucuggggacgauugugugguuaaacccguggacgaucgguuugcuaccgcccuuaucgcucugaaugacaugggaaaggucagaaaagauaucccucaaugggagcccagcaagggcuggaacgacuggcaacaggugccuuucugcucccaucacuuucaccagcucauuaugaaagaugggcgcgagaucguugugcccugucggaaucaagacgaacuggucggcagagcccgcgugagccagggagcgggcuggucucugcgggagacagccugccucgggaaguccuaugcucagauguggcaacugauguacuuccauagacgcgaucuucggcuggccgcuaacgccauuuguagcgcugucccgguggacuggguuccuaccucuagaacaaccugguccauccacgcccaucaccaguggaugacaaccgaagacaugcucagcguguggaaucgggucuggauugaggaaaaccccuggauggaggauaagacgcacguguccucuugggaggaaguucccuaucugggaaaaagagaggaccaguggugcggcagccuuaucgggcugacagcgcgcgccaccugggcuaccaauauucagguggccaucaaccaaguccggagacucaucggaaaugaaaacuaccuggauuacaugacauccaugaagcgcuuuaaaaaugagagcgacccugagggcgcccugugguga

SEQ ID NO: 18764 - RNA, 9879 nt, Artificial Sequence
  derived and/or modified CDS sequence (opt5) from DENV-1__EU482591__SS-prME
agcgugacaaugcugcucaugcugcuucccacagcccuggcuuuccaccucacgacccggggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuuagacaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccgcccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagguguuugggaccgccuacggaguucuguucagcggcguguccuggacgaugaaaaucgggaucggcauucuucugaccuggcucggacugaauagccgcucuacaucccugagcaugaccuguaucgcugucggcauggugacacuuuaccucgggguuauggugcaggccgauucuggaugcgucauuaacuggaagggccgggagcugaaauguggguccggaaucuuugugaccaacgaaguucacacauggaccgagcaauauaaguuccaggcugacagcccuaagagacuguccgccgcgauuggcaaagccugggaggaaggggugugcggcauccgcucugcuacgcggcucgagaauauuauguggaagcagaucagcaacgaacugaaucauauccuucuggagaacgauaugaaauuuacagucguggugggagacgccaauggcauucucgcucaggggaagaaaaugaucagaccgcaacccauggaacacaaguacuccuggaaaucuuggggaaaggccaagauuaucggcgccgacauucagaacaccaccuucaucaucgaugggccugacacacccgaguguccugauggacagcgcgcuuggaauauuugggaggucgaagacuauggcuuuggcguuuucaccacgaacaucuggcugaaacugcgggauagcuacacacagaugugcgaccacagacuuauguccgcggccauuaaggauagcaaagcugugcaugccgacaugggguauuggaucgagucugaaaagaaugagaccuggaaacucgcccgcgcuuccuucauugaagugaagacauguaccuggcccaagagccacacacuguggucuaacggaguccuggaguccgagaugaucaucccgaaaauuuacggcgggccuaucagccaacauaauuaucggcccggauacuuuacccagacggccggcccuuggcaccucgggaagcuggaacuugauuucgaccugugcgagggaaccacagugguuguggaugaacacugcggcaacagaggccccucucuccggaccacaaccgucacggggaaaauuauccaugagugguguugccgcagcuguacacugccuccccugagauuucggggagaggacggcugcugguacgggauggaaauuagaccggugaaggagaaagaagagaaucuuguucgcuccauggugagcgcgggaucuggcgaagucgauuccuucagccucgggauccuguguguguccaucaugauugaggagguuaugcggucuagauggagccgcaagaugcugaugaccggaacacucgcuguguuucugcuucugaucaugggccagcucaccuggaacgaccugauuagacugugcaucauggucggcgccaaugccuccgaccggauggggaugggaaccacauaucuugcucugauggccacguucaagaugcgcccuauguuugcggugggccuccuguucagacggcucaccucucgcgaagugcugcuucugacaauugggcucagccuggucgcuuccguugagcugcccaacucucuugaagaacugggagauggccucgccauggggaucaugaugcugaaacuccugaccgaauuucaaccccaccagcuuuggacaacccugcucagccugacguucgugaagacaacccugucccuugacuacgccuggaaaaccacagcuauggcccugagcauugugucucucuuuccucugugucucuccaccacaagccagaagacgaccuggcugccgguccuucugggaucuuucggcugcaaaccccugacaauguuucucaucaccgagaacaagaucuggggcagaaaguccuggccucugaaugaggggauuauggcuaucggaauugugagcauccuucugucuucccuccugaaaaacgauguuccccucgccggcccucugauugccgggggaaugcuuaucgccuguuaugugaucagcggcuccagcgcugaccugucucuggaaaaggccgcugaggucagcugggaacaggaggccgaacauuccggggccucucacagcauucucguggagguucaagaugacggaacaaugaaaaucaaggaugaggaacgggacgauacccugacgauucuucugaaagcuacccuccuggcgguguccggcgucuaccccaugucuaucccugccacacucuucgugugguauuucuggcagaagaaaaagcagcgcagcggcguccugugggacacccccuccccgccugagguggaaagagcuguucuugauaaugggauuuaccggauccugcagcgcggacugcucggcagaucucaagugggggucggaguguuucaggacggcguuuuccauacaauguggcacgugaccagaggggcgguccugauguaucagggaaagcggcuugagcccagcugggccuccgugaaaaaggaucugaucagcuacggcggcggguggcgcuuucagggaucuuggaacacaggcgaggaagugcaaguuauugcugucgagccugggaaaaaucccaagaacgugcagacgaccccgggaacauucaaaaccccugaaggcgaggugggggccaucgcgcucgacuuuaagcccggaaccuccggcagcccuauugucaaucgggaaggcaagaucguggggcuguacggaaacggcguugugacaacgucugggaccuaugucuccgcuauugcccaggccaaagcuagccaagagggaccccuccccgagaucgaagacgagguguucaagaaaagaaaucugacaauuauggaucuucacccuggcuccgggaagacccgccgguaccugccggccaucguuagagaagcgaucaaacgcaagcugcggacacucauucuggcucccaccagaguggucgccucugagauggccgaagcucuuaagggcaugccuauccgcuaucagacgacagccgugaaaagcgagcauaccggacgggagauuguugaccugaugugccacgcuaccuuuacaaugagacuccugucccccgugcgggucccuaacuacaauaugaucauuauggaugaagcccauuucaccgaccccgcgagcaucgccgcucgcggcuauaucucuacaagaguggggaugggagaggccgcugccauuuuuaugaccgccacgccuccgggcuccguggaggcuuucccccagagcaacgcggucauccaggaugaggaacgggacauuccugagcgcucuuggaauagcggguacgauuggaucacagacuuucccggaaagaccguuugguucgugccuuccauuaaaucuggcaacgauaucgccaauugucugagaaagaacgggaaacgggugauccaacucagcagaaagacauucgacaccgaguaucagaagacgaaaaacaaugauugggacuacgucgugaccacagacauuuccgaaaugggcgcuaacuuucgcgccgaucggguuaucgaccccagacgcugccuuaagccggugauucugaaagauggaccugagcgggucauccuggccggccccaugcccgugaccguugcuucugccgcgcagagacgcgggcggauuggaagaaaucagaacaaggaaggcgaccaauacguguauauggggcagccucucaauaacgaugaggaccacgcucauuggacagaggccaaaaugcugcuugauaauaucaacacccccgaaggaauuaucccugcccuguucgagccggaacgcgaaaagagcgcugccaucgacggcgaauacagacucagaggggaagcgcgcaagacauuugucgagcugaugagacggggcgaucugcccguguggcucuccuauaaagucgccagcgaaggauuccaguacucugaccgcagauggugcuuugauggcgagcggaauaaccaggugcuugaagagaauauggacguugaaauuuggaccaaggagggggagcgcaagaagcugcgcccucgguggcuggaugcuagaacguauuccgacccccucgcccugcgcgaguucaaagaguuugcugccggacggagaagcguguccggcgaccuuauccuggaaauugggaagcucccucaacaccugacacugcgggcucagaacgcccucgauaaucuugugaugcugcacaacucugagcagggaggcaaagcguaccgccaugccauggaggaacugcccgacaccaucgagacccucaugcugcuugcucugauugccguccucacaggcgggguuacccuguucuuucugagcggaaagggccucgggaagacauccaucggacuucugugugugacggcuucuagcgcccugcucuggauggccuccguggaaccgcacuggaucgcugcgagcauuauccuggaguucuuucuuaugguccugcucauuccugaacccgauagacagcggaccccucaagacaaucagcuggccuaugugguuaucggccuccuguucaugauucuuacaguggcugccaacgagauggggcugcuggagaccaccaaaaaggaucucggaaucggcuacgucgccgcugaaaaccaucagcacgccaccaugcuggacguggaucuucaccccgcgucugccuggacgcuguacgcugucgccaccacagugaucaccccuaugaugcgccauacaauugagaauaccacggcuaacaucucccucacagccauugcgaaucaagccgcuauccugaugggccuggacaaaggguggcccauuagcaagauggauaucggaguuccgcuccuugcccugggcugcuauucucaggugaacccucugacccucacagcugccguccugaugcuuguggcucacuacgccauuaucgggcccggacugcaggcgaaagccaccagagaagcucagaagcggaccgccgcuggcaucaugaagaaucccacaguugacgggauuguggccaucgaucucgacccugucguguaugaugccaaauuugagaagcaacugggacagauuaugcugcucauccuuuguacgucccagauucugcugaugcgcaccacaugggcgcucugcgaaagcaucacccuggcuacaggcccgcuuaccacgcugugggagggcucucccgggaaauucuggaacacaaccaucgccgugagcauggcuaauauuuucagaggauccuaccucgccggcgccgggcuggcuuuuucucugaugaaaagccucggaggcgggcggcgcggaaccggcgcccagggcgagacacuuggggaaaaauggaagagacaacugaaccagcuguccaagagcgaguucaauaccuauaaacgguccggaaucauggaaguugacagaucugaggcgaaggaaggccucaaacgcggggagacaacgaagcaugccgucagccggggaaccgcuaaacugagaugguuuguggagcgcaaccuugugaagccugaaggcaaggucauugaccugggguguggacggggcggcugguccuacuauugcgccgggcucaaaaagguuacagaggugaaaggauacaccaagggcgggcccggacacgaggaaccuauccccauggcuacauacggcuggaaucuggugaaacugcauucugggaaggaugucuucuuuaugccuccggaaaaaugugacacccuccuuugcgauauuggagagagcucccccaacccuacgaucgaggaaggcagaacccugcgcgugcugaagaugguugagcccuggcuccggggcaaucaguucuguaucaagauucugaacccuuauaugcccucuguggucgaaacacuugagagaaugcagcgcaaacacgggggaaugcuggugcggaauccgcucagcagaaacuccacccacgagauguacuggguuagcugcggcacagggaauaucgugucugccgucaacaugaccucccgcaugcugcugaaccgguuuacaauggcgcauagaaagccuaccuaugaacgcgacguggaucucggagccggcacgagacacguggcugucgagcccgaaguugccaaucuggacauuaucgggcaacggauugagaacaucaaaaaugaacauaagagcacauggcacuacgaugaggacaaccccuauaaaaccugggcuuaccacggaucuuaugaggugaagccuuccggcagcgccucuuccauggugaauggcgucgugcgccuucugaccaagcccugggauguuauuccuauggugacacagaucgcuaugacggacaccacaccguucgggcagcaaagagucuuuaaagaaaagguggauacccggacacccagagccaaacggggaaccacacagaucauggagguuaccgcgaaguggcucuggggcuuccugagccgcaacaaaaagccuagaauuuguacgcgggaagaguuuacccgcaaggugagauccaaugccgcuaucggggccgucuucguggacgaaaaccaguggaauagcgcuaaagaggccguugaggacgaacgguuuugggaucuugugcaucgcgagagagaacugcacaagcagggaaaaugcgccacaugcgucuacaacaugaugggcaagcgggagaaaaagcucggggaguucggcaaggcgaaaggaucucgcgcuauuugguacauguggcugggcgccagauuccuggaguuugaggcccucggguucaugaaugaagaccauugguuuagccgggagaacucccugucuggaguggaaggcgaggggcuucacaagcugggauauauccuccgcgauauuagcaaaauccccggcgggaauauguacgcugacgauaccgccggcugggacacaagaaucaccgaggaugaccugcaaaacgaagcuaagauuacggauaucauggagccugaacaugcccuucuggcgacauccauuuucaaacucaccuaucagaauaaggucgugcggguucagcgccccgccaaaaacggaacagugauggacgucaucucuagacgggaucagagaggcagcgggcaagugggaaccuacggccugaacacguuuaccaauauggaggugcagcugauucgccagauggaauccgaggggaucuuccucccgucugagcuggaaacaccuaaccuugcugagcgggcccuggacuggcucgaaaagcacggagcugagagacugaagcgcauggccaucagcggcgaugacuguguugugaaacccauugacgaucgguuugcgaccgcccuuacagcucugaaugacauggggaaggucagaaaagauaucccucagugggaacccuccaagggcuggaacgacuggcaacaggugccuuucugcagccaccauuuucaccagcucauuaugaaagauggacgcgagaucguugugcccugucggaaucaggacgagcuggucggcagagcccgcgugucucaaggggcuggauggucccugcgggaaaccgccugccucggcaagagcuaugcucagauguggcagcugauguacuuccauagacgcgaucuucggcuggccgcgaacgccauuuguucugcugucccgguggacuggguuccuacauccagaaccacguggagcauccacgcccaccaucaauggaugacaaccgaggauaugcucuccguguggaaucgggucuggaucgaagagaaccccuggauggaagacaagacccacgugucuagcugggaggagguucccuaucuggggaaaagagaagaucaguggugcggaucccuuauuggccugacagcccgcgcuaccugggccacaaauauccagguggcgauuaaccagguccggagacucaucgggaaugagaacuaccuggacuacaugacgagcaugaagcgcuuuaaaaaugaaucugacuccgagggcgcucugugguga

SEQ ID NO: 18765 - RNA, 9879 nt, Artificial Sequence
  derived and/or modified CDS sequence (opt5) from DENV-1__EU482592__SS-prME
agcgugaccaugcugcuuaugcugcuucccaccgcucuggcuuuccaccucacgaccagaggcggggagccucauaugaucgucuccaagcaggaacggggaaagucucugcuuuuuaagaccagcgccggcauuaacaugugcacccugaucgcgauggaccucggggagcugugugaagauacaaugaccuacaaaugcccccgcauuacagaggcugaacccgacgauguugacuguuggugcaaugccaccgauacgugggugaccuauggaacauguucccagaccggcgagcacagacgggacaagcgcucuguggcccuggcuccucaugucgggcucggacuggagacaagaaccgaaacguggaugagcuccgagggcgccuggaaacagauccagaagguggaaacaugggcccuucggcaccccggcuucaccguuacagcccuguuucucgcgcaugccauugggaccucuaucacccagaagggaaucauuuucauccugcuuaugcuggugacaccuagcauggcuaugcgcugcgucggcauugggaacagagauuuuguggagggacucuccggcgccacguggguugacgugguccuggagcacgggagcugugugaccacaauggcuaaagauaagcccacccuggacaucgaacuccugaaaacagaggugaccaauccugccguccuucggaagcugugcauugaagcgaaaaucucuaacacgacaaccgauucccgcuguccgacccagggagaggccacacucguugaagaacaggacagcaauuucgugugcagacggaccuuuguggaucgcggcuggggcaacggguguggacuguucggcaaggggucucuucugacaugcgcuaaguuuaaaugcgucacgaagcucgagggaaaaauugugcaguacgaaaaucugaaguauuccguuaucgugaccguccacacaggcgaccagcaucaaguggggaacgagaccacagaacacggaaccaucgccacgauuacaccccaggcuccuacaagcgagauccagcugaccgacuacggcgcccucacacuggauuguucucccagaaccggccuugacuucaaugaaaugguucugcucacgaugaaagagaaguccuggcuggugcauaaacagugguuucuugaucugccucuccccuggacaagcggggccuccaccucucaagagacauggaaccggcaggaccugcuggucaccuucaagaccgcucacgcgaagaaacaggaaguggucgugcucggaagccaagagggcgccaugcacacagcucugacgggggccaccgaaauucagacauccggaaccacaaccaucuuugccggccaucuuaagugccgccugaaaauggauaagcucacgcugaaagggaugagcuauguuauguguacaggcucuuucaagcuggagaaggaaguggcugagacccagcacggaaccguccuugugcagguuaaauacgagggcacagacgccccgugcaagauuccuuucuccgcgcaagaugaaaaaggggugacccagaauggaagacucaucacagcuaaccccaucgucacggacaaggagaaaccugugaauauugaaaccgagccgcccuuuggcgagagcuauaucgugguuggggccggagaaaaggcccugaagcugucuugguucaaaaagggcagcuccauugggaaaauguuugaggcuacagcccggggcgcuagacgcauggccauccucggagauaccgcgugggacuucggcucuauugggggagucuuuacaagcgugggcaagcuggugcaucaggucuucggggccgcuuacggagugcucuuuuccggcguuagcuggaccaugaaaaucgggaucggcauucugcucacguggcugggacugaacucucgguccaccagccuuucuaugacauguaucgccgugggcauggucacccucuaccugggggugaugguucaggcugauuccggaugcgugauuaauuggaagggcagagaacugaagugugggagcggaaucuucgucacaaacgaggugcacaccuggacagaacaauauaaauuucaggccgacuccccuaagcgccucucugcggccauuggcaaggcuugggaggaggggguuugcggcauccggagcgccaccagacuggaaaacauuauguggaagcagaucuccaaugagcuuaaccauauccugcucgaaaaugacaugaaauucacgguggucgugggagaugcuaacggcauucuggcccaggggaagaaaaugauccgcccgcaacccauggagcaccgguacucuuggaaaagcuggggaaaggccaagauuaucggcgcugacauucaaaauuccacauuuaucaucgaugggccugacacccccgaauguccugaugaccagagagcguggaacauuugggagguggaggauuauggauucggcaucuuuaccacaaauauuuggcugaaacuucgcgacagcuacacccagaugugcgaucaccggcucaugucugccgcuaucaaagacuccaaggccguccaugccgauaugggcuauuggauugaaagcgagaaaaacgaaacguggaagcuggcuagagccucuuucaucgagguuaagacauguaucuggcccaaaucccacacccuguggagcaauggggugcucgaaucugagaugauuaucccgaagauuuacggaggcccuaucagccaacauaacuaucgccccggguacuucacacagaccgcgggaccuuggcaccugggcaaacuugagcuggacuuugaucucugcgaagggacaaccguggucguggacgagcacugcggaaaucggggccccucccugagaacgaccacaguuaccggcaagauuauccaugaaugguguugccggagcuguacacugccuccccuucgcuucagaggggaggacggaugcugguacggcauggagauccggccggugaaagaaaaggaggaaaaccucgucagaucuaugguguccgcugggagcggagagguugauuccuuuucucugggcauucugugugugagcaucaugauugaagaggucaugcgcucccgguggucuagaaagaugcucaugaccgggacgcuggccguguuccuucugcucaucaugggacagcugacauggaaugaccugauucgccuuugcaucaugguuggcgccaacgcuagcgauagaaugggcauggggaccacauaucuggcccucauggcgaccuuuaaaaugcggccuauguucgcugugggacugcucuuucgcagacugaccucccgggagguccuucugcucacaauuggccugucucugguggccagcguggaacuucccaauucccuggaggaacucggggacggacuggccaugggcaucaugaugcucaagcugcuuacggaguuccaaccccaccagcuguggaccacacuccugagccugaccuuuaucaaaacaacccuuucucuggauuacgcuuggcgcacgauggccaugguccucuccauuguuagccuguucccucucugucugucuacaaccucccagaagaccacauggcuuccggugcugcuggggagcuuuggaugcaaaccccucaccauguuccugaucacagaaaacaagauuuggggcagaaagucuuggccucuuaacgagggcaucauggcuauugggaucguguccauccugcucagcucccugcucaaaaaugacgucccccuggccggaccucuuauugcgggcgggaugcugaucgccuguuaugugauuagcggaucuagcgcugaucugucccucgagaaggccgcugaaguuucuugggaggaagaggccgaacauagcggcacgucccacaacauccugguggagguccaggacgaugggaccaugaaaauuaaggacgaggaacgggaugacacacuuaccauccugcucaaagccacacugcucgcugugucuggaguuuaccccaugagcaucccugcgacccuguuugugugguauuucuggcaaaagaaaaagcagcgcuccggcguccuuugggauacgcccucuccgccugagguggaaagagccguccuggacgacggcauuuaccggauccugcagcgcgggcuccugggaagaagccaggugggcguugggguguuccaagauggagucuuucauaccauguggcacgugacacggggcgcuguucuuauguaucaggggaagagacuggagcccuccugggccagcgugaaaaaggaccucauuucuuacggaggcggcuggcgcuuccagggguccuggaauaccggagaggaaguccaggugaucgccguggagccuggcaaaaaccccaagaauguucaaacaaccccggggacauuuaaaacgccugaaggagaggucggcgcuauugcccuggauuucaagcccgggaccagcggaucuccuaucgugaaccgggaaggcaagauugugggccucuacgggaauggagucgugacaaccuccggcaccuauguuagcgcgaucgcucaggccaaaacaucccaggaggggccccugcccgagaucgaagaggaaguguuuaagaaaagaaaccuuacgauuauggaccugcacccuggaucuggcaagacccgccgguaccugccggccaucgucagagaggcuauuaaacgcaagcuccggacacugauccuugcccccaccagagugguugcgagcgaaauggcugaggcccugaaggggaugccuauucgcuaucaaacaaccgccgugaaauccgagcauacgggccgggaaaucgucgaucucaugugccacgcuacauucaccaugagacugcugagccccgugcggguuccuaauuacaacaugaucauuauggacgaggcccauuuuaccgaucccgcuucuaucgccgcgcgcggauauauuuccacaagagugggcaugggggaagccgcugccaucuucaugaccgcuacaccuccgggaagcgucgaggccuuuccccagucuaaugccgugauucaggacgaagaacgggauaucccugagcgcagcuggaacuccggcuacgacuggaucaccgauuuccccgggaagacggugugguuugucccuucuauuaaaagcggaaaugacaucgcuaacugucucagaaagaauggcaaacggguuauucagcuuuccagaaagacauucgacaccgaauaucaaaagacacgcaacaacgauugggacuacguggugaccacggauaucucugagaugggggcgaauuuccgggccgacagagucauugauccccgccggugccugaaaccggugauccugaaggacggcccugaaagaguuauucucgcuggacccaugcccgugaccgucgccagcgccgcucagcgccggggcagaaucgggcgcaaccagaauaaagagggagaucaguacguguauaugggccaaccucugaacaaugacgaggaucacgcccauuggacagaagcgaagaugcuucuggacaacaucaauacccccgaggggauuaucccugcucucuuugaaccggagagagaaaaauccgccgccauugauggagaguaccggcugcgcggcgaggcuagaaagacauucguugaacugaugcggcgcggggaccuccccguguggcuuagcuauaaggucgccucugagggcuuucaguacuccgauagacgguggugcuucgacggagaaagaaacaaucaggugcuggaggaaaacauggacgucgagaucuggaccaaagagggcgaacgcaagaaacugcggccuagauggcucgaugcgcgcacauauagcgacccccuggcccuucgggaguuuaaggaguucgcugccgggagacgguccgugucuggagaucugauucucgagaucggcaaacugccucagcaccugacccuccgcgcucaaaaugcccuugacaaccugguuaugcugcacaauagcgaacaagggggaaaggcuuacagacaugccauggaggagcuccccgauacgaucgaaacacugaugcuucuggcgcucauugccgugcugaccggcggcgugacccuguuuuuccucuccgggaaaggacuuggcaagacaucuaucgggcugcugugugucauggcuagcuccgcccuccuguggauggcuaacguugagccgcacuggauugccgccagcaucauucuugaauuuuuccugauggugcuccugaucccugagcccgaccggcagcgcaccccucaggauaaucaacuggcuuauguggucaucggacuccuuuuuaugauucugacaguggcggccaacgagaugggccugcucgaaacgaccaagaaagaccuggggaucggauacguugcugccgagaaccagcaucacgccacaaugcuugauguggaccugagacccgcuucugccuggacccucuacgcggucgccacaaccgugauuacgccuaugaugcggcacaccaucgaaaauacaaccgcuaacauuucccugacagccaucgcuaaucaggccgcgauucugaugggccucgauaagggcuggcccaucagcaaaauggacaucggggucccgcuucuggcccugggaugcuauucucaagugaacccucucacccugacggcugccguucuuaugcugguggcucauuacgccauuaucggccccgggcuccaggcuaaggccacacgcgaggcgcagaaaagaaccgccgcuggaauuaugaagaaucccacagucgauggcaucguggccauugaccuggacccuguuguguaugaugcuaaguucgaaaaacagcuggggcaaaucaugcuccuuauccuguguaccucccagauucugcucaugcggaccacaugggcccugugcgagagcaucacgcuugccaccggaccgcugacaacccucugggagggcucucccggcaaguuuuggaacacaaccauugcggucagcauggcuaauaucuuccgcggguccuaccuggccggagcuggccuggccuucucucucaugaaaagccuugggggaggcagacgggggacgggagcccagggcgaaacacugggcgagaaguggaaaagacagcugaaccaacucuccaagagcgaauuuaauaccuauaagcgcuccgggauuauggagguggaccggucugaagcuaaagagggacugaagagaggcgagaccacaaaacacgccgugagccgcgggaccgcgaaacuucggugguucguugaaagaaaccuggucaaaccugagggaaaggugaucgaucucggcugugggcgcggaggcugguccuacuauugcgccggccugaagaaagugacagaagucaagggguacacgaaaggaggccccgggcaugaggaaccuauccccauggcuaccuacggauggaaucugguuaagcucuauucuggcaaagacguguuuuucacaccuccggagaagugugauacccuucugugcgacauuggggagagcucccccaacccuacaaucgaagagggacggacccugagagugcucaaaauggucgaacccuggcugcgcggcaaucaguuuuguauuaagauccuuaacccuuacaugcccucugugguugagacgcuggagcagaugcagcggaagcacggcgggaugcucgugagaaauccgcugagccgcaacuccacccaugaaauguauugggucagcugcggaacaggcaauauugugucugccguuaacaugaccucccggaugcugcucaacagauucacaaugacccaccgcaaaccuacauacgagagagauguggaccugggggcuggaacccggcacgucgccguggaacccgagguggcgaaucuugauaucauuggccaacgcaucgaaaacaucaagaaugagcauaaaagcacgugguauuacgacgaggauaaccccuauaagacaugggccuaccacgggucuuacgaagucaaaccuuccggaagcgcuucuuccaugguuaauggcguggugagacugcucaccaagcccugggacgucauuccuauggugacccagaucgccaugacagacacgaccccguuuggccagcaacggguuuucaaggagaaaguggauacaagaacaccccgggcuaagcgcgggacagcccagauuauggaagucaccgcuaaauggcuguggggauuucuuagcagaaacaagaaaccucggaucuguacacgcgaggaguucaccagaaaggugcgguccaaugccgcgauuggcgccguuuuuguggacgagaaccaguggaauagcgcuaaggaggccgucgaagaugagcgcuucugggaccuggugcauagagaacgggagcuccacaaacaggggaagugcgcuacgugcguuuauaacaugaugggaaaacgcgaaaagaaacugggcgaguuugggaaggccaagggcucuagagccaucugguacauguggcugggagcgcgguuccucgaguucgaagcucugggcuuuaugaaugaggaucacugguucagccgcgaaaacuccuuuucugggguggagggagagggccuucauaaacugggguauauccucagagacauuagcaagauccccggaggcaauauguacgccgaugacaccgccgggugggauacacggauuaccgaagacgaucugcaaaacgaggcuaaaaucacagacauuauggaaccugagcacgcccuucuggcuaccuccaucuucaagcucacguaucagaauaaagucgugcgcguccagagacccgccaagaacggcacagugauggauguuaucucucggagagaccagcgcggaagcggccaaguggggaccuacggacugaacacauuuaccaauauggaaguccagcugauucggcagauggaguccgagggcaucuuccucccgucugaacuggagacgccuaaccuugcggaaagagugcugaauuggcucgagaaacaugggaccgaacgccugaagcggauggccauuagcggagacgauugugugguuaagcccguggacgauagauuugcuacagcccuuaucgcucugaacgacaugggcaaaguccgcaaggauauuccucagugggagcccuccaaaggguggaaugacuggcaacaggugccuuucugcagccaccauuuucaccagcucaucaugaaggauggccgggagaucguugugcccuguagaaaccaggacgaacuggucggacgcgcccgggugucucaaggcgcgggguggucccugagagagaccgccugccucggaaaaagcuaugcucagauguggcagcugauguacuuccaccgccgggaucuuagacuggccgcuaaugccauuuguucugcugucccgguggacuggguuccuacaucccggaccacauggagcauccaugcccaccaucaauggaugaccacggaagauaugcucuccguguggaacagagucuggauugaggaaaaucccuggauggaggacaagacacacgugucuagcugggaggaaguucccuaccugggcaagcgcgaggaccaguggugcgggucccuuaucggacugaccgcgcgggccaccugggcuacaaacauucagguggccaucaaucaggucagacgccucauuggcaacgaaaauuaucuggauuacaugaccagcaugaaaagauuuaagaacgagucugacccugagggggcccugugguga

SEQ ID NO: 18766 - RNA, 9879 nt, Artificial Sequence
  derived and/or modified CDS sequence (opt5) from DENV-1__EU482609__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccccccuuuggcgaguccuauaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaucagguguucgggaccgccuacggaguucuuuuuagcggcguguccuggacgaugaagaucgggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuucgugaccaacgagguucacacauggaccgaacaauauaaguuucaggcugauagcccuaaacggcucuccgccgcgauuggcaaggccugggaggagggggugugcggcaucagaucugcuacgcgccuggaaaauauuauguggaaacagaucagcaacgagcuuaaucauauccugcucgaaaacgacaugaaguucacagucguggugggagacgccaauggcauucuggcucaggggaaaaagaugauccggccgcaacccauggagcacaaauacuccuggaagucuuggggaaaggccaaaauuaucggcgccgauauucagaacaccaccuuuaucaucgacgggccugauacacccgaauguccugacggacagagagcuuggaauauuugggaggucgaggauuauggcuucggcaucuuuaccacgaacauuuggcugaagcuucgcgacagcuacacacagaugugcgaucaccggcucauguccgcggccaucaaagacagcaaggcuguucaugccgauaugggguauuggauugaaucugagaaaaaugaaaccuggaagcuggccagagcuuccuucaucgaggugaagacauguaccuggcccaaaagccacacacuguggucuaacggagugcucgaauccgagaugaucauuccgaagaucuacggcgggccuauuagccaacauaauuaucgccccggauacuucacccagacggccggcccuuggcaccuggggaaacuugagcuggacuuugaucucugcgaaggaaccacagucgugguugacgagcacugcggcaaccggggccccucucugagaaccacaaccgugacggggaagaucauucaugaaugguguugccggagcuguacacugccuccccuucgcuucagaggagaggauggcugcugguacgggauggagauccggccggucaaagaaaaggaggaaaaucucgugagauccaugguuagcgcgggaucuggcgagguggacuccuuuagccuggggauccugugugucuccauuaugaucgaagaggugaugcgcucucgguggagcagaaagaugcucaugaccggaacacuggcuguuuuccuucugcucauuaugggccagcugaccuggaacgaccugauccgccuuugcauuauggugggcgccaaugccuccgauagaauggggaugggaaccacauaucuggcucucauggccacguuuaaaaugcggccuauguucgcggucggccugcucuuucgcagacugaccucucgggaggugcuucugcucacaaucgggcugagccugguggcuuccgucgaacuucccaacucucuggaggaacucggagacggccuggccauggggauuaugaugcucaagcugcuuaccgaguuccaaccccaccagcuguggacaacccuccugagccugacguuuguuaaaacaacccuuucccuggauuacgccuggaagaccacagcuauggugcucagcaucgugucucuguucccucucugucuguccaccacaagccagaaaacgaccuggcuuccgguccugcugggaucuuuuggcugcaagccccucacaauguuccugaucaccgaaaacaagauuuggggccgcaaauccuggccucuuaaugaggggaucauggccauuggaaucgugagcauucugcucucuucccugcucaagaacgacguuccccuggcuggcccucuuaucgccgggggaaugcugaucgcguguuaugugauuagcggcuccagcgccgaucugucucucgagaaagcugccgaagucagcugggagcaggaagcugagcauuccggggccucucacaauauccugguggaaguucaagacgauggaacaaugaagauuaaagacgaggagagagaugacacccuuacgauccugcucaaggccacccugcucgcugugagcggcgucuaccccauguccauuccugcgacacuguuugugugguauuucuggcagaaaaagaagcagcggucuggcguccuuugggauacccccagcccgccugaaguggagcgcgccguucuggacgaugggaucuacagaauccugcagcggggacuccugggccgcucccaagugggggucggaguguuccaggacggcguuuuucauacaauguggcacgugaccagaggggcuguccuuauguaucagggaaaacggcuggaacccucuugggccagcgugaagaaagaccucauuuccuacggcggcggguggagauuccagggaagcuggaacacaggcgaggaggugcaaguuaucgccgucgaaccugggaagaaucccaaaaacgugcagacgaccccgggaacauuuaagaccccugagggcgaagugggggcuauugcccuggauuucaagcccggaaccucuggcuccccuaucgucaaucgcgagggcaaaauuguggggcucuacggaaacggcguugugacaacgagcgggaccuaugucucugcgaucgcucaggcccgggccucccaagaaggaccccugcccgagauugaggacgaaguguuuaagaaaagaaaucuuacaaucauggaucugcacccuggcagcgggaagacccgccgguaccugccggcuaucguuagagaggccauuaaacgcaagcuccggacacugauccuugcgcccaccagaguggucgcuuccgaaauggccgaggcccugaagggcaugccuauucgcuaucagacgacagcugugaaaucugaacauaccggacgggagaucguugaccucaugugccacgccaccuucacaaugagacugcugagccccgugcgggucccuaacuacaauaugauuaucauggaugaggcucauuuuaccgaccccgccuccaucgcggcccgcggcuauauuagcacaagaguggggaugggagaagcugccgcuaucuucaugaccgccacgccuccgggcucuguggaggccuuuccccaguccaacgcugucauucaggaugaagagcgggacaucccugaacgcagcuggaauucuggguacgauuggauuacagacuuccccggaaagaccguuugguuugugccuagcaucaaauccggcaacgauaucgcgaauugucucagaaagaacgggaaacgggugauucaacuuucuagaaagacauucgacaccgaguaucagaagacgaaaaacaaugacugggauuacgucgugaccacagacaucagcgagaugggcgccaacuuccgcgcugaucggguuauugaccccagacgcugccugaagccggugauccugaaagauggaccugaacgggucauucucgccggccccaugcccgugaccguugccuccgcugcccagagacgcgggcggaucggaagaaaucagaacaaggagggcgaccaauacguguauauggggcagccucugaauaacgaugaagaccacgcgcauuggacagaggcuaaaaugcuucuggauaauauuaacacccccgagggaaucaucccugcccucuuugaaccggagcgcgaaaagucugccgcuauugacggcgaguacagacugcggggggaagcccgcaagacauucgucgagcugaugagacggggcgaucuccccguguggcuuagcuauaaagucgcguccgagggauuucaguacagcgaccgcagauggugcuucgauggcgaacggaauaaccaggugcuggaggaaaauauggacguugagaucuggaccaaggaaggggagagaaaaaagcugcgcccucgguggcucgacgccagaacguauucugauccccuggcucuucgcgaguuuaaagaauucgccgcuggacggagauccgugagcggcgaccugauucucgagaucgggaagcugccucaacaccugacacuccgggcccagaacgcucuugauaaucuggugaugcugcacaacuccgaacagggaggcaaagccuaccgccaugcgauggaggaacuccccgacaccauugagacccugaugcuucuggcccucaucgcuguccugacaggcgggguuacccuguuuuuccucucuggaaagggccuugggaagacaagcaucggacugcugugugugacggccuccucugcucuccuguggauggccagcguggagccgcacuggauugccgcuuccaucauucuugaauuuuuccugaugguccuccugaucccugagcccgauagacagcggaccccucaagacaaucagcuggcguaugugguuauuggccuccuuuuuaugauccugacaguggccgcuaacgaaauggggcugcucgagaccacaaaaaaggaucugggaaucggcuacgucgccgccgagaaccaucagcacgcuaccaugcuugacguggaucugcgccccgccagcgcguggacgcucuacgccgucgcuaccacagugauuaccccuaugaugagacacacaaucgaaaauaccacggccaacauuucucugacagcuaucgccaaucaagcggccauucugaugggccucgacaaaggguggcccaucuccaagauggauauuggaguuccgcuucuggcucugggcugcuauagccaggugaacccucucacccugacagccgcuguccuuaugcugguggcccauuacgcuaucaucgggcccggacuccaggccaaagcgacccgggaggcccagaagcgcaccgcugccggcauuaugaagaaucccacaguugacgggaucguggcuauugaucuggacccugucguguaugacgccaaauucgaaaagcaacugggacagaucaugcuccuuauucuguguacgucucagauccugcucaugagaaccacaugggcccugugcgaguccaucacccuugcgacaggcccgcugaccacgcucugggaaggcagccccgggaaauuuuggaacacaaccauugcugugucuauggccaauaucuuccggggaagcuaccuggcuggcgccgggcuggccuucucccucaugaagucucuuggaggcgggcgcagaggaaccggcgcucagggcgagacacugggggagaaauggaagcggcaacugaaccagcucagcaaguccgaauuuaauaccuauaaaagaagcggaauuauggagguugaucgcuccgaagccaaggagggccugaaacggggggaaacaacgaagcacgcggucucuagaggaaccgccaaacuucgcugguucguggagcggaaccuggugaagccugagggcaaggucaucgaccucggguguggaagaggcggcuggagcuacuauugcgcugggcugaaaaagguuacagaagugaaaggauacaccaagggcgggcccggacaugaggaaccuauucccauggccacauacggcuggaaucuggugaaacuccacuccgggaaggaugucuuuuucaugccuccggagaaaugugacacccuucugugcgauaucggagaaucuagccccaacccuacgaucgaggagggccgcacccugcgggugcucaagaugguugaacccuggcugaagggcaaucaguuuuguauuaaaauccuuaacccuuauaugcccuccguggucgagacacuggaacagaugcaaagaaagcaugggggaaugcucgugcgcaauccgcugucucggaacagcacccacgagauguacuggguuuccugcggcacagggaauauugugagcgcugucaacaugaccucuagaaugcugcucaaccgcuucacaauggcccaccggaaaccuaccuaugagagagacguggaucugggagcgggcacgcgccauguggccgucgaacccgagguugcuaaucuugacaucauugggcagagaaucgaaaacauuaagaaugagcacaaauccacauggcauuacgaugaagacaaccccuauaagaccugggccuaccacggaagcuaugaggugaagccuucuggcuccgcuagcucuauggugaauggcgucgugcggcugcucaccaaacccugggauguuaucccuauggugacacagaucgccaugacggacaccacaccguuugggcaacagcgcgucuucaaggagaaaguggacaccagaacaccccgggcuaagagaggaaccacacagauuauggaaguuaccgcccgguggcuguggggcuuucuuucccgcaacaaaaagccuagaaucuguacgcgggaggaauucacccgcaaggugagaagcaaugcggccauuggggcugucuuuguggaugagaaccaguggaauuccgccaaagaagcuguugaggacgagcgguucugggaucuggugcaccgcgaaagagagcuccauaagcaaggaaaaugcgccacaugcgucuacaacaugaugggcaagcgggaaaaaaagcugggggaguuuggcaaggccaaaggaagccgcgcgaucugguacauguggcugggcgcuagauuccucgaauucgaggcccugggguuuaugaaugaggaccacugguucucucgggaaaacagccuuuccggaguggagggcgaagggcugcauaagcucggauauauucugcgcgauaucucuaaaauccccggcgggaauauguacgccgacgauaccgcuggcugggacacaagaauuaccgaggaugaccuucagaacgaggccaagaucacggauauuauggaaccugagcacgcucugcucgccacaagcaucuuuaaacugaccuaucagaauaaggucgugcggguucagcgccccgcgaaaaacggaacagugauggacgucauuuccagacgggaucaaagaggcucugggcaggugggaaccuacggccugaacacguucaccaauauggaagugcagcucauccgccagauggagagcgaagggaucuuuuccccgucugagcuggagacaccuaaccuugccgaacggguucuggacuggcucgagaagcauggagcugaaagacugaagcgcauggccauuagcggcgacgauuguguggucaaacccaucgacgaucgguucgcuaccgcccuuacagcgcugaaugacauggggaaggugagaaaagauauuccucaaugggagcccuccaagggcuggaacgacuggcagcagguuccuuuuugcagccaccacuuccaucagcucaucaugaaagauggacgcgaaauugugguccccugucggaaucaagacgagcuggugggcagagcccgcgucucucagggggcuggauggucccugcgggagaccgccugccucggcaagagcuaugcucagauguggcaacugauguacuuucacagacgcgaucuucggcuggccgcuaacgccaucuguucugcggugccgguugacugggugccuacauccagaaccacguggagcauccaugcccaccaccaguggaugacaaccgaagauaugcucuccgucuggaaucggguguggauugaggaaaaccccuggauggaggacaagacccauguuucuagcugggaagaggugcccuaucuggggaaaagagaggaccaguggugcggaucccuuaucggccugacagcucgcgccaccugggccacaaauauucaggucgcuaucaaccaagugcggagacucauugggaaugaaaacuaccuggauuacaugacgagcaugaagcgcuucaaaaaugagucugacccugaaggcgcccugugguga

SEQ ID NO: 18767 - RNA, 9879 nt, Artificial Sequence
  derived and/or modified CDS sequence (opt5) from DENV-1__EU482610__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggugcuucgccaccccggcuucaccgucaucgcuuuuuuccuggcccaugcgauugggacaucuaucacccagaagggaaucauuuuuauccuccugaugcuugugaccccuagcauggccaugagaugcguuggcauugggaaccgggacuucguggagggacuguccggcgcuacaugggucgauguggugcucgaacacgggagcugugucacgaccauggccaagaauaaacccacacuggacaucgagcugcucaagaccgaaguuacaaacccugcugugcugcgcaaacuuugcauugaggccaagaucucuaauaccacgacagauuccagauguccgacccaaggagaagcgacccugguggaggagcaggacgccaacuuugucugccggcgcacauucguggauagaggcuggggcaauggguguggacucuuuggcaaagggagccugcuuaccugcgcuaaguucaagugcguuacaaaacuggaaggaaagauugugcaguacgagaaccucaaauauucugucaucgugacgguucacaccggcgaccagcaucaaguggggaaugaaacaaccgagcacggaacaaucgccaccauuacgccccaggcuccuaccuccgaaauccagcugacagauuacggcgcccugacccucgacuguagcccccggacaggccuggacuuuaacgagaugguccuucugaccaugaaggagaaaucuuggcucgugcauaagcagugguuccuggaucuuccucugcccuggacguccggggccagcacaucccaagaaaccuggaaucgccaggaccuccuggucacauuuaaaaccgcucacgcgaagaagcaggaggugguugugcugggaucucaagaaggcgccaugcacaccgcucucacaggggccacggagauucagaccagcggaacaaccacaaucuucgccggccaucugaaaugcagacuuaagauggauaaacugacccucaaggggauguccuaugucauguguacgggcagcuucaaacuggaaaaggagguggcugagacacagcacggaaccguucuggugcaggucaaguacgaaggcaccgacgccccgugcaaaauuccuuuuucuacacaagaugagaagggggugacccagaacggacggcuuaucacagcgaaucccaucgugacggacaaagaaaagccuguuaacauugagaccgagccccccuucggcgaauccuauaucgucgugggggcuggagagaaagcccucaagcugagcugguuuaagagaggcucuagcauugggaaaauguucgaagccacagcucgcggcgcccggagaauggcuauccugggagauaccgccugggacuuuggcuccauugggggaguguucacaucugucggcaagcucgugcaucagguuuuugggaccgcguacggagugcuguucagcggcgucuccuggacgaugaaaaucgggaucggcauucuucugaccuggcucggacugaauagccgcucuacaucccugagcaugaccuguaucgccgugggcaugguuacacuuuaccucggggugaugguccaggcugauucuggaugcgugauuaacuggaagggccgggagcugaaauguggguccggaaucuuuguuaccaacgaagugcacacauggaccgagcaauauaaguuccaggccgacagcccuaagagacuguccgcugccauuggcaaagcgugggaggaaggggucugcggcauccgcucugccacgcggcucgagaauauuauguggaagcagaucagcaacgaacugaaucauauccuucuggagaacgauaugaaacucacagugguggucggagacgcuaauggcauucuggcccaggggaagaaaaugaucagaccgcaacccauggaacacaaguacuccuggaaaucuuggggaaaggcuaagauuaucggcgccgacauucagaacaccaccuuuaucaucgaugggccugacacacccgaguguccugauggacagcgcgccuggaauauuugggagguugaagacuauggcuucggcguguuuaccacgaacaucuggcugaaacuucgggauagcuacacacagaugugcgaccacagacucauguccgcugcgauuaaggauagcaaagccgugcaugcugacaugggguauuggaucgagucugaaaagaaugagaccuggaaacuggcccgcgccuccuucauugaagucaagacauguaccuggcccaagagccacacacuguggucuaacggagugcucgaguccgagaugaucaucccgaaaauuuacggcgggccuaucagccaacauaauuaucggcccggauacuucacccagacggcuggcccuuggcaccuggggaagcuugaacuggauuuugaccucugcgagggaaccacaguuguggucgaugaacacugcggcaacagaggccccucucugcggaccacaaccgugacggggaaaauuauccaugagugguguugccgcagcuguacacugccuccccuuagauuccggggagaggacggcugcugguacgggauggaaauuagaccgguuaaggagaaagaagagaaucucgugcgcuccauggucagcgccggaucuggcgaaguggauuccuuuagccuggggauccuguguguuuccaucaugauugaggaggugaugcggucuagauggagccgcaagaugcucaugaccggaacacuggcggucuuccuucugcucaucaugggccagcugaccuggaacgaccugauuagacuuugcaucauggugggcgcuaaugccuccgaccggauggggaugggaaccacauaucuggcccucauggcuacguuuaagaugcgcccuauguucgccgugggccugcucuuuagacggcugaccucucgcgaaguccuucugcucacaauugggcugagccugguugcguccguggagcuucccaacucucuggaagagcucggagauggccuggcuauggggaucaugaugcucaaacugcuuaccgaauuccaaccccaccagcuguggacaacccuccugagccugacguuugugaagacaacccuuucccuggacuacgccuggaaaaccacagccaugguccucagcauugugucucuguucccucucugucuguccaccacaagccagaagacgaccuggcuuccgguucugcugggaucuuuuggcugcaaaccccucacaauguuccugaucaccgagaacaagaucuggggcagaaaguccuggccucuuaaugaggggauuauggcuaucggaauugugagcauccugcucucuucccugcucaaaaacgaugucccccuggccggcccucuuauugcugggggaaugcugaucgccuguuaugugaucagcggcuccagcgcggaccugucucucgaaaaggccgcugagguuagcugggaacaggaggccgaacauuccggggcuucucacaauauucugguggagguccaagaugacggaacaaugaaaaucaaggaugaggaacgggacgauacccuuacgauucugcucaaagccacccugcucgccgugagcggcgucuaccccauguccaucccugcuacacuguuugugugguauuucuggcagaagaaaaagcagcgcucuggcguucuuugggacacccccagcccgccugagguggaaagagcgguccuggaugacgggauuuaccggauccugcagcgcggacuccugggcagaucccaaguggggguuggaguguuccaggauggcgucuuucauacaauguggcacgugacccggggggccgugcuuauguaucagggaaagagacuggagcccucuugggcuagcguuaaaaaggaccucaucuccuacggcggcggguggcgcuuccagggaagcuggaacacaggcgaggaaguccaagugauugccguggagccugggaaaaaucccaagaacguccagacgaccccgggaacauuuaaaaccccugaaggcgaggugggggccaucgcucuggacuucaagcccggaaccucuggcuccccuauuguuaaucgggaaggcaagaucguggggcucuacggaaacggcgucgugacaacgagcgggaccuauguuucugccauugcgcaggcuaaagccucccaagagggaccccugcccgagaucgaagaugagguguuuaagaaaagaaaucuuacaauuauggaccugcacccuggcagcgggaagacccgccgguaccugccggccaucgucagagaagcuaucaaacgcaagcuccggacacugauucuugcccccaccagagugguugcguccgagauggcugaagcccugaagggcaugccuauccgcuaucagacgacagccgugaaaucugagcauaccggacgggagauugucgaucucaugugccacgcuaccuucacaaugagacugcugagccccgugcgggugccuaacuacaauaugaucauuauggacgaagcccauuuuaccgaucccgcuuccaucgccgcgcgcggcuauaucagcacaagagucgggaugggagaggccgcugccauuuucaugaccgcuacgccuccgggcucuguugaagccuuuccccaguccaacgccgugauccaggacgaggaacgggauauuccugagcgcagcuggaauucuggguacgacuggaucacagauuuccccggaaagaccgugugguuugucccuagcauuaaauccggcaacgacaucgcuaauugucucagaaagaacgggaaacgggugauccaacuuucuagaaagacauucgauaccgaguaucagaagacgaaaaacaaugacugggacuacguugugaccacagauauuagcgaaaugggcgcgaacuuccgcgccgaccgggucaucgaucccagacgcugccugaagccggugauucugaaagacggaccugagcggguuauccucgcuggccccaugcccgugaccgucgccuccgccgcucagagacgcgggcggauuggaagaaaucagaacaaggaaggcgaucaauacguguauauggggcagccucugaauaacgacgaggaucacgcccauuggacagaggcgaaaaugcuucuggacaauaucaacacccccgaaggaauuaucccugcucucuuugagccggaacgcgagaagucugccgccaucgauggcgaauacagacugcggggggaggcucgcaagacauucgucgagcugaugagacggggcgaccuccccguguggcuuagcuauaaaguugccuccgaaggauuucaguacagcgaucgcagauggugcuucgacggcgagcggaauaaccaggugcuggaagagaauauggauguggaaauuuggaccaaggagggggagagaaaaaagcugcgcccucgguggcucgacgcgagaacguauucugacccccuggcccuucgcgaauuuaaagaguucgcugccggacggagauccgucagcggcgaucugauccucgaaauugggaagcugccucaacaccugacacuccgggcucagaacgcccuugacaaucugguuaugcugcacaacuccgagcagggaggcaaagcuuaccgccaugccauggaagagcuccccgauaccaucgagacccugaugcuucuggcgcucauugccgugcugacaggcggggugacccuguuuuuccucucuggaaagggccuugggaagacaagcaucggacugcugugugucacggcuuccucugcccuccuguggauggcuagcguggaaccgcacuggaucgccgccuccauuauccuugaguuuuuccugaugguucuccugauuccugaacccgacagacagcggaccccucaagauaaucagcuggcuuauguggucaucggccuccuuuuuaugauucugacaguggcggccaacgagauggggcugcucgagaccacaaaaaaggaccugggaaucggcuacgucgcugccgaaaaccaucagcacgccaccaugcuugauguggaccugcaccccgcuagcgccuggacgcucuacgcgguugccaccacagugaucaccccuaugaugcgccauacaauugagaauaccacggcuaacaucucucugacagccauugcuaaucaagccgcgauccugaugggccucgauaaaggguggcccauuuccaagauggacaucggagucccgcuucuggcccugggcugcuauagccaggugaacccucucacccugacagcugccguucuuaugcugguggcucacuacgccauuaucgggcccggacuccaggcuaaagccaccagagaagcgcagaagcggaccgccgcuggcaucaugaagaaucccacagucgaugggauuguggccaucgaccuggauccugugguuuaugacgcuaaauucgagaagcaacugggacagauuaugcuccuuauccuguguacgucucagauucugcucaugcgcaccacaugggcccugugcgaauccaucacccuugccacaggcccgcugaccacgcucugggagggcagccccgggaaauuuuggaacacaaccaucgcggucucuauggcuaauauuuucagaggaagcuaccuggccggcgcugggcuggccuucucccucaugaagucucuuggaggcgggcggcgcggaaccggcgcccagggcgagacacugggggaaaaauggaagagacaacugaaccagcucagcaaguccgaguuuaauaccuauaaacggagcggaaucauggaaguggacagauccgaggcuaaggaaggccugaaacgcggggagacaacgaagcaugccgugucucggggaaccgcgaaacuuagaugguucgucgagcgcaaccugguuaagccugaaggcaaggugauugaucucggguguggacggggcggcuggagcuacuauugcgccgggcugaaaaaggugacagaggucaaaggauacaccaagggcgggcccggacacgaagagccuauccccauggcuacauacggcuggaaucuggugaaacuccauuccgggaaggacguuuuuuucaugccuccggaaaaaugugauacccuucugugcgacauuggagagucuagccccaacccuacgaucgaggaaggcagaacccugcgcgugcucaagauggucgagcccuggcugcggggcaaucaguuuuguaucaagauucuuaacccuuauaugcccuccgugguugaaacacuggagcagaugcaaagaaaacacgggggaaugcucgugcgcaauccgcugucucggaacagcacccacgagauguacugggucuccugcggcacagggaauaucgugagcgccgugaacaugaccucuagaaugcugcucaaccgcuucacaauggcucaucggaagccuaccuaugaaagagaugucgaccugggagccggcacgcgccacguugcgguggagcccgaaguggccaaucuugauauuaucgggcagagaauugagaacaucaaaaaugaacauaaguccacauggcacuacgacgaggauaaccccuauaaaaccugggcuuaccacggaagcuaugaggucaagccuucuggcuccgccagcucuauggugaauggcguugugcggcugcucaccaagcccugggacgucauuccuauggugacacagaucgcuaugacggauaccacaccguuugggcaacagcgcguuuucaaagaaaagguggacaccagaacaccccgggccaaaagaggaaccacacagaucauggaggucaccgcuaaguggcuguggggcuuucuuucccggaacaaaaagccucgcauuuguacgagagaagaguucacccggaaggugcgcagcaaugccgcgaucggggccguuuuuguggacgaaaaccaguggaauuccgcuaaagaggccgucgaggaugaaagauucugggaccuggugcaucgggagcgcgaacuccacaagcaaggaaaaugcgcuacaugcgucuacaacaugaugggcaagagagagaaaaagcugggggaauuuggcaaggccaaaggaagccgggccauuugguacauguggcugggcgcgcgcuuccucgaguucgaggcucugggguuuaugaaugaagaucauugguucucuagagagaacagccuuuccggaguggaaggcgaggggcugcacaagcucggauauauccugcgggacauuucuaaaauccccggcgggaauauguacgccgaugacaccgccggcugggauacacgcaucaccgaggacgaucuucagaacgaagcuaagauuacggacaucauggagccugaacaugcccugcucgcuacaagcauuuuuaaacugaccuaucagaauaagguugugagaguccagcggcccgccaaaaacggaacagugauggaugugaucucccgcagagaccaacggggcucugggcagguuggaaccuacggccugaacacguucaccaauauggaggugcagcucauuagacagauggaaagcgaggggaucuuucugccguccgagcuugaaacaccuaaccuggcggagcgcgcccucgauuggcuggaaaagcacggagcugagcggcuuaagagaauggccaucucuggcgacgacugugucgugaaacccauugaugaccgcuucgcuaccgcccugacagcgcucaaugauauggggaagguucggaaagacaucccucaaugggaacccagcaagggcuggaacgauuggcagcaggugccuuuuugcucccaccauuuccaccagcugauuaugaaagacggaagagagaucgucgugcccugucgcaaucaagaugagcuggucggccgggccagagugagccagggggcuggauggucucuccgcgaaaccgccugccugggcaaguccuaugcucagauguggcaacuuauguacuuucaucggagagaccugcgccucgccgcuaacgccauuuguagcgcgguuccgguggauugggucccuacaucucggaccacgugguccauccacgcccaccaucaguggaugacaaccgaggacaugcugagcguguggaauagaguuuggaucgaagagaaccccuggauggaagauaagacccacguguccucuugggaggagguccccuaucuugggaaacgggaagaccaguggugcggaagccugauuggccucacagcuagagccaccugggccacaaauauccagguggcuauuaaccaagugcgccggcugaucgggaaugagaacuaccuggacuacaugacguccaugaagagauucaaaaaugaaagcgauccugagggcgcccucugguga

SEQ ID NO: 18768 - RNA, 9879 nt, Artificial Sequence
  derived and/or modified CDS sequence (opt5) from DENV-1__EU482611__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccccccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagguguuugggaccgccuacggaguucuguucagcggcguguccuggacgaugaaaaucgggaucggcauucuucugaccuggcucggacugaauagccgcucuacaucccugagcaugaccuguaucgcugucggcauggugacacuuuaccucgggguuauggugcaggccgauucuggaugcgucauuaacuggaagggccgggagcugaaauguggguccggaaucuuugugaccaacgaaguucacacauggaccgagcaauauaaguuccaggcugacagcccuaagagacuguccgccgcgauuggcaaagccugggaggaaggggugugcggcauccgcucugcuacgcggcucgagaauauuauguggaagcagaucagcaacgaacugaaucauauccuucuggagaacgauaugaaacucacagucguggugggagacgccaauggcauucuggcucaggggaagaaaaugaucagaccgcaacccauggaacacaaguacuccuggaaaucuuggggaaaggccaagauuaucggcgccgacauucagaacaccaccuuuaucaucgaugggccugacacacccgaguguccugauggacagcgcgcuuggaauauuugggaggucgaagacuauggcuucggcguuuuuaccacgaacaucuggcugaaacuucgggauagcuacacacagaugugcgaccacagacucauguccgcggccauuaaggauagcaaagcugugcaugccgacaugggguauuggaucgagucugaaaagaaugagaccuggaaacuggcccgcgcuuccuucauugaagugaagacauguaccuggcccaagagccacacacuguggucuaacggaguccucgaguccgagaugaucaucccgaaaauuuacggcgggccuaucagccaacauaauuaucggcccggauacuucacccagacggccggcccuuggcaccuggggaagcuugaacuggauuuugaccucugcgagggaaccacagugguuguggaugaacacugcggcaacagaggccccucucugcggaccacaaccgucacggggaaaauuauccaugagugguguugccgcagcuguacacugccuccccuuagauuccggggagaggacggcugcugguacgggauggaaauuagaccggugaaggagaaagaagagaaucucguucgcuccauggugagcgcgggaucuggcgaagucgauuccuuuagccuggggauccuguguguguccaucaugauugaggagguuaugcggucuagauggagccgcaagaugcucaugaccggaacacuggcuguguuccuucugcucaucaugggccagcugaccuggaacgaccugauuagacuuugcaucauggucggcgccaaugccuccgaccggauggggaugggaaccacauaucuggcucucauggccacguuuaagaugcgcccuauguucgcggugggccugcucuuuagacggcugaccucucgcgaagugcuucugcucacaauugggcugagccuggucgcuuccguugagcuucccaacucucuggaagagcucggagauggccuggccauggggaucaugaugcucaaacugcuuaccgaauuccaaccccaccagcuguggacaacccuccugagccugacguuugugaagacaacccuuucccuggacuacgccuggaaaaccacagcuauggugcucagcauugucucucuguucccucucugucuguccaccacaagccagaagacgaccuggcuuccggugcugcugggaucuuuuggcugcaaaccccucacaauguuccugaucaccgagaacaagaucuggggcagaaaguccuggccucuuaaugaggggauuauggccaucggaauuguuagcauccugcucucuucccugcucaaaaacgaugugccccuggcuggcccucuuauugccgggggaaugcugaucgcguguuaugucaucagcggcuccagcgccgaccugucucucgaaaaggcugccgaggugagcugggaacaggaggcugaacauuccggggccucucacaauauucugguugaggugcaagaugacggaacaaugaaaaucaaggaugaggaacgggacgauacccuuacgauucugcucaaagccacccugcucgcugucagcggcguguaccccauguccaucccugcgacacuguuugucugguauuucuggcagaagaaaaagcagcgcucuggcgugcuuugggacacccccagcccgccugagguugaaagagccgugcuggaugacgggauuuaccggauccugcagcgcggacuccugggcagaucccaagucggggugggaguuuuccaggauggcguguuucauacaauguggcacgucacccggggggcugugcuuauguaucagggaaagagacuggagcccucuugggccagcgugaaaaaggaccucaucuccuacggcggcggguggcgcuuccagggaagcuggaacacaggcgaggaaguucaagucauugccguggagccugggaaaaaucccaagaacgugcagacgaccccgggaacauuuaaaaccccugaaggcgaggucggggcuaucgcccuggacuucaagcccggaaccucuggcuccccuauugugaaucgggaaggcaagaucguugggcucuacggaaacggcguggucacaacgagcgggaccuaugugucugcgauugcucaggccaaagccucccaagagggaccccugcccgagaucgaagaugagguuuuuaagaaaagaaaucuuacaauuauggaccugcacccuggcagcgggaagacccgccgguaccugccggcuaucgugagagaagccaucaaacgcaagcuccggacacugauucuugcgcccaccagagucguggcuuccgagauggccgaagcccugaagggcaugccuauccgcuaucagacgacagcuguuaaaucugagcauaccggacgggagauuguggaucucaugugccacgccaccuucacaaugagacugcugagccccguccgggugccuaacuacaauaugaucauuauggacgaagcucauuuuaccgaucccgccuccaucgcggcccgcggcuauaucagcacaagaguggggaugggagaggcugccgcuauuuucaugaccgccacgccuccgggcucugucgaagccuuuccccaguccaacgcuguuauccaggacgaggaacgggauauuccugagcgcagcuggaauucuggguacgacuggaucacagauuuccccggaaagaccgugugguuugugccuagcauuaaauccggcaacgacaucgcgaauugucucagaaagaacgggaaacgggucauccaacuuucuagaaagacauucgauaccgaguaucagaagacgaaaaacaaugacugggacuacgugguuaccacagauauuagcgaaaugggcgccaacuuccgcgcugaccgggugaucgaucccagacgcugccugaagccggucauucugaaagacggaccugagcgggugauccucgccggccccaugcccguuaccguggccuccgcugcccagagacgcgggcggauuggaagaaaucagaacaaggaaggcgaucaauacgucuauauggggcagccucugaauaacgacgaggaucacgcgcauuggacagaggcuaaaaugcuucuggacaauaucaacacccccgaaggaauuaucccugcccucuuugagccggaacgcgagaagucugccgcuaucgauggcgaauacagacugcggggggaggcccgcaagacauucguggagcugaugagacggggcgaccuccccgucuggcuuagcuauaaaguggcguccgaaggauuucaguacagcgaucgcagauggugcuucgacggcgagcggaauaaccagguucuggaagagaauauggauguggaaauuuggaccaaggagggggagagaaaaaagcugcgcccucgguggcucgacgccagaacguauucugacccccuggcucuucgcgaauuuaaagaguucgccgcuggacggagauccgugagcggcgaucugauccucgaaauugggaagcugccucaacaccugacacuccgggcccagaacgcucuugacaaucuggucaugcugcacaacuccgagcagggaggcaaagccuaccgccaugcgauggaagagcuccccgauaccaucgagacccugaugcuucuggcccucauugcuguucugacaggcggggugacccuguuuuuccucucuggaaagggccuugggaagacaagcaucggacugcugugugugacggccuccucugcucuccuguggauggccagcgucgaaccgcacuggaucgccgcuuccauuauccuugaguuuuuccugauggugcuccugauuccugaacccgacagacagcggaccccucaagauaaucagcuggcguauguugugaucggccuccuuuuuaugauucugacagucgccgcuaacgagauggggcugcucgagaccacaaaaaaggaccugggaaucggcuacguggccgccgaaaaccaucagcacgcuaccaugcuugaugucgaccugcaccccgccagcgcguggacgcucuacgccguggcuaccacaguuaucaccccuaugaugcgccauacaauugagaauaccacggccaacaucucucugacagcuauugccaaucaagcggccauccugaugggccucgauaaaggguggcccauuuccaagauggacaucggagugccgcuucuggcucugggcugcuauagccaggucaacccucucacccugacagccgcugugcuuaugcugguugcccacuacgcuauuaucgggcccggacuccaggccaaagcgaccagagaagcccagaagcggaccgcugccggcaucaugaagaaucccacaguggaugggauugucgcuaucgaccuggauccugugguguaugacgccaaauucgagaagcaacugggacagauuaugcuccuuauccuguguacgucucagauucugcucaugcgcaccacaugggcccugugcgaauccaucacccuugcgacaggcccgcugaccacgcucugggagggcagccccgggaaauuuuggaacacaaccaucgcuguuucuauggccaauauuuucagaggaagcuaccuggcuggcgccgggcuggccuucucccucaugaagucucuuggaggcgggcggcgcggaaccggcgcucagggcgagacacugggggaaaaauggaagagacaacugaaccagcucagcaaguccgaguuuaauaccuauaaacggagcggaaucauggaagucgacagauccgaggccaaggaaggccugaaacgcggggagacaacgaagcaugcggugucucggggaaccgccaaacuuagaugguucguggagcgcaaccuggucaagccugaaggcaagguuauugaucucggguguggacggggcggcuggagcuacuauugcgcugggcugaaaaaggugacagaggugaaaggauacaccaagggcgggcccggacacgaagagccuauccccauggccacauacggcuggaaucuggucaaacuccauuccgggaaggacguguuuuucaugccuccggaaaaaugugauacccuucugugcgacauuggagagucuagccccaacccuacgaucgaggaaggcagaacccugcgcguucucaagaugguggagcccuggcugcggggcaaucaguuuuguaucaagauucuuaacccuuauaugcccuccgucguggaaacacuggagcagaugcaaagaaaacacgggggaaugcucguucgcaauccgcugucucggaacagcacccacgagauguacuggguguccugcggcacagggaauaucgucagcgcugugaacaugaccucuagaaugcugcucaaccgcuucacaauggcccaucggaagccuaccuaugaaagagauguggaccugggagcgggcacgcgccacgucgccguugagcccgaaguggcuaaucuugauauuaucgggcagagaauugagaacaucaaaaaugaacauaaguccacauggcacuacgacgaggauaaccccuauaaaaccugggccuaccacggaagcuaugaggugaagccuucuggcuccgcuagcucuauggucaauggcgugguucggcugcucaccaagcccugggacgugauuccuauggucacacagaucgccaugacggauaccacaccguuugggcaacagcgcguguucaaagaaaagguugacaccagaacaccccgggcuaaaagaggaaccacacagaucauggaggugaccgccaaguggcuguggggcuuucuuucccggaacaaaaagccucgcauuuguacgagagaagaguucacccggaagguccgcagcaaugcggccaucggggcuguguuuguugacgaaaaccaguggaauuccgccaaagaggcuguggaggaugaaagauucugggaccugguccaucgggagcgcgaacuccacaagcaaggaaaaugcgccacaugcguguacaacaugaugggcaagagagagaaaaagcugggggaauuuggcaaggccaaaggaagccgggcgauuugguacauguggcugggcgcucgcuuccucgaguucgaggcccugggguuuaugaaugaagaucauugguucucuagagagaacagccuuuccggagucgaaggcgaggggcugcacaagcucggauauauccugcgggacauuucuaaaauccccggcgggaauauguacgccgaugacaccgcuggcugggauacacgcaucaccgaggacgaucuucagaacgaagccaagauuacggacaucauggagccugaacaugcucugcucgccacaagcauuuuuaaacugaccuaucagaauaaggugguuagagugcagcggcccgcgaaaaacggaacagucauggaugugaucucccgcagagaccaacggggcucugggcaggugggaaccuacggccugaacacguucaccaauauggagguucagcucauuagacagauggaaagcgaggggaucuuucugccguccgagcuugaaacaccuaaccuggccgagcgcgcucucgauuggcuggaaaagcacggagccgagcggcuuaagagaauggcuaucucuggcgacgacuguguggucaaacccauugaugaccgcuucgccaccgcgcugacagcccucaaugauauggggaaggugcggaaagacaucccucaaugggaacccagcaagggcuggaacgauuggcagcagguuccuuuuugcucccaccauuuccaccagcugauuaugaaagacggaagagagaucgugguccccugucgcaaucaagaugagcuggugggccgggcuagagucagccagggggccggauggucucuccgcgaaaccgcuugccugggcaaguccuaugcccagauguggcaacuuauguacuuucaucggagagaccugcgccucgcugccaacgcgauuuguagcgccgugccgguugauugggugccuacaucucggaccacgugguccauccacgcucaccaucaguggaugacaaccgaggacaugcugagcgucuggaauagaguguggaucgaagagaaccccuggauggaagauaagacccacguuuccucuugggaggaggugcccuaucuugggaaacgggaagaccaguggugcggaagccugauuggccucacagccagagccaccugggcuacaaauauccaggucgccauuaaccaagugcgccggcugaucgggaaugagaacuaccuggacuacaugacguccaugaagagauucaaaaaugaaagcgauccugagggcgcgcucugguga

SEQ ID NO: 18769 - RNA, 9879 nt, Artificial Sequence
  derived and/or modified CDS sequence (opt5) from DENV-1__FJ639735__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugacagcccuguuucucgcgcaugccaucgggaccucuauuacccagaagggaaucaucuucauucugcuuaugcuggucacaccuagcauggcuaugagaugcgugggcaucgggaaccgggauuuuguugagggacucuccggcgccacguggguggacgucgugcuggagcacgggagcugugugaccacaauggcuaagaauaaacccacccuggauauugaacuccugaagacagaggucaccaacccugccguucuucgcaaacugugcaucgaagcgaagauuucuaauacgacaaccgacuccagauguccgacccaaggagaggccacacucguggaagagcaggaugcuaacuucgugugccggcgcaccuuugucgacagaggcuggggcaauggguguggacuguucggcaaagggagccuucugacaugcgccaaguuuaagugcgugacgaaacucgagggaaagaucguucaguacgaaaaccugaaauauucugugauugucaccgugcacacaggcgaucagcaucaaguugggaaugagaccacagaacacggaaccaucgcuacgaucaccccccaggccccuacauccgagauucagcugaccgacuacggcgcccucacacuggacuguagcccccggaccggccuugauuucaacgaaauggugcugcucacgaugaaggagaaaucuuggcugguccauaagcagugguuucuugaccugccucuccccuggacauccggggcuagcaccucccaagagacauggaaucgccaggaucugcuggugaccuucaaaaccgcgcacgccaagaagcaggaagucgugguucucggaucucaagagggcgcuaugcacacagcccugacgggggccaccgaaauccagacaagcggaaccacaaccauuuuugcuggccaucuuaaaugcagacugaagauggacaaacucacgcugaaggggacauccuaugugauguguaccggcagcuucaaacuggagaaggaagucgccgagacccagcacggaacagugcuuguucaggugaaguacgagggcaccgaugcgccgugcaaaaucccuuucucuacacaagacgaaaagggggucacgcagaacggacggcucauuaccgcuaaucccaucgugacagauaaagagaagccugugaacaucgaaaccgagccccccuuuggcgaguccuauauuguugucggggccggagaaaaagcccugaagcugagcugguucaagaaaggcucuagcaucgggaagauguuugaggcuacagccagaggcgcucgccggauggccauucucggagacaccgcgugggauuucggcuccaucgggggaguguuuacgucugugggcaaacugguccaucagguguucgggaccgccuacggaguucuuuuuagcggcguguccuggacaaugaagauugggaucggcauccugcucaccuggcugggacugaauagcagaucuacaucccuuagcaugaccuguauugcugucggcauggugacacucuaccuggggguuauggugcaggccgacucuggaugcgucaucaacuggaaaggccgcgaacugaaguguggguccggaauuuucgugaccaacgagguucacacguggacagaacaauauaaguuucaggcugauagcccuaaacggcucuccgccgcgaucggcaaggccugggaggagggggugugcggcauuagaucugcuacccgccuggaaaauaucauguggaaacagauuagcaacgagcuuaaucauauccugcucgaaaacgacaugaaguucaccgucguggugggagacgccaauggcauccuggcucaggggaaaaagaugauucggccgcaacccauggagcacaaauacuccuggaagucuuggggaaaggccaaaaucauuggcgccgauauccagaacacaaccuuuauuaucgacgggccugauacgcccgaauguccugacgaucagagagcuuggaauaucugggaggucgaggacuauggauucggcauuuuuacaaccaacaucuggcugaagcuucgcgauagcuacacacagaugugcgaccaccggcucauguccgcggccauuaaagauagcaaggcuguucaugccgacaugggcuauuggaucgaaucugagaaaaaugaaaccuggaagcuggccagagcuuccuucauugaggugaagacauguaccuggcccaaaagccacacgcuguggucuaacggggugcucgaauccgagaugaucaucccgaagauuuacggaggcccuaucagccaacauaauuaucgccccggguacuucacccagacagccggaccuuggcaccugggcaaacuugagcuggauuuuaaccucugcgaagggaccacagucgugguugacgagcacugcggaaaucggggccccucucugagaaccacgacagugaccggcaagauuauccaugaaugguguugccggagcuguacacugccuccccuucgcuucagaggggaggauggaugcugguacggcauggagauucggccggucaaagaaaaggaggaaaaccucgugagauccaugguuagcgcggggucuggagagguggacuccuuuagccugggcauccugugugucuccaucaugauugaagaggugaugcgcucucgguggagcagaaagaugcucaugaccgggacccuggcuguuuuccuucugcucaucaugggacagcugacauggaaugaccugauucgccuuugcaucauggugggcgccaacgccuccgauagaaugggcauggggacgaccuaucuggcucucauggccacauuuaaaaugcggccuauguucgcggucggacugcucuuucgcagacugaccucucgggaggugcuucugcucacaauuggccugagccugguggcuuccgucgaacuucccaacucucuggaggaacucggggacggacuggccaugggcaucaugaugcucaagcugcuuaccgaguuccaaccccaccagcuguggacgacacuccugagccugaccuuuauuaaaaccacacuuucccuggauuacgccuggaagaccacagcuauggcccucagcaucguuucucuguucccucucugucuguccacgaccagccagaaaacaaccuggcuuccggugcugcuggggucuuuuggaugcaagccccucacaauguuccugaucaccgaaaauaagauuuggggccgcaaauccuggccucuuaacgagggcaucauggcuauugggaucgugagcauucugcucucuucccugcucaagaaugacgucccccuggccggaccucuuaucgcgggcgggaugcugaucgccuguuaugugauuagcggauccagcgcugaucugucucucgagaaagccgcugaaguuagcugggagcaggaagccgagcauuccggcacgucucacaacauccugguggaaguccaagacgaugggaccaugaagauuaaagacgaggagaaggaugacacacuuaccauccugcucaaagccacacugcucgcugugagcggaguuuaccccauguccauuccugcgacccuguuugugugguauuucuggcagaagaagaaacagagaucuggcguccuuugggauacacccagcccgccugaaguggagcgggccguccuggacgauggcaucuaccgcauccugcagagagggcuccugggacggucccaagugggcguugggguguuccaggacggagucuuucauacgauguggcacgugacccgcggcgcuguucuuauguaucaggggaagagacuggaacccucuugggccagcgugaaaaaggaccucauuuccuacggaggcggcuggcgguuccaggggagcuggaauacaggagaggagguccaagugaucgccguggaaccuggcaaaaaccccaagaauguucagaccaccccggggacauuuaagacgccugagggagaagucggcgcuauugcccuggauuucaaacccgggaccucuggauccccuaucgugaacagagagggcaagauugugggccucuacgggaauggagucgugacaaccagcggcacauauguuucugcgaucgcucaggccaaagccucccaagaagggccccugcccgagauugaggacgaaguguuuaagaaacgcaaccuuaccaucauggaucugcacccuggaagcggcaagacgcggagauaccugccggcuaucguccgcgaggccauuaagcggaaacucagaacacugauccuugcgcccacccgcgugguugcuuccgaaauggccgaggcccugaaggggaugccuauucgguaucagaccacagcugugaaaucugaacauaccggcagagagaucgucgaccucaugugccacgccacauucaccaugcgccugcugagccccgugcggguuccuaauuacaacaugauugugauggaugaggcucauuuuacggaccccgccuccaucgcggccagaggauauaucagcacacgggucggcaugggggaagcugccgcuauuuucaugaccgccacaccuccgggaucuguggaggccuuuccccaguccaaugcugugauccaggaugaagagcgcgacauuccugaaagaagcuggaacucuggcuacgauuggaucaccgacuuccccgggaagacggucugguuuguuccuagcauuaaauccggaaaugauaucgcgaacugucuccggaagaacggcaagcgcgugauccaacuuucuagaaaaaccuucgacacagaguaucagaagaccaaaaauaacgacugggauuacguggucacaaccgacauuagcgagaugggggccaauuuccgggcugauagagugaucgacccccgccggugccugaagccgguuauucugaaagauggcccugaaagagugauccucgccggacccaugcccgucacaguggccuccgcugcccagcgccggggcagaauugggcgcaaccagaauaaggagggagaccaauacguuuauaugggccagccucugaacaaugaugaagaccacgcgcauuggaccgaggcuaagaugcuucuggauaacaucaauacgcccgaggggauuaucccugcccucuuugaaccggagcgggaaaaaucugccgcuaucgacggagaguacagacugcgcggcgaagccagaaagacauucguggagcugaugcggcgcggggaucuccccgucuggcuuagcuauaaaguggcguccgagggcuuucaguacagcgacagacgguggugcuucgauggagaacgcaacaaucagguccuggaggaaaacauggacguggagauuuggaccaaggaaggcgagagaaaaaagcugcggccuagauggcucgacgcccgcaccuauucugauccccuggcucuucgggaguuuaaagaauucgccgcugggagacgcuccguuagcggagaccugauccucgagauuggcaagcugccucaacaccugacacuccgggcccagaaugcucuugauaaccuggugaugcugcacaauuccgaacaggggggaaaggccuacagacaugcgauggaggaacuccccgacaccaucgagacacugaugcuucuggcccucauugcugugcugacgggcggcgucacccuguuuuuccucucugggaaaggacuuggcaagacaagcaucgggcugcuguguguuaccgccuccucugcucuccuguggauggccagcguggagccgcacuggaucgccgcuuccauuauccuugaauuuuuccugauggugcuccugauuccugagcccgaucggcagcgcacaccucaagacaaccagcuggcguaugucgugaucggacuccuuuuuaugauucugaccguugccgcuaacgaaaugggccugcucgagacgaccaaaagagaucuggggaucggacauguggccgccgagaaucaccagcacgcuacaaugcuugacgucgaucugcggcccgccagcgcguggacccucuacgccguggcuacaaccgucaucacgccuaugaugcgccauacaauugaaaacaccacagccaauaucucucugaccgcuauugccaaccaagcggccauccugaugggccucgacaagggcuggcccauuuccaaaauggauaucggggugccgcuucuggcucugggaugcuacagccagguuaauccucucacccugacagccgcugugcuuaugcuggucgcccacuaugcuauuaucggccccgggcuccaggccaaggcgacgagagaggcccagaagcggaccgcugccggaaucaugaaaaaccccacaguggacggcauuguugcuaucgaucuggacccuguggucuacgacgccaaguucgaaaaacaacuggggcagauuaugcuccuuauccuguguaccucucagauucugcucaugcgcacaaccugggcccugugcgaguccaucacgcuugcgacaggaccgcugaccacccucugggaaggcagccccggcaaguuuuggaauacaaccaucgcugugucuauggccaacauuuucagagggagcuaucuggcuggagccggccuggccuucucccucaugaaaucucuugggggaggccggcgcgggacaggagcucagggcgagacgcugggcgagaaguggaagagacaacugaaucagcucagcaaauccgaauuuaacaccuacaagcggagcgggaucauggagguggauagauccgaagccaaagagggacugaagcgcggcgaaacaaccaaacaugcgguuucucgggggacagccaagcuuagaugguucgucgagcgcaaucuggugaagccugagggaaaagugauugaccucggcugugggcggggaggcuggagcuauuacugcgcuggccugaagaaagucaccgaaguuaagggguauacgaaaggaggccccgggcacgaggaaccuauccccauggccaccuacggauggaaccuggugaagcuccauuccggcaaagauguguuuuucaugccuccggagaagugugacacacuucugugcgauauuggggaaucuagccccaauccuaccaucgaggagggaagaacacugcgcguccucaagaugguggaacccuggcugcggggcaaccaguuuuguaucaaaauucuuaauccuuacaugcccuccguuguggagacccuggaacagaugcaaagaaagcacggcgggaugcucguccgcaacccgcugucucggaauagcacacacgagauguauuggguguccugcggaaccggcaacaucguuagcgcugugaacaugacgucuagaaugcugcucaaucgcuucacaauggcccaucggaaaccuaccuacgagagagacgucgaucugggggcgggaacccgccacguggccguggaacccgaggucgcuaaccuugacauuaucggccagagaauugaaaauaucaagaacgagcauaaauccacauggcacuaugaugaagacaaucccuacaagacgugggccuaucacgggagcuacgagguuaagccuucuggauccgcuagcucuauggugaacggcgugguccggcugcucaccaaacccugggaugugauuccuaugguuacacagaucgccaugaccgacacaaccccguuuggccaacagcgcguguucaaggagaaagucgacacaagaaccccccgggcuaagagagggacgacccagaucauggaagugacagccaaauggcuguggggauuucuuucccggaauaagaagccucgcauuuguaccagagaggaauucacacggaaaguucgcagcaacgcggccaucggcgcuguguuugucgaugagaaucaguggaacuccgccaaggaagcuguggaggacgagagauucugggaucugguucaucgggaacgcgagcuccacaaacaagggaagugcgccaccugcguguauaauaugaugggaaaaagagaaaagaagcugggcgaguuugggaaagccaagggcagccgggcgauuugguacauguggcugggagcucgcuuccucgaauucgaggcccugggcuuuaugaacgaggaccauugguucucuagagaaaauagccuuuccggggucgagggagaaggccugcacaaacucggguacauccugcgggauauuucuaagauccccggaggcaacauguaugccgacgauacggcugggugggacacacgcaucaccgaggaugaccuucagaaugaggccaaaauuacagauaucauggaaccugagcaugcucugcucgccaccagcauuuuuaagcugacguaccagaacaaaguggucagagugcagcggcccgcgaagaacggcaccguuauggacgugaucucccgcagagaucaacggggaucuggccaggucgggacauauggacugaauaccuucacaaacauggaagugcagcucauuagacagauggagagcgaaggcaucuuucugccguccgagcuugagaccccuaaucuggccgaacgcgugcucgacuggcuggagaagcacggggcugaacggcuuaaaagaauggccaucucuggagacgauuguguugugaagcccauugacgaucgcuucgcuacagcccugaccgcgcucaacgacaugggcaaaguccggaaggauaucccucaaugggagcccagcaaaggguggaaugacuggcagcaggugccuuuuugcucccaccauuuccaccagcugauuaugaaggauggcagagaaaucguugugcccugucgcaaccaagacgagcuggucggacgggccagagugagccagggcgcuggguggucucuccgcgagacggccugccugggaaaguccuacgcucagauguggcaacuuauguauuuucaucggagagaucugcgccucgccgcuaaugccauuuguagcgcggucccgguggacuggguuccuacaucucggaccaccugguccauccacgcccaccaucaguggaugacaaccgaagauaugcugagcguguggaacagagucuggaucgaggaaaaucccuggauggaggacaaaacacacguguccucuugggaagagguucccuaccuuggcaagcgggaggaccaguggugcgggagccugauuggacucacggcuagagccaccugggccacaaacauccagguggcuauuaaucaaguccgccggcugaucggcaacgaaaauuaucuggauuacaugaccuccaugaaaagauucaagaacgagagcgacccugaaggggcccucugguga

SEQ ID NO: 18770 - RNA, 9879 nt, Artificial Sequence
  derived and/or modified CDS sequence (opt5) from DENV-1__FJ639740__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacacuggucgacagaggcuggggcaauggguguggacuuuuuggcaaagggagccugcucaccugcgccaaguucaagugcgugacaaaacuggagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcucacagacuacggcgcccugacccuugacuguagcccccggacaggccuggauuuuaacgaaauggugcuccugaccaugaaggagaaaucuuggcuuguccauaagcagugguuccuggaccucccucugcccuggacguccggggcuagcacaucccaagagaccuggaaucgccaggaucugcucgugacauuuaaaaccgcgcacgccaagaagcaggaagucgugguucugggaucucaagagggcgcuaugcacaccgcccuuacaggggccacggaaauucagaccagcggaacaaccacaaucuucgcuggccaucugaaaugcagacucaagauggacaaacugacccugaaggggauguccuaugugauguguacgggcagcuuuaaacuugagaaggaagucgccgagacacagcacggaaccgugcucguucaggugaaguacgagggcaccgaugcgccgugcaaaauuccuuucgcuacacaagacgaaaagggggucacccagaacggacggcugaucacagccaaucccaucgugacggauaaagagaagccugugaacauugaaaccgagccccccuucggcgagucuuauaucguugucggggccggagaaaaagcucugaagcucuccugguuuaagaaaggcagcucuauugggaagauguucgaggccacagcuagaggcgcccgccggauggcgauccugggagacaccgccugggauuuuggcagcauugggggaguguucacauccgugggcaaacuuguccaucagguguuugggaccgcuuacggaguucuguucucuggcgugagcuggacgaugaagaucgggaucggcauucuccugaccuggcugggacuuaauuccagaagcacaucucucuccaugaccuguaucgccgucggcauggugacacuguaccuggggguuauggugcaggcugacagcggaugcgucauuaacuggaaaggccgcgaacucaagugugggucuggaaucuuugugaccaacgagguucacacauggaccgaacaauauaaguuccaggccgauuccccuaaacggcugagcgcggccauuggcaaggcuugggaggagggggugugcggcaucagauccgccacgcgccuugaaaauauuauguggaaacagaucucuaacgagcugaaucauauccuccuggaaaacgacaugaaguuuacagucguggugggagacgcuaauggcauucuggcccaggggaaaaagaugauccggccgcaacccauggagcacaaauacagcuggaaguccuggggaaaggccaaaauuaucggcgcugauauucagaacaccaccuucaucaucgacgggccugauacacccgaauguccugacggacagagagcguggaauauuugggaggucgaggauuauggcuuuggcaucuucaccacgaacauuuggcuuaagcuccgcgacucuuacacacagaugugcgaucaccggcugaugagcgccgcuaucaaagacuccaaggccguucaugccgauaugggguauuggauugaaagcgagaaaaaugaaaccuggaagcuggcuagagccucuuuuaucgaggugaagacauguaccuggcccaaaucccacacacucuggagcaacggagugcuggaaucugagaugaucauuccgaagaucuacggcgggccuauuucccaacauaauuaucgccccggauacuucacccagacggcgggcccuuggcaccuugggaaacuggagcucgacuucgaucugugcgaaggaaccacagucgugguugacgagcacugcggcaaccggggccccagccugagaaccacaaccgugacggggaagaucauucaugaaugguguugccggucuuguacacuuccuccccuccgcuuuagaggagaggauggcugcugguacgggauggagauccggccggucaaagaaaaggaggaaaaucuggugagaagcaugguuuccgcuggaagcggcgagguggacucuuucucccuggggauccucugugucagcauuaugaucgaagaggugaugcgcucccgguggucuagaaagaugcugaugaccggaacacuugccguuuuucugcuccugauuaugggccagcugaccuggaacgaccuuauccgccugugcauuauggugggcgccaaugcuagcgauagaauggggaugggaaccacauaucucgcccugauggcgacguucaaaaugcggccuauguuugcugucggccuccuguuccgcagacuuaccucccgggaggugcugcuccugacaaucgggcugucucuuguggccagcgucgaacugcccaacucccucgaggaacugggagacggccucgccauggggauuaugaugcugaagcuucugaccgaguuucaaccccaccagcucuggacaacccugcugucucuuacguucguuaaaacaacccugagccucgauuacgcuuggaagaccacagccauggugcuguccaucgugagccucuuuccucugugucuuucuaccacaucccagaaaacgaccuggcugccgguccugcucggaagcuucggcugcaagccccugacaauguuucuuaucaccgaaaacaagauuuggggccgcaaaucuuggccucugaaugaggggaucauggcuauuggaaucguguccauucuccugagcucucuccugaagaacgacguuccccuugccggcccucugaucgcggggggaaugcugaucgccuguuaugugauuuccggcagcuccgcugaucucagccuggagaaagccgcugaagucucuugggagcaggaagccgagcauagcggggccucccacaauauccuuguggaaguucaagacgauggaacaaugaagauuaaagacgaggagagagaugacacccugacgauccuccugaaggcuacccuccuggcggugucuggcgucuaccccaugagcauuccugccacacuuuucgugugguauuuuuggcagaaaaagaagcagcgguccggcguccugugggauacccccucuccgccugaaguggagcgcgcuguucuggacgaugggaucuacagaauccuccagcggggacugcuuggccgcagccaagugggggucggaguguuccaggacggcguuuuccauacaauguggcacgugaccagaggggccguccugauguaucagggaaaacggcucgaacccuccugggccucugugaagaaagaccugauuagcuacggcggcggguggagauuucagggauccuggaacacaggcgaggaggugcaaguuaucgcugucgaaccugggaagaaucccaaaaacgugcagacgaccccgggaacauucaagaccccugagggcgaagugggggccauugcgcucgauuuuaagcccggaaccagcggcucuccuaucgucaaucgcgagggcaaaauuguggggcuguacggaaacggcguugugacaacguccgggaccuaugucagcgcuaucgcccaggccaaggcuucucaagaaggaccccuucccgagauugaggacgaaguguucaaaaagcggaaucugacaaucauggaucugcacccuggcuccgggaaaaccagacgcuaccucccggccaucguucgggaggcgauuaagagaaagcugcgcacacuuauccuggcucccacccggguggucgccagcgaaauggccgaggcucucaaaggcaugccuauuagauaucagacgacagccgugaaguccgaacauaccggacgcgagaucguugaccugaugugccacgcuaccuuuacaaugcggcugcucucucccgugagagucccuaacuacaauaugauuaucauggaugaggcccauuucaccgaccccgcgagcaucgccgcucggggcuauauuuccacacgcguggggaugggagaagccgcugccaucuuuaugaccgccacgccuccgggcagcguggaggcuuucccccagucuaacgcggucauucaggaugaagagagagacaucccugaacgguccuggaauagcggguacgauuggauuacagacuuucccggaaaaaccguuugguucgugccuucuaucaagagcggcaacgauaucgccaauugucuucgcaaaaacgggaagagagugauucaacugucccggaagacauuugacaccgaguaucagaaaacgaagaacaaugacugggauuacgucgugaccacagacaucucugagaugggcgcuaacuucagagccgaucgcguuauugacccccggagaugccugaaaccggugauccucaaggauggaccugaacgcgucauucuggccggccccaugcccgugaccguugcuagcgccgcgcagcggagagggcgcaucggacggaaucagaacaaagagggcgaccaauacguguauauggggcagccucuuaauaacgaugaagaccacgcucauuggacagaggccaagaugcugcucgauaauauuaacacccccgagggaaucaucccugcccuguucgaaccggagagagaaaaguccgcugccauugacggcgaguaccgccugagaggggaagcgcggaaaacauuugucgagcucaugcgcagaggcgaucuucccguguggcugucuuauaaggucgccagcgagggauuccaguacuccgaccggcgcuggugcuuugauggcgaaagaaauaaccaggugcuggaggaaaauauggacguugagaucuggaccaaagaaggggagcggaagaaacucagaccucgcuggcuggacgcucggacguauagcgauccccuugcccugagagaguucaaggaauuugcugccggacgccggucuguguccggcgaccucauucuggagaucgggaaacugccucaacaccucacacuuagagcucagaacgcccuggauaaucuggugaugcuccacaacagcgaacagggaggcaaggcguaccggcaugccauggaggaacugcccgacaccauugagacccuuaugcugcucgcucugaucgccguccugacaggcgggguuacccucuucuuucuuuccggaaagggccuggggaaaacaucuaucggacugcucugugugacggcuagcuccgcccugcuuuggauggccucuguggagccgcacuggauugcugcgagcaucauucuggaauucuuucucaugguccugcugaucccugagcccgaucgccagagaaccccucaagacaaucagcucgccuaugugguuauuggccuucuguucaugauccugacaguggcugccaacgaaauggggcuccuggagaccacaaagaaagaucuuggaaucggcuacgucgccgcugagaaccaucagcacgccaccaugcuggacguggaucuccggcccgcguccgccuggacgcuguacgcugucgccaccacagugauuaccccuaugaugcgccacacaaucgaaaauaccacggcuaacauuagccugacagccaucgcgaaucaagccgcuauucucaugggccuugacaagggguggcccaucucuaaaauggauauuggaguuccgcugcuggcccucggcugcuauucccaggugaacccucugacccuuacagcugccguccugaugcucguggcucauuacgccaucaucgggcccggacugcaggcgaaggccaccagagaggcucagaagcggaccgccgcuggcauuaugaaaaaucccacaguugacgggaucguggccauugaucuggacccugucguguaugacgccaaguuugaaaaacaacucggacagaucaugcuucugauucuguguacgagccagauccuccugaugcgcaccacaugggcgcuuugcgagucuaucacccuggcuacaggcccgcucaccacgcugugggaaggcucccccgggaaguucuggaacacaaccauugccgugagcauggcuaauaucuuuagaggaucuuaccuggccggcgccgggcucgcuuucagccuuaugaaaucccugggaggcgggcggcgcggaaccggcgcccagggcgagacacugggggagaaguggaagagacaacucaaccagcugucuaaaagcgaauucaauaccuauaagcgguccggaauuauggagguugauagaagcgaagcgaaagagggccuuaagcgcggggaaacaacgaaacacgccgucucccggggaaccgcuaagcugagaugguuuguggagcgcaaccucgugaagccugagggcaaagucaucgaccugggguguggacggggcggcuggucuuacuauugcgccgggcugaagaaaguuacagaagugaagggauacaccaaaggcgggcccggacaugaggaaccuauucccauggcuacauacggcuggaaucucgugaagcuucacagcgggaaagaugucuucuuuaugccuccggagaagugugacacccugcugugcgauaucggagaauccucucccaacccuacgaucgaggagggcagaacccuccgcgugcugaagaugguugaacccuggcuucggggcaaucaguucuguauuaaaauccugaacccuuauaugcccagcguggucgagacacucgaacagaugcaaagaaagcaugggggaaugcuggugcgcaauccgcugucccggaacucuacccacgagauguacuggguuagcugcggcacagggaauauuguguccgccgucaacaugaccagcagaaugcuccugaaccgcuuuacaauggcgcaccggaaaccuaccuaugagagagacguggaucuuggagccggcacgcgccauguggcugucgaacccgaggaagccaaucuggacaucauugggcagagaaucgagaacauuaagaaugaacacaaaucuacauggcauuacgaugaggacaaccccuauaagaccugggcuuaccacggauccuaugagguuaagccuagcggcucugccuccagcauggugaauggcgugguccggcuccugaccaaacccugggaugugaucccuaugguuacacagaucgcuaugacggacaccacaccguucgggcaacagcgcguguuuaaggaaaaagucgacaccagaacaccccgggccaagagaggaaccacacagauuauggaggugaccgcgaaauggcuuuggggcuuccugucucggaacaagaagccucgcaucuguacgagagaagaguuuacccggaaaguucgcuccaaugccgcuauuggggccguguucgucgaugaaaaccaguggaauagcgcuaaggaggccguggaggacgaaagauuuugggaucucguucaccgggagcgcgaacugcauaaacaaggaaagugcgccacaugcguguacaacaugaugggcaaaagagagaagaagcugggggaauucggcaaagcgaagggaucccgggcuaucugguacauguggcucggcgcccgcuuucuggaguucgaggcccuuggguucaugaaugaagaccacugguuuagcagagagaacucucugagcggagucgaaggcgaggggcuccauaaacugggauauauucuucgggauaucuccaagauccccggcgggaauauguacgcugacgauaccgccggcugggacacacgcauuaccgaggaugaccugcagaacgaagcuaaaaucacggauauuauggagccugaacacgcccuccuggcgacaucuaucuucaagcugaccuaucagaauaaaguggucagagugcagcggcccgccaagaacggaacaguuauggacgugauuagccgcagagaucaacggggcuccgggcaggucggaaccuacggccucaacacguuuaccaauauggaggugcagcugaucagacagauggaaucugaggggaucuuccuuccgagcgagcuggaaacaccuaaccucgcugagcgcgugcuggacuggcuugaaaagcauggagccgagcggcugaaaagaauggcuauuuccggcgacgauuguguugugaagcccaucgacgaucgcuuugccaccgcgcucacagcccugaaugacauggggaaaguccggaaggauauuccucaaugggaacccucuaaaggcuggaacgacuggcagcaggugccuuucugcagccaccacuuucaucagcugaucaugaaggauggaagagagauuguugugcccugucgcaaucaagacgagcucgucggccgggcuagagugucccagggggccggauggagccugcgcgaaaccgcuugccuuggcaagucuuaugcccagauguggcaacugauguacuuccaccggagagaucuccgccuggcugccaacgcgaucuguuccgccgucccgguggacuggguuccuacaagccggaccacguggucuauccaugcucaccaccaguggaugacaaccgaggauaugcuuuccguguggaauagagucuggauugaagagaaccccuggauggaagacaaaacccaugugagcuccugggaggagguucccuaucuggggaagcgggaagaccaguggugcggaucucucaucggccugacagccagagccaccugggcuacaaauauucagguggccaucaaccaaguccgccggcugauugggaaugagaacuaccucgauuacaugacgagcaugaaaagauuuaagaaugaauccgacccugagggcgcgcugugguga

SEQ ID NO: 18771 - RNA, 9879 nt, Artificial Sequence
  derived and/or modified CDS sequence (opt5) from DENV-1__FJ639741__SS-prME
agcgugaccauccugcucaugcugcuucccacagcccuggcuuuccaccucacgaccagaggcggggagccucauaugauugucuccaagcaggaacggggaaaaucucugcuuuuuaagacaagcgccggcguuaacaugugcacccugaucgcgauggaccucggggagcugugugaagauacaaugaccuacaaaugcccgcgcauuacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauccagcggguugaaacaugggcucuucgccaccccggcuucaccgugauugcccuguuucucgcgcaugccaucgggacaucuaucacccagaagggaauuaucuucauucugcuuaugcuggucaccccuagcauggcuaugagaugcgugggcaucgggaaccgggauuuuguugagggacucuccggcgccacauggguggacgucgugcuggagcacgggagcugugugacgaccauggcuaagaauaaacccacacuggauauugaacuccugaagaccgaggucacaaacccugccguucuucgcaaacugugcaucgaagcgaagauuucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagaucguucaguacgaaaaccugaaauauucugugaucgucacggugcacaccggcgaucagcaucaaguugggaaugagacaaccgaacacggaacaauugcuaccaucacgccccaggccccuaccuccgagauucagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccgggacaagcaccucccaagagacauggaaucgccaggaucugcuggugaccuucaaaaccgcucacgcgaagaagcaggaagucgugguucucggaucucaagagggcgccaugcacacagcucugacgggggccaccgaaauccagacaagcggaaccacaaccauuuuugccggccaucuuaaaugcagacugaagauggacaaacucacgcugaaggggacauccuaugugauguguaccggcagcuucaaacuggagaaggaagucgcugagacccagcacggaacagugcuuguucaggugaaguacgagggcaccgaugccccgugcaaaaucccuuucucuacacaagacgaaaagggggucacgcagaacggacggcucaucaccgcgaaucccauugugacagauaaagagaagccugugaacaucgaaaccgagccccccuuuggcgaguccuauauuguugucggggcuggagaaaaagcccugaagcugagcugguucaagaaaggcucuagcaucgggaagauguuugaggccacagcuagaggcgcccgccggauggcuauucucggagacaccgccugggauuucggcuccaucgggggaguguuuacgucugugggcaaacugguccaucagguguucgggaccgcguacggaguucuuuuuagcggcguguccuggacaaugaagaucgggauuggcauccugcucaccuggcugggacugaauagcagaucuacaucccuuagcaugaccuguauugccgucggcauggugacacucuaccuggggguuauggugcaggcugacucuggaugcgucaucaacuggaaaggccgcgaacugaaguguggguccggaauuuucgugaccaacgagguucacacguggacagaacaauauaaguuucaggccgauagcccuaaacggcucuccgcugccaucggcaaggcgugggaggagggggugugcggcauuagaucugccacccgccuggaaaauaucauguggaaacagaucagcaacgagcuuaaucauauucugcucgaaaacgacaugaaguucaccgucguggugggagacgcuaauggcauccuggcccaggggaaaaagaugauucggccgcaacccauggagcacaaauacuccuggaagucuuggggaaaggcuaaaaucauuggcgccgauauccagaacacaaccuuuaucauugacgggccugauacgcccgaauguccugacgaucagagagccuggaauaucugggaggucgaggacuauggauucggcauuuuuacaaccaacaucuggcugaagcuucgcgauagcuacacacagaugugcgaccaccggcucauguccgcugcgauuaaagauagcaaggccguucaugcugacaugggcuauuggaucgaaucugagaaaaaugaaaccuggaagcuggccaaggccuccuucaucgaggugaaaacauguauuuggcccaagagccacacccuguggucuaacggggugcucgaauccgagaugaucauuccgaaaaucuacggaggcccuauuagccaacauaauuauagacccggguacuucacgcagaccgcuggaccuuggcaccugggcaagcuugagcuggauuuugaccucugcgaagggacaaccgucgugguugaugagcacugcggaaaccgcggccccucucugcggacaaccacggugacaggcaaaaucauccaugaaugguguugcagaagcuguacccugccuccccuucgguuccgcggggaggacggaugcugguacggcauggagauuagaccggucaaggaaaaggaggaaaaucucgugcgguccaugguuagcgccgggucuggagagguggacuccuuuagccugggcauccugugugucuccauuaugaucgaagaggugaugagaucucgcuggagccggaaaaugcucaugacagggacccuggcgguuuuccuucugcucauuaugggacagcugaccuggaacgaucugaucagacuuugcauuauggugggcgcuaaugccuccgaccgcaugggcauggggacaacguaucuggcccucauggcuaccuuuaagaugagaccuauguucgccgucggacugcucuuucggcgccugacaucuagagaggugcuucugcucaccaucggccugagccugguggcguccgucgaacuucccaacucucuggaggaacucggggauggacuggcuaugggcaucaugaugcucaaacugcuuacagaguuccaaccccaccagcuguggaccacgcuccugagccugacauuuauuaagaccacccuuucccuggacuacgccuggaaaacaaccgccaugguucucagcaucgugucucuguucccucucugucuguccacaacgagccagaagaccacauggcuuccggugcugcuggggucuuuuggaugcaagccccucaccauguuccugauuacagaaaacaaaaucuggggccggaaguccuggccucuuaaugagggcauuauggcuaucgggaucgucagcauucugcucucuucccugcucaaaaacgaugugccccuggccggaccucuuaucgcuggcgggaugcugauugccuguuauguuaucagcggauccagcgcggaccugucucucgagaaggccgcugaagugagcugggagcaggaagccgagcauuccggcaccucucacaauauucuggucgaagugcaagaugacgggacgaugaaaaucaaggaugaggagcgcgacgauacccuuacaauccugcucaaagcuacccugcucgccguuagcggaguguaccccauguccauuccugccacacuguuugucugguauuucuggcagaagaagaaacagagaucuggcgugcuuugggacacccccagcccgccugaagucgagcgggcugugcuggaugacggcaucuaccgcauucugcagagagggcuccugggacggucccaaguuggcgugggggucuuccaggacggaguguuucauacaauguggcacguuacgcgcggcgcggugcuuauguaucaggggaagagacuggaacccucuugggccagcgucaaaaaggaucucaucuccuacggaggcggcuggcgguuccaggggagcuggaacaccggagaggaggugcaagugauugcuguugaaccuggcaaaaaucccaagaacguccagacaaccccggggaccuuuaagacaccugagggagaagugggcgccaucgcccuggacuucaaacccgggacgucuggauccccuauugugaauagagagggcaagaucgucggccucuacgggaacggagugguuaccacaagcggcaccuaugugucugcuaucgcccaggcgaaagcuucccaagaagggccccugcccgagauugaggaugaagucuuuaagaaacgcaaucuuacaaucauggaccugcacccuggaagcggcaagacccggagauaccugccggccauugugcgcgaggccaucaagcggaaacucagaacgcugauucuugcucccacacgcguuguggccuccgaaauggcggaggcucugaaggggaugccuauccgguaucagaccaccgccgucaaaucugaacauacaggcagagagaucguggaucucaugugccacgccaccuucacaaugcgccugcugagccccguucgggugccuaacuacaauaugauuaucauggacgaggcucauuuuaccgaucccgccuccauugcugccagaggauauaucagcacgcgggucggcaugggggaagcggccgcuauuuucaugacagccaccccuccgggaucuguggaggcuuuuccccaguccaacgccgugauccaggacgaagagcgcgauaucccugaaagaagcuggaauucuggcuacgacuggauuacagauuuccccgggaagaccgucugguuuguuccuagcaucaaauccggaaacgacauugccaauugucuccggaagaacggcaagcgcgugauccaacuuucuagaaaaacguucgacaccgaguaucagaagacaaaaaacaaugauugggacuacguggucaccacagauauuagcgagaugggggcuaacuuccgggcggacagagugaucgauccccgccggugccugaagccgguuauucugaaagacggcccugaaagagugauccucgccggacccaugcccgucaccguggcuuccgccgcccagcgccggggcagaaucgggcgcaaucagaacaaggagggagaucaauacguuuauaugggccagccucugaauaacgacgaagaucacgcucauuggacagaggccaagaugcuucuggacaauauuaacacccccgaggggaucauuccugcgcucuuugaaccggagcgggaaaaaucugcugccaucgauggagaguacagacugcgcggcgaagccagaaagacguucguggagcugaugcggcgcggggaccuccccgucuggcuuagcuauaaaguggcuuccgagggcuuucaguacagcgauagacgguggugcuucgacggagaacgcaauaaccagguccuggaggaaaauauggacguggagauuuggacaaaggaaggcgagagaaaaaagcugcggccuagauggcucgaugcccgcaccuauucugacccccuggcgcuucgggaguuuaaagaauucgccgcugggagacgcuccguuagcggagaucugauccucgagaucggcaagcugccucaacaccugacccuccgggcccagaacgcucuugacaaucuggugaugcugcacaacuccgaacaggggggaaaggccuacagacaugcuauggaggaacuccccgauacaauugagacccugaugcuucuggcccucaucgcggugcugacaggcggcgucacgcuguuuuuccucucugggaaaggacuuggcaagaccagcauugggcugcuguguguuacagccuccucugcucuccuguggauggccagcguggagccgcacuggaucgcugccuccauuauccuugaauuuuuccugauggugcuccugaucccugagcccgaccggcagcgcaccccucaagauaaucagcuggccuaugucgugauuggacuccuuuuuaugauccugacaguugcugcgaacgaaaugggccugcucgagaccacgaaaaaggaccuggggauuggacauguggccgcugagaaccaccagcacgccaccaugcuugaugucgaccugagacccgccagcgcuuggacacucuacgccguggcgaccacagucaucaccccuaugaugcggcauacgauugaaaauacaaccgccaacaucucucugacagcuauugccaaucaagcugccauccugaugggccucgauaaaggcuggcccaucuccaagauggacauuggggugccgcuucuggcgcugggaugcuacagccagguuaacccucucacccugaccgccgcugugcuuaugcuggucgcccacuaugcuaucauuggccccgggcuccaggccaaggcuacacgcgaggcccagaaaagaacggcggccggaaucaugaagaaucccaccguggauggcauuguugcuaucgaccuggacccuguggucuacgaugccaaauucgaaaagcaacuggggcagaucaugcuccuuauucuguguacaucucagauccugcucaugcggaccacaugggcucugugcgaguccauuacccuugccacgggaccgcugacaacccucugggaaggcagccccggcaaauuuuggaacaccacaaucgccgugucuauggcgaauauuuuccgcgggagcuaucuggcuggagccggccuggcuuucucccucaugaagucucuugggggaggcagacgggggaccggagcccagggcgagacacugggcgagaaguggaaacgccaacugaaccagcucagcaaguccgaauuuaauacguacaaaagaagcgggaucauggagguggaccgguccgaagccaaggagggacugaaaagaggcgaaaccacaaagcaugcuguuucucgcgggaccgccaagcuucggugguucgucgagagaaaccuggugaaaccugagggaaaggugaucgaucucggcugugggcgcggaggcuggagcuauuacugcgcgggccugaaaaaggucacagaaguuaaaggguauaccaagggaggccuggggcacgaggaacccauuccuauggccacguacggauggaaucucgugaaacuucauuccggcaaggacguguuuuucaugcccccugagaagugugauacccugcugugcgacaucggggaaucuagcccgaaccccacaauugaggagggacggacccucagaguccugaaaaugguggaaccuuggcuucgcggcaaucaguuuuguaucaagauucugaaccccuacaugccuuccguuguggagacacucgaacagaugcaacggaaacacggcgggaugcuggucagaaauccccugucucgcaacagcacccacgagauguauuggguguccugcggaacaggcaauaucguuagcgcugugaacaugaccucucggaugcuccugaacagauucacgauggcccaucgcaagccgacauacgagcgggaugucgaccuuggggcuggaaccagacacguggccguggaaccugaggucgcgaaucuggauauuaucggccagcgcaucgaaaacauuaaaaaugagcauaaguccaccuggcacuaugacgaagauaaccccuacaagacaugggccuaucacgggagcuacgagguuaaacccucuggauccgcuagcucuauggugaauggcguggucaagcuccugacgaaaccuugggacgugauccccaugguuacccagauugccaugacagacaccacaccuuuuggccaacagagaguguucaaggagaaagucgauacccggacaccgcgcgcuaagagagggaccacgcagaucauggaagugaccgccaaguggcuuuggggauuucugucccggaacaaaaagcccagaauuuguacacgggaggaauucacccgcaaaguuagaagcaaugcugccaucggcgcgguguuugucgacgagaaccaguggaauuccgccaaggaagcuguggaggaugagcgguucuggaaccucguucaucgcgaaagagagcugcacaaacaagggaagugcgccacaugcguguauaauaugaugggaaagcgggaaaaaaagcugggcgaguuugggaaagcuaagggcagccgcgccaucugguacauguggcucggagccagauuccuggaauucgaggcgcuuggcuuuaugaacgaggaccauugguucucucgggaaaauagccuguccggggucgagggagaaggccuccacaaacugggguacauucuucgcgauaucucuaagauuccuggaggcaacauguaugcugacgauaccgccgggugggacacgagaaucacagaggaugaccugcagaaugaggccaaaauuaccgauaucauggaacccgagcaugcucuccuggccacaagcaucuuuaagcugaccuaccagaacaaggugguccgggugcagcgcccugcuaaaaacggcacgguuauggacgugauuuccagacgggaucaacgcggaucuggccaggucgggaccuauggacucaauacauucaccaacauggaagugcagcugaucagacagauggagagcgaaggcauuuuucuucccuccgagcuggagacaccgaaucucgccgaacgggugcuggacuggcuugagaagcacggggcggaaagacugaaacgcauggccaucucuggagacgauuguguugugaagccuauugacgaucgguucgcuaccgcccucacagcucugaacgacaugggcaaagucagaaaggauaucccccaaugggagccuagcaagggguggaaugacuggcagcaggugcccuuuugcucccaccauuuccaccagcugaucaugaaagauggccgcgaaauuguugugccuugucggaaccaagacgagcucgucggaagagcccgcgugagccagggcgcgggguggucucugcgggagaccgccugccuuggaaaguccuacgcucagauguggcaacugauguauuuucauagacgcgaucuccggcuggccgcuaaugccaucuguagcgcuguccccguggacuggguuccgacgucuagaacaaccugguccauucacgcccaccaucaguggaugaccacagaagauaugcuuagcguguggaaccgcgucuggaucgaggaaaauccuuggauggaggacaaaacccacguguccucuugggaagagguucccuaccugggcaagcgggaggaccaguggugcgggagccucauuggacugacagcgagagccacgugggcuaccaacauccagguggccauuaaucaaguccggagacugaucggcaacgaaaauuaucucgauuacaugacauccaugaaacgcuucaagaacgagagcgaccccgaaggggcccugugguga

SEQ ID NO: 18772 - RNA, 9879 nt, Artificial Sequence
  derived and/or modified CDS sequence (opt5) from DENV-1__FJ639743__SS-prME
agcgugaccaugcugcucaugcugcuucccaccgcucuggcuuuccaccucacgacccggggcggggagccucauaugaucgucuccaagcaggaacgggggaagucucugcuuuuuaagacaagcgcuggcguuaauaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucuguugcccuggcuccucauguggggcucggacuggagacaagaaccgaaacguggaugagcuccgagggcgccuggaaacagauucagcggguugaaacaugggcccuucgccaccccggcuucaccgugauggcccuguuucucgcgcaugccaucgggacaucuauuacccagaagggaaucaucuucauucugcuuaugcuggucaccccuagcauggcuaugagaugcgugggcaucgggaaccgggauuuuguugagggacucuccggcgccacauggguggacgucgugcuggagcacgggagcugugugacgaccauggcuaagaauaaacccacacuggauauugaacuccugaagaccgaggucacaaacccugccguucuucgcaaacugugcaucgaagcgaagauuucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagaucguucaguacgaaaaccugaaauauucugugauugucacggugcacaccggcgaucagcaucaaguugggaaugagacaaccgaacacggaacaaucgcuaccaucacgccccaggccccuaccuccgagauucagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauccagaccagcggaacaaccacaauuuuugcuggccaucuuaaaugcagacugaagauggacaaacucacccugaaggggauguccuaugugauguguacgggcagcuucaaacuggagaaggaagucgccgagacacagcacggaaccgugcuuguucaggugcgguacgagggcaccgaugcgccgugcaagaucccuuucucuacacaagacgaaaaaggggucacccagaacggaagacucauuacagcuaaucccaucgugacggauaaggagaaaccugugaacaucgaaaccgagccgcccuuuggcgaguccuauauuguugucggggccggagaaaaggcccugaaacugagcugguucaagaagggcucuagcaucgggaaaauguuugaggcuacagcccgcggcgcucggagaauggccauucucggagacaccgcgugggauuucggcuccaucgggggaguguuuacaucugugggcaagcugguccaucagguguucgggaccgccuacggaguucuuuuuagcggcguguccuggacgaugaaaauugggaucggcauccugcucaccuggcugggacugaauagccgcucuacaucccuuagcaugaccuguauugcugucggcauggugacacucuaccuggggguuauggugcaggccgacucuggaugcgucaucaacuggaagggccgggaacugaaauguggguccggaauuuucgugaccaacgagguucacacauggaccgaacaauauaaguuucaggcugauagcccuaagagacucuccgccgcgaucggcaaagccugggaggagggggugugcggcauucgcucugcuacgcggcuggaaaauaucauguggaagcagauuagcaacgagcuuaaucauauccugcucgaaaacgacaugaaauucacagucguggugggagacgccaauggcauccuggcucaggggaagaaaaugauuagaccgcaacccauggagcacaaguacuccuggaaaucuuggggaaaggccaaggucaucggcgccgauauucagaacaccaccuuuaucauugacgggccugauacacccgaauguccugacggacagcgcgcuuggaauaucugggagguugaggauuauggcuucggcaucuuuaccacgaacauuuggcugaaacuucgggacagcuacacacagaugugcgaucacagacucauguccgcggccaucaaggacagcaaagcugugcaugccgauaugggguauuggauugaaucugagaagaaugaaaccuggaaacuggcccgcgcuuccuucaucgaggugaagacauguaccuggcccaagagccacacacuguggucuaacggaguccucgaauccgagaugauuaucccgaaaaucuacggcgggccuauuagccaacauaauuaucggcccggauacuucacccagacggccggcccuuggcaccuggggaaacuugagcuggacuuugaucucugcgaaggaaccacagugguuguggacgagcacugcggcaacagaggccccucucugcggaccacaaccgucacggggaaaaucauucaugaaugguguugccgcagcuguacacugccuccccuuagauuccggggagaggauggcugcugguacgggauggagaucagaccggugaaggaaaaagaggaaaaucucguucgcuccauggugagcgcgggaucuggcgaggucgacuccuuuagccuggggauucuguguguguccaucaugaucgaagagguuaugcggucuagauggagccgcaagaugcucaugaccggaacacuggcuguguuccuucugcucgucaugggccagcugaccuggaacgaccugauuagacuuugcaucauggugggcgccaaugccuccgaucggauggggaugggaaccacauaucuggcucucauggccacguuuaagaugcgcccuauguucgcggugggccugcucuuuagacggcugaccucucgcgagguccuucugcucacaauugggcugagccugguugcuuccguggaacuucccaacucucuggaggaacucggagacggccuggccauggggaucaugaugcucaaacugcuuaccgaguuccaaccccaccagcuguggacaacccuccugagccugacguuugugaagacaacccuuucccuggauuacgccuggaaaaccacagcuaugguccucagcauugugucucuguucccucucugucuguccaccacaagccagaagacgaccuggcuuccgguucugcugggaucuuuuggcugcaaaccccucacaauguuccugaucaccgaaaacaagauuuggggcagaaaguccuggccucuuaaugaggggaucauggccaucggaauugugagcauccugcucucuucccugcucaaaaacgacgucccccuggcuggcccucuuauugccgggggaaugcugaucgcguguuaugugauuagcggcuccagcgccgaucugucucucgagaaggcugccgaaguuagcugggagcaggaagcugagcauuccggggccucucacaauauccugguggaaguccaagacgauggaacaaugaaaaucaaggacgaggagcgggaugacacccuuacgauucugcucaaagccacccugcucgcugugagcggcgucuaccccauguccaucccugcgacacuguuugugugguauuucuggcagaagaaaaagcagcgcucuggcguucuuugggauacccccagcccgccugaaguggagagagccguccuggacgaugggauuuaccggauccugcagcgcggacuccugggcagaucccaaguggggguuggaguguuccaggacggcgucuuucauacaauguggcacgugaccagaggggcugugcuuauguaucagggaaagagacuggaacccucuugggccagcguuaaaaaggaccucauuuccuacggcggcggguggcgcuuccagggaagcuggaacacaggcgaggagguccaagugaucgccguggaaccugggaaaaaucccaagaacguccagacgaccccgggaacauuuaaaaccucugagggcgaagugggggcuaucgcccuggauuucaagccuggaaccuccggcagccccauuguuaaucgggagggcaagaucguggggcucuacggaaacggcgucgugacaacgucugggaccuauguuuccgcgauugcucaggccaaagccagccaagaaggaccucugcccgagaucgaggacgaaguguuuaagaaaagaaaucuuacaauuauggaucugcaccccggcuccgggaagacccgccgguaccugccugcuaucgucagagaggccauuaaacgcaagcuccggacacugauccuugcgccgaccagagugguugcuucugaaauggccgaggcccugaagggcaugcccauccgcuaucagacgacagcugugaaaagcgaacauaccggacgggagauugucgaccucaugugccacgccaccuucacaaugagacugcuguccccugugcgggugcccaacuacaauaugaucauuauggaugaggcucauuuuaccgacccugccagcaucgcggcccgcggcuauauuucuacaagagucgggaugggagaagcugccgcuaucuucaugaccgccacgcccccuggcuccguugaggccuuuccgcagagcaacgcugugauccaggaugaagaacgggacauucccgaacgcucuuggaauagcggguacgauuggaucacagacuucccuggaagaaccgugugguuuguccccuccauuaagucuggcaacgauaucgcgaauugucuccggaaaaacgggaagagagugauucaacuuagccgcaaaacauucgacaccgaguaucagaagacgaagaacaaugacugggauuacguugugaccacagacaucuccgagaugggcgccaacuuccgggcugauagagucaucgacccucgccggugccugaaacccgugauucugaaggauggaccggaaagaguuauccucgccggcccuaugcccgugaccgucgccucugcugcccagcgccgggggagaauuggacgcaaucagaacaaagagggcgaccaauacguguauauggggcagccccugaauaacgaugaagaccacgcgcauuggacagaggcuaagaugcuucuggauaauaucaacaccccugagggaauuauccccgcccucuuugaaccugagagagaaaagagcgccgcuauugacggcgaguaccggcugcgcggggaggccagaaagacauucgucgagcugaugcggcgcggcgaucucccgguguggcuuuccuauaagguugcgagcgagggauuucaguacucugacagacgguggugcuucgauggcgaaagaaauaaccaggugcuggaggaaaauauggacguggagaucuggaccaaagaaggggagcgcaagaaacugcggcccagauggcucgacgcccgcacguauuccgauccucuggcccuucgggaguuuaaggaguucgccgcuggaagacggagcgucuccggcgaccugauccucgagauugggaaacugccccaacaccugacacuccgcgcccagaacgcucuugauaaucugguuaugcugcacaacucugaacagggaggcaaggccuacagacaugcgauggaggaacucccugacaccaucgagacccugaugcuucuggcccucauugcugugcugacaggcggggugacccuguuuuuccucagcggaaaaggccuugggaagacauccaucggacugcugugugucacggccucuagcgcucuccuguggauggccuccguggagccccacuggauugccgcuagcaucauccuugaauuuuuccugaugguucuccugauuccggagccugaucggcagcgcacaccccaggacaaucagcuggcguauguggucaucggccuccuuuuuaugauucugacaguggccgcuaacgaaauggggcugcucgagaccacaaagaaagaucugggaaucggcuacgucgccgccgagaaccaucagcacgcuaccaugcuugacguggaucugagaccugccucugcguggacgcucuacgccguugcuaccacagugauuacccccaugaugcggcacacaaucgaaaauaccacggccaacaucucccugacagcuauugccaaucaagcggccauccugaugggccucgacaagggguggccuauuagcaaaauggauaucggagucccccuucuggcucugggcugcuauucucaggugaacccgcucacccugacagccgcuguucuuaugcugguggcccauuacgcuauuaucgggccuggacuccaggccaaggcgacccgcgaggcccagaaaagaaccgcugccggcauuaugaagaaucccacagucgacgggaucguggcuaucgaucuggaccccgugguuuaugacgccaaguucgaaaaacaacugggacagauuaugcuccuuauccuguguacgucccagauucugcucaugcggaccacaugggcccugugcgagagcaucacccuugcgacaggcccucugaccacgcucugggaaggcucuccggggaaguuuuggaacacaaccauugcugucagcauggccaauaucuuccgcggauccuaccuggcuggcgccgggcuggccuucucucucaugaaaagccuuggaggcgggagacggggaaccggcgcucagggcgagacacugggggagaaguggaaaagacaacugaaccagcucuccaagagcgaauuuaauaccuauaagcgcuccggaaucauggagguggaucggucugaagccaaagagggccugaagagaggggaaacaacgaaacacgcggugagccgcggaaccgccaaacuucggugguucgucgagagaaaccugguuaaacccgagggcaaggugauugaccucggguguggacgcggcggcugguccuacuauugcgcugggcugaagaaagugacagaagucaagggauacaccaaaggcgggccuggacaugaggaacccaucccuauggccacauacggcuggaaucuggugaagcuccacucugggaaagaugucuuuuucaugagccccgagaagugugacacccuucugugcgauauuggagaauccucuccuaacccgacgaucgaggagggccggacccugagagugcucaaaauggucgaacccuggcugcgcggcaaucaguuuuguauuaagauccuuaacccuuauaugcccagcgugguugagacacuggaacagaugcaacggaagcaugggggaaugcucgugagaaauccucugucccgcaacagcacccacgagauguacugggucucuugcggcacagggaauaucguguccgcugugaacaugaccagccggaugcugcucaacagauucacaauggcccaccgcaaacccaccuaugagagagacgucgaucugggagcgggcacgcggcauguugccguggaaccggaggaagcuaaucuugacauuaucgggcagcgcauugagaacaucagaaaugaacacaagucuacauggcauuacgaugaggacaacccuuauaaaaccugggccuaccacggauccuaugaggugaagcccagcggcucugcuuccagcauggucaauggcgugguucggcugcucaccaaacccugggaugugauuccuauggucacacagaucgccaugacggacaccacacccuuugggcaacagagaguguucaaggaaaagguugacacccggacaccucgcgcuaaaagaggaaccacacagauuauggaggugaccgccaaguggcuguggggcuuucuuucccggaacaaaaagccgcgcaucuguacgagagaagaguucacccggaaaguccgcagcaaugcggccaucggggcuguguuuguugaugaaaaccaguggaacucugccaaggaggcuguggaggacgaaagauucugggaucugguccaccgggagcgcgaacuccauaagcaaggaaaaugcgccacaugcguguacaacaugaugggcaagagagagaaaaagcugggggaauuuggcaaagccaagggaagccgggcgauuugguacauguggcugggcgcucgcuuccucgaguucgaggcccugggguuuaugaaugaagaccacugguucuccagagagaacucucuuagcggagucgaaggcgaggggcugcauaagcucggauauauccugcgggauauuuccaaaauccccggcgggaauauguacgccgacgauaccgcuggcugggacacacgcauuaccgaggaugaccuucagaacgaagccaagaucacggauaucauggagccugaacacgcucugcucgccacaucuauuuuuaaacugaccuaucagaauaaggugguuagagugcagcggcccgcgaaaaacggaacagucauggacgugaucagcagacgcgaucaacggggcuccggacaggugggaaccuacggccugaacacguucaccaauauggagguucagcucauuagacagauggaaucugaggggaucuuucugccuagcgagcuugaaacacccaaccuggccgagcgcgugcucgacuggcuggaaaagcauggagcugagcggcuuaaaagaauggccauuuccggcgacgauugugucgugaagccgaucgacgaucgcuucgcuaccgcccugacagcgcucaaugacauggggaagguucggaaagauaucccucaaugggaacccagcaagggcuggaacgacuggcaacaggugccuuuuugcucucaccacuuccaucagcugauuaugaaagauggaagagagaucgucgugcccugucgcaaucaagacgagcuggucggccgggccagagugucccagggggcuggauggagccuccgcgaaaccgccugccugggcaagucuuaugcucagauguggcaacuuauguacuuucaccggagagaucugcggcucgccgcuaacgccauuuguuccgcgguuccuguggacuggguccccacaagcagaaccacgugguccauccaugcccaccaccaguggaugacaaccgaggauaugcugucuguguggaaucgcguuuggauugaagagaacccguggauggaagacaaaacccaugugagcuccugggaggaggucccuuaucuugggaagcgggaagaccaguggugcggaagccugaucggccucacagcuagagccaccugggccacaaauauccagguggcuauuaaccaagugcgcagacugaucgggaaugagaacuaccuggauuacaugacgucuaugaagcgguucaaaaaugaauccgaccccgagggcgcccucugguga

SEQ ID NO: 18773 - RNA, 9879 nt, Artificial Sequence
  derived and/or modified CDS sequence (opt5) from DENV-1__FJ639794__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccccccuuuggcgaguccuauaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaucagguguucgggaccgccuacggaguucuuuuuagcggcguguccuggacgaugaagaucgggaucggcauucugcucaccuggcugggacugaauagcagaucuacaucccuuagcaugaccuguaucgucgugggcaugguuacacucuaccugggggugaugguccaggcugacucuggaugcgugauuaacuggaaaggccgcgaacugaaguguggguccggaaucuucguuaccaacgaggugcacacauggaccgaacaauauaaguuucaggccgauagcccuaaacggcucuccgcugccauuggcaaggcgugggaggagggggucugcggcaucagaucugccacgcgccuggaaaauauuauguggaaacagaucagcaacgagcuuaaucauauccugcucgaaaacgacaugaaguucacagugguggucggagacgcuaauggcauucuggcccaggggaaaaagaugauccggccgcaacccauggagcacaaauacuccuggaagucuuggggaaaggcuaaaauuaucggcgccgauauucagaacaccaccuuuaucaucgacgggccugauacacccgaauguccugacggacagagagccuggaauauuugggagguugaggauuauggcuucggcaucuuuaccacgaacauuuggcugaagcuucgcgacagcuacacacagaugugcgaucaccggcucauguccgcugcgaucaaagacagcaaggccgugcaugcugauaugggguauuggauugaaucugagaaaaaugaaaccuggaagcuggccagagccuccuucaucgaggugaagacauguaccuggcccaaaagccacacacuguggucuaacggaguccucgaauccgagaugaucauuccgaagaucuacggcgggccuauuagccaacauaauuaucgccccggauacuucacccagacggcuggcccuuggcaccuggggaaacuugagcuggacuuugaucucugcgaaggaaccacagugguuguggacgagcacugcggcaaccggggccccucucugagaaccacaaccgucacggggaagaucauucaugaaugguguugccggagcuguacacugccuccccuucgcuucagaggagaggauggcugcugguacgggauggagauccggccggugaaagaaaaggaggaaaaucucguuagauccauggugagcgccggaucuggcgaggucgacuccuuuagccuggggauccuguguguguccauuaugaucgaagagguuaugcgcucucgguggagcagaaagaugcucaugaccggaacacuggcgguguuccuucugcucauuaugggccagcugaccuggaacgaccugauccgccuuugcauuauggucggcgcuaaugccuccgauagaauggggaugggaaccacauaucuggcccucauggcuacguuuaaaaugcggccuauguucgccgugggccugcucuuucgcagacugaccucucgggaggugcuucugcucacaaucgggcugagccuggucgcguccguugaacuucccaacucucuggaggaacucggagacggccuggcuauggggauuaugaugcucaagcugcuuaccgaguuccaaccccaccagcuguggacaacccuccugagccugacguuugugaaaacaacccuuucccuggauuacgccuggaagaccacagccauggugcucagcaucgucucucuguucccucucugucuguccaccacaagccagaaaacgaccuggcuuccggugcugcugggaucuuuuggcugcaagccccucacaauguuccugaucaccgaaaacaagauuuggggccgcaaauccuggccucuuaaugaggggaucauggcuauuggaaucguuagcauucugcucucuucccugcucaagaacgacgugccccuggccggcccucuuaucgcugggggaaugcugaucgccuguuaugucauuagcggcuccagcgcggaucugucucucgagaaagccgcugaagugagcugggagcaggaagccgagcauuccggggcuucucacaauauccugguugaagugcaagacgauggaacaaugaagauuaaagacgaggagagagaugacacccuuacgauccugcucaaggccacccugcucgccgucagcggcguguaccccauguccauuccugcuacacuguuugucugguauuucuggcagaaaaagaagcagcggucuggcgugcuuugggauacccccagcccgccugaaguugagcgcgcggugcuggacgaugggaucuacagaauccugcagcggggacuccugggccgcucccaagucggggugggaguuuuccaggacggcguguuucauacaauguggcacgucaccagaggggccgugcuuauguaucagggaaaacggcuggaacccucuugggcuagcgugaagaaagaccucauuuccuacggcggcggguggagauuccagggaagcuggaacacaggcgaggagguucaagucaucgccguggaaccugggaagaaucccaaaaacgugcagacgaccccgggaacauuuaagaccccugagggcgaagucggggccauugcucuggauuucaagcccggaaccucuggcuccccuaucgugaaucgcgagggcaaaauuguugggcucuacggaaacggcguggucacaacgagcgggaccuaugugucugccaucgcgcaggcuaaggccucccaagaaggaccccugcccgagauugaggacgaaguuuuuaaaaagcggaaucuuacaaucauggaucugcacccuggcagcgggaaaaccagacgcuaccugccggccaucgugcgggaggcuauuaagagaaagcuccgcacacugauccuugcccccacccgggucguggcguccgaaauggcugaggcccugaaaggcaugccuauuagauaucagacgacagccguuaagucugaacauaccggacgcgagaucguggaccucaugugccacgcuaccuucacaaugcggcugcugagccccgucagagugccuaacuacaauaugauuaucauggaugaggcccauuuuaccgaccccgcuuccaucgccgcgcggggcuauauuagcacacgcguggggaugggagaagccgcugccaucuucaugaccgcuacgccuccgggcucugucgaggccuuuccccaguccaacgccguuauucaggaugaagagagagacaucccugaacggagcuggaaucucggguacgauuggauuacagacuuccccggaaaaaccgugugguuugugccuucuaucaagagcggcaacgauaucgcuaauugucuucgcaaaaacgggaagagagucauucaacugucccggaagacauucgacaccgaguaucagaaaacgaagaacaaugacugggauuacgugguuaccacagacaucucugagaugggcgcgaacuucagagccgaucgcgugauugacccccggagaugccugaaaccggucauccucaaggauggaccugaacgcgugauucuggcuggccccaugcccguuaccguggccagcgccgcucagcggagagggcgcaucggacggaaucagaacaaagagggcgaccaauacgucuauauggggcagccucuuaauaacgaugaagaccacgcccauuggacagaggcgaagaugcugcucgauaauauuaacacccccgagggaaucaucccugcucuguuugaaccggagagagaaaaguccgccgccauugacggcgaguaccgccugagaggggaagcucggaaaacauucguggagcucaugcgcagaggcgaucuucccgucuggcugucuuauaagguggccagcgagggauuucaguacuccgaccggcgcuggugcuucgauggcgaaagaaauaaccagguucuggaggaaaauauggacguggagaucuggaccaaagaaggggagcggaagaaacucagaccucgcuggcuggacgcgcggacguauagcgauccccuugcccugagagaguuuaaggaauucgcugccggacgccggucuguguccggcgaccucauucuggagaucgggaaacugccucaacaccucacacuuagagcucagaacgcccuggauaaucuggucaugcuccacaacagcgaacagggaggcaaggcuuaccggcaugccauggaggaacugcccgacaccauugagacccuuaugcugcucgcgcugaucgccguucugacaggcggggugacccucuuuuuccuuuccggaaagggccuggggaaaacaucuaucggacugcucugugugacggcuagcuccgcccugcuuuggauggcuucugucgagccgcacuggauugccgccagcaucauucuggaauuuuuccucauggugcugcugaucccugagcccgaucgccagagaaccccucaagacaaucagcucgcuuauguugugauuggccuucuguuuaugauccugacagucgcggccaacgaaauggggcuccuggagaccacaaagaaagaucuuggaaucggcuacguggcugccgagaaccaucagcacgccaccaugcuggacgucgaucuccggcccgcuuccgccuggacgcuguacgcgguggccaccacaguuauuaccccuaugaugcgccacacaaucgaaaauaccacggcuaacauuagccugacagccaucgcuaaucaagccgcgauucucaugggccuugacaagggguggcccaucucuaaaauggauauuggagugccgcugcuggcccucggcugcuauucccaggucaacccucugacccuuacagcugccgugcugaugcucguugcucauuacgccaucaucgggcccggacugcaggcuaaggccaccagagaggcgcagaagcggaccgccgcuggcauuaugaaaaaucccacaguggacgggaucgucgccauugaucuggacccugugguguaugacgcuaaguucgaaaaacaacucggacagaucaugcuucugauucuguguacgagccagauccuccugaugcgcaccacaugggcccuuugcgagucuaucacccuggccacaggcccgcucaccacgcugugggaaggcucccccgggaaguuuuggaacacaaccauugcgguuagcauggcuaauaucuucagaggaucuuaccuggccggcgcugggcucgccuucagccuuaugaaaucccugggaggcgggcggcgcggaaccggcgcccagggcgagacacugggggagaaguggaagagacaacucaaccagcugucuaaaagcgaauuuaauaccuauaagcgguccggaauuauggaggucgauagaagcgaagcuaaagagggccuuaagcgcggggaaacaacgaaacacgccgugucccggggaaccgcgaagcugagaugguucguggagcgcaaccucgucaagccugagggcaaaguuaucgaccugggguguggacggggcggcuggucuuacuauugcgccgggcugaagaaagugacagaagugaagggauacaccaaaggcgggcccggacaugaggaaccuauucccauggcuacauacggcuggaaucucgucaagcuucacagcgggaaagauguguuuuucaugccuccggagaagugugacacccugcugugcgauaucggagaauccucucccaacccuacgaucgaggagggcagaacccuccgcguucugaagaugguggaacccuggcuuaaaggcaaucaguuuuguauuaagauccugaacccuuauaugcccagcgucguggagacacucgaacagaugcaacggaaacaugggggaaugcugguuagaaauccgcugucccgcaacucuacccacgagauguacugggugagcugcggcacagggaauauugucuccgccgugaacaugaccagccggaugcuccugaacagauucacaauggugcaccgcaagccuaccuaugagcgggacgucgaucuuggagcuggcacgagacauguugccguggaacccgagguggcgaaucuggacaucauugggcagcgcaucgaaaacauuaaaaaugagcacaagucuacauggcauuacgaugaagacaaccccuauaagaccugggccuaccacggauccuaugaggucaaaccuagcggcucugcuuccagcauggugaauggcguugugagacuccugaccaagcccugggaugucaucccuauggugacacagaucgccaugacggacaccacaccguuugggcaacagcggguuuucaaagagaagguggacacccgcacacccagagcuaaacggggaaccacacagauuauggaagucaccgccaaguggcuuuggggcuuucugucuagaaacaagaaaccucggaucuguacgcgcgaggaauucaccagaaaggugcgguccaaugcugccauuggggcgguuuuuguggaugagaaccaguggaauagcgccaaagaagcugucgaggacgagcgcuucugggaucucgugcacagagaacgggagcugcauaagcaaggaaaaugcgccacaugcgucuacaacaugaugggcaagcgcgaaaagaaacugggggaguuuggcaaggcuaaaggauccagagccaucugguacauguggcucggcgcccgguuccuggaauucgaggcgcuuggguuuaugaaugaggaccacugguucagccgcgaaaacucucugagcggaguggagggcgaagggcuccauaagcugggauauauucuuagagauaucuccaaaauccccggcgggaauauguacgcugacgauaccgccggcugggacacacggauuaccgaggaugaccugcagaacgaggccaagaucacggauauuauggaaccugagcacgcucuccuggccacaucuaucuuuaaacugaccuaucagaauaagguugugcgcguccagagacccgcuaagaacggaacagugauggacgugauuagccggcgcgaucaaagaggcuccgggcagguuggaaccuacggccucaacacguucaccaauauggaagugcagcugauccggcagauggagucugaagggaucuuucuuccgagcgagcuggagacaccuaaccucgccgaaagaguccuggacuggcuugagaaacauggagcggaacgccugaagcggauggccauuuccggcgacgauugugugguuaaacccaucgacgauagauucgcuaccgcccucacagcucugaaugacauggggaaggugcgcaaagauauuccucaaugggagcccucuaagggcuggaacgacuggcagcaggucccuuuuugcagccaccacuuccaucagcuggugaugaaggauggacgggaaaucgucgugcccuguagaaaucaagacgagcucguuggccgcgcccgggugucccagggggcgggauggagccugagagagaccgccugccuuggcaaaucuuaugcucagauguggcaacugauguacuuucaccgccgggaucucagacuggccgcuaacgccauuuguuccgcugucccgguggacuggguuccuacaagccgcaccacguggucuauccaugcccaccaccaguggaugacaaccgaagauaugcuuuccguguggaaucgggucuggaucgaggaaaaccccuggauggaggacaagacccaugugagcuccugggaagaggugcccuaucuggggaaaagagaggaccaguggugcggaucucucauuggccugacagcgcgggccaccugggcuacaaauauccagguugccauuaaccaagucagacgccugaucgggaaugaaaacuaccucgauuacaugacgagcaugaagcgguucaaaaaugaguccgacccugaaggcgcccugugguga

SEQ ID NO: 18774 - RNA, 9879 nt, Artificial Sequence
  derived and/or modified CDS sequence (opt5) from DENV-1__FJ639796__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccccccuuuggcgaguccuauaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaucagguguucgggaccgccuacggaguucuuuuuagcggcguguccuggacgaugaagaucgggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuucgugaccaacgagguucacacauggaccgaacaauauaaguuucaggcugauagcccuaaacggcucuccgccgcgauuggcaaggccugggaggagggggugugcggcaucagaucugcuacgcgccuggaaaauauuauguggaaacagaucagcaacgagcuuaaucauauccugcucgaaaacgacaugaaguucacagucguggugggagacgccaauggcauucuggcucaggggaaaaagaugauccggccgcaacccauggagcacaaauacuccuggaagucuuggggaaaggccaaaauuaucggcgccgauauucagaacaccaccuuuaucaucgacgggccugauacacccgaauguccugacggacagagagcuuggaauauuugggaggucgaggauuauggcuucggcaucuuuaccacgaacauuuggcugaagcuucgcgacagcuacacacagaugugcgaucaccggcucauguccgcggccaucaaagacagcaaggcuguucaugccgauaugggguauuggauugaaucugagaaaaaugaaaccuggaagcuggccagagcuuccuucaucgaggugaagacauguaccuggcccaaaagccacacacuguggucuaacggagugcucgaauccgagaugaucauuccgaagaucuacggcgggccuauuagccaacauaauuaucgccccggauacuucacccagacggccggcccuuggcaccuggggaaacuugagcuggacuuugaucucugcgaaggaaccacagucgugguugacgagcacugcggcaaccggggccccucucugagaaccacaaccgugacggggaagaucauucaugaaugguguugccggagcuguacacugccuccccuucgcuucagaggagaggauggcugcugguacgggauggagauccggccggucaaagaaaaggaggaaaaucucgugagauccaugguuagcgcgggaucuggcgagguggacuccuuuagccuggggauccugugugucuccauuaugaucgaagaggugaugcgcucucgguggagcagaaagaugcucaugaccggaacacuggcuguuuuccuucugcucauuaugggccagcugaccuggaacgaccugauccgccuuugcauuauggugggcgccaaugccuccgauagaauggggaugggaaccacauaucuggcucucauggccacguuuaaaaugcggccuauguucgcggucggccugcucuuucgcagacugaccucucgggaggugcuucugcucacaaucgggcugagccugguggcuuccgucgaacuucccaacucucuggaggaacucggagacggccuggccauggggauuaugaugcucaagcugcuuaccgaguuccaaccccaccagcuguggacaacccuccugagccugacguuuguuaaaacaacccuuucccuggauuacgccuggaagaccacagcuauggugcucagcaucgugucucuguucccucucugucuguccaccacaagccagaaaacgaccuggcuuccgguccugcugggaucuuuuggcugcaagccccucacaauguuccugaucaccgaaaacaagauuuggggccgcaaauccuggccucuuaaugaggggaucauggccauuggaaucgugagcauucugcucucuucccugcucaagaacgacguuccccuggcuggcccucuuaucgccgggggaaugcugaucgcguguuaugugauuagcggcuccagcgccgaucugucucucgagaaagcugccgaagucagcugggagcaggaagcugagcauuccggggccucucacaauauccugguggaaguucaagacgauggaacaaugaagauuaaagacgaggagagagaugacacccuuacgauccugcucaaggccacccugcucgcugugagcggcgucuaccccauguccauuccugcgacacuguuugugugguauuucuggcagaaaaagaagcagcggucuggcguccuuugggauacccccagcccgccugaaguggagcgcgccguucuggacgaugggaucuacagaauccugcagcggggacuccugggccgcucccaagugggggucggaguguuccaggacggcguuuuucauacaauguggcacgugaccagaggggcuguccuuauguaucagggaaaacggcuggaacccucuugggccagcgugaagaaagaccucauuuccuacggcggcggguggagauuccagggaagcuggaacacaggcgaggaggugcaaguuaucgccgucgaaccugggaagaaucccaaaaacgugcagacgaccccgggaacauuuaagaccccugagggcgaagugggggcuauugcccuggauuucaagcccggaaccucuggcuccccuaucgucaaucgcgagggcaaaauuguggggcucuacggaaacggcguugugacaacgagcgggaccuaugucucugcgaucgcucaggccaaggccucccaagaaggaccccugcccgagauugaggacgaaguguuuaaaaagcggaaucuuacaaucauggaucugcacccuggcagcgggaaaaccagacgcuaccugccggcuaucguucgggaggccauuaagagaaagcuccgcacacugauccuugcgcccacccggguggucgcuuccgaaauggccgaggcccugaaaggcaugccuauuagauaucagacgacagcugugaagucugaacauaccggacgcgagaucguugaccucaugugccacgccaccuucacaaugcggcugcugagccccgugagagucccuaacuacaauaugauuaucauggaugaggcucauuuuaccgaccccgccuccaucgcggcccggggcuauauuagcacacgcguggggaugggagaagcugccgcuaucuucaugaccgccacgccuccgggcucuguggaggccuuuccccaguccaacgcugucauucaggaugaagagagagacaucccugaacggagcuggaauucuggguacgauuggauuacagacuuccccggaaaaaccguuugguuugugccuagcaucaaguccggcaacgauaucgcgaauugucuccgcaaaaacgggaagagagugauucaacuuucucggaagacauucgacaccgaguaucagaaaacgaagaacaaugacugggauuacgucgugaccacagacaucagcgagaugggcgccaacuucagagcugaucgcguuauugacccccggagaugccugaaaccggugauccugaaggauggaccugaacgcgucauucucgccggccccaugcccgugaccguugccuccgcugcccagcggagagggcgcaucggacggaaucagaacaaagagggcgaccaauacguguauauggggcagccucugaauaacgaugaagaccacgcgcauuggacagaggcuaagaugcuucuggauaauauuaacacccccgagggaaucaucccugcccucuuugaaccggagagagaaaagucugccgcuauugacggcgaguaccgccugagaggggaagcccggaaaacauucgucgagcugaugcgcagaggcgaucuccccguguggcuuagcuauaaggucgcguccgagggauuucaguacagcgaccggcgcuggugcuucgauggcgaaagaaauaaccaggugcuggaggaaaauauggacguugagaucuggaccaaagaaggggagcggaagaaacugagaccucgcuggcucgacgcccggacguauucugauccccuggcucuuagagaguuuaaggaauucgccgcuggacgccgguccgugagcggcgaccugauucucgagaucgggaaacugccucaacaccugacacucagagcccagaacgcucuugauaaucuggugaugcugcacaacuccgaacagggaggcaaggccuaccggcaugcgauggaggaacuccccgacaccauugagacccugaugcuucuggcccucaucgcuguccugacaggcgggguuacccuguuuuuccucucuggaaagggccuugggaaaacaagcaucggacugcugugugugacggccuccucugcucuccuguggauggccagcguggagccgcacuggauugccgcuuccaucauucuugaauuuuuccugaugguccuccugaucccugagcccgaucgccagagaaccccucaagacaaucagcuggcguaugugguuauuggccuccuuuuuaugauccugacaguggccgcuaacgaaauggggcugcucgagaccacaaagaaagaucugggaaucggcuacgucgccgccgagaaccaucagcacgcuaccaugcuugacguggaucugcggcccgccagcgcguggacgcucuacgccgucgcuaccacagugauuaccccuaugaugcgccacacaaucgaaaauaccacggccaacauuucucugacagcuaucgccaaucaagcggccauucugaugggccucgacaagggguggcccaucuccaaaauggauauuggaguuccgcuucuggcucugggcugcuauagccaggugaacccucucacccugacagccgcuguccuuaugcugguggcccauuacgcuaucaucgggcccggacuccaggccaaggcgaccagagaggcccagaagcggaccgcugccggcauuaugaaaaaucccacaguugacgggaucguggcuauugaucuggacccugucguguaugacgccaaguucgaaaaacaacugggacagaucaugcuccuuauucuguguacgucucagauccugcucaugcgcaccacaugggcccugugcgaguccaucacccuugcgacaggcccgcugaccacgcucugggaaggcagccccgggaaguuuuggaacacaaccauugcugugucuauggccaauaucuucagaggaagcuaccuggcuggcgccgggcuggccuucucccucaugaaaucucuuggaggcgggcggcgcggaaccggcgcucagggcgagacacugggggagaaguggaagagacaacugaaccagcucagcaaauccgaauuuaauaccuauaagcggagcggaauuauggagguugauagauccgaagccaaagagggccugaagcgcggggaaacaacgaaacacgcggucucucggggaaccgccaagcuuagaugguucguggagcgcaaccuggugaagccugagggcaaagucaucgaccucggguguggacggggcggcuggagcuacuauugcgcugggcugaagaaaguuacagaagugaagggauacaccaaaggcgggcccggacaugaggaaccuauucccauggccacauacggcuggaaucuggugaagcuccacuccgggaaagaugucuuuuucaugccuccggagaagugugacacccuucugugcgauaucggagaaucuagccccaacccuacgaucgaggagggcagaacccugcgcgugcucaagaugguugaacccuggcugaaaggcaaucaguuuuguauuaagauccuuaacccuuauaugcccuccguggucgagacacuggaacagaugcaacggaaacaugggggaaugcucgugagaaauccgcugucucgcaacagcacccacgagauguacuggguuuccugcggcacagggaauauugugagcgcugucaacaugaccucucggaugcugcucaacagauucacaauggcccaccgcaagccuaccuaugagcgggacguggaucugggagcgggcacgagacauguggccgucgaacccgagguugcuaaucuugacaucauugggcagcgcaucgaaaacauuaaaaaugagcacaaguccacauggcauuacgaugaagacaaccccuauaagaccugggccuaccacggaagcuaugaggugaaaccuucuggcuccgcuagcucuauggugaauggcgucgugagacugcucaccaagcccugggauguuaucccuauggugacacagaucgccaugacggacaccacaccguuugggcaacagcgggucuucaaagagaagguggacacccgcacacccagagcuaaacggggaaccacacagauuauggaaguuaccgccaaguggcuguggggcuuucuuuccagaaacaagaaaccucggaucuguacgcgcgaggaauucaccagaaaggugcggagcaaugcggccauuggggcugucuuuguggaugagaaccaguggaauuccgccaaagaagcuguugaggacgagcgcuucugggaucuggugcacagagaacgggagcuccauaagcaaggaaaaugcgccacaugcgucuacaacaugaugggcaagcgcgaaaagaaacugggggaguuuggcaaggccaaaggaagcagagcgaucugguacauguggcugggcgcucgguuccucgaauucgaggcccugggguuuaugaaugaggaccacugguucucucgcgaaaacagccuuuccggaguggagggcgaagggcugcauaagcucggauauauucugagagauaucucuaaaauccccggcgggaauauguacgccgacgauaccgcuggcugggacacacggauuaccgaggaugaccuucagaacgaggccaagaucacggauauuauggaaccugagcacgcucugcucgccacaagcaucuuuaaacugaccuaucagaauaaggucgugcgcguucagagacccgcgaagaacggaacagugauggacgucauuucccggcgcgaucaaagaggcucugggcaggugggaaccuacggccugaacacguucaccaauauggaagugcagcucauccggcagauggagagcgaagggaucuuucugccguccgagcuugagacaccuaaccuggccgaaagaguucucgacuggcuggagaaacauggagcugaacgccuuaagcggauggccauuucuggcgacgauuguguggucaaacccaucgacgauagauucgcuaccgcccugacagcgcucaaugacauggggaaggugcgcaaagauauuccucaaugggagcccagcaagggcuggaacgacuggcagcagguuccuuuuugcucccaccacuuccaucagcugaucaugaaggauggacgggaaauugugguccccuguagaaaucaagacgagcuggugggccgcgcccgggucagccagggggcuggauggucucucagagagaccgccugccugggcaaauccuaugcucagauguggcaacuuauguacuuucaccgccgggaucugagacucgccgcuaacgccaucuguagcgcggugccgguugacugggugccuacaucucgcaccacgugguccauccaugcccaccaccaguggaugacaaccgaagauaugcugagcgucuggaaucggguguggauugaggaaaaccccuggauggaggacaagacccauguuuccucuugggaagaggugcccuaucuugggaaaagagaggaccaguggugcggaagccugaucggccucacagcucgggccaccugggccacaaauauucaggucgcuaucaaccaagugagacgccugauugggaaugaaaacuaccuggauuacaugacguccaugaagcgguucaaaaaugagagcgacccugaaggcgcccucugguga

SEQ ID NO: 18775 - RNA, 9879 nt, Artificial Sequence
  derived and/or modified CDS sequence (opt5) from DENV-1__FJ639797__SS-prME
agcgugaccaugcugcucaugcugcuucccaccgcucuggcuuuccaccucacgacccggggcggggaaccucauaugaucgucuccaagcaggaacgggggaaaucucugcuuuuuaagacaagcgccggcguuaauaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccaaaccggcgagcaccggcgggacaagcgcucugucgcccuggcuccucauguggggcucggacuggagacacggaccgaaacguggaugagcuccgagggcgccuggaaacagauucagcggguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaucgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccgcccuuuggcgaguccuauaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaucagguguucgggaccgccuacggaguucuuuuuagcggcguguccuggacgaugaagaucgggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuucgugaccaacgagguucacacauggaccgaacaauauaaguuucaggcugauagcccuaaacggcucuccgccgcgauuggcagagccugggaggagggggugugcggcauccgcucugcuacgcggcuggaaaauauuauguggaagcagaucagcaacgagcuuaaucauauccugcucgaaaacgacaugaaauucacagucguggugggagacgccaauggcauucuggcucaggggaagaaaaugaucagaccgcaacccauggagcacaaguacuccuggaaaucuuggggaaaggccaagauuaucggcgccgauauucagaacaccaccuuuaucaucgacgggccugauacacccgaauguccugacggacagcgcgcuuggaauauuugggaggucgaggauuauggcuucggcaucuuuaccacgaacauuuggcugaaacuucgggacagcuacacacagaugugcgaucacagacucauguccgcggccaucaaggacagcaaagcuguucaugccgauaugggguauuggauugaaucugagaagaaugaaaccuggaaacuggcccgcgcuuccuucaucgaggugaagacauguaucuggcccaagagccacacccuguggucuaacggagugcucgaauccgagaugauuaucccgaaaauuuacggcgggccuaucagccaacauaauuaucggcccggauacuucacacagaccgccggcccuuggcaccuggggaaacuugagcuggacuuugaucucugcgaaggaacgaccgucgugguugacgagcacugcggcaacagaggccccucucugcggacaaccacagugaccgggaaaauuauccaugaaugguguugccgcagcuguacgcugccuccccuuagauuccggggagaggauggcugcugguacgggauggagaucagaccggucaaggaaaaagaggaaaaucucgugcgcuccaugguuagcgcgggaucuggcgagguggacuccuuuagccuggggauucugugugucuccaucaugauugaagaggugaugcggucuagauggagccgcaagaugcucaugacaggaacccuggcuguuuuccuucugcucaucaugggccagcugacauggaacgaccugauuagacuuugcaucauggugggcgccaaugccuccgaucggauggggaugggaaccaccuaucuggcucucauggccacauuuaagaugcgcccuauguucgcggucggccugcucuuuagacggcugacgucucgcgaggugcuucugcucaccauugggcugagccugguggcuuccgucgaacuucccaacucucuggaggaacucggagacggccuggccauggggaucaugaugcucaaacugcuuacagaguuccaaccccaccagcuguggaccacacuccugagccugaccuuuguuaagacgacacuuucccuggauuacgccuggaaaaccaccgcuauggugcucagcaucgugucucuguucccucucugucuguccacaaccagccagaagacaacguggcuuccgguccugcugggaucuuuuggcugcaaaccccucaccauguuccugauuacagaaaacaagaucuggggcagaaaguccuggccucuuaaugaggggauuauggccaucggaauugugagcauccugcucucuucccugcucaaaaacgacguuccccuggcuggcccucuuaucgccgggggaaugcugauugcguguuaugugaucagcggcuccagcgccgaucugucucucgagaaggcugccgaagucagcugggagcaggaagcugagcauuccggggccucucacaauauucugguggaaguucaagacgauggaaccaugaaaaucaaggacgaggagcgggaugacacacuuaccauucugcucaaagccacgcugcucgcugugagcggcgucuaccccauguccaucccugcgacccuguuugugugguauuucuggcagaagaaaaagcagcgcucuggcguccuuugggauacacccagcccgccugaaguggagagagccguucuggacgaugggaucuaccggauucugcagcgcggacuccugggcagaucccaagugggggucggaguguuccaggacggcguuuuucauaccauguggcacgugacaagaggggcuguccuuauguaucagggaaagagacuggaacccucuugggccagcgugaaaaaggaccucaucuccuacggcggcggguggcgcuuccagggaagcuggaacaccggcgaggaggugcaaguuauugccgucgaaccugggaaaaaucccaagaacgugcagacaacgccgggaaccuuuaaaacaccugagggcgaagugggggcuaucgcccuggauuucaagcccggaaccucuggcuccccuauugucaaucgggagggcaagaucguggggcucuacggaaacggcguugugaccacaagcgggacguaugucucugcgauugcucaggccaaagccucccaagaaggaccccugcccgagaucgaggacgaaguguuuaagaaaagaaaucuuaccaucauggaucugcacccuggcagcgggaagacacgccgguaccugccggcuauuguuagagaggccaucaaacgcaagcuccggacccugauucuugcgcccacaagaguggucgcuuccgaaauggccgaggcccugaagggcaugccuauccgcuaucagaccacggcugugaaaucugaacauacaggacgggagauuguugaccucaugugccacgccaccuucaccaugagacugcugagccccgugcgggucccuaacuacaauaugaucaucauggaugaggcucauuuuacagaccccgccuccauugcggcccgcggcuauaucagcaccagaguggggaugggagaagcugccgcuauuuucaugacagccaccccuccgggcucuguggaggccuuuccccaguccaacgcugucauccaggaugaagaacgggacauuccugaacgcagcuggaacucuggguacgauuggaucacggacuuccccggaaagacaguuugguuugugccuagcaucaaauccggcaacgauauugcgaauugucucagaaagaacgggaaacgggugauccaacuuucuagaaagaccuucgacacagaguaucagaagaccaaaaacaaugacugggauuacgucgugacgaccgacauuagcgagaugggcgccaacuuccgcgcugaucggguuaucgaccccagacgcugccugaagccggugauucugaaagauggaccugaacgggucauccucgccggccccaugcccgugacaguugccuccgcugcccagagacgcgggcggauuggaagaaaucagaacaaggagggcgaccaauacguguauauggggcagccucugaauaacgaugaagaccacgcgcauuggaccgaggcuaaaaugcuucuggauaauaucaacacacccgagggaaucauuccugcccucuuugaaccggagcgcgaaaagucugccgcuaucgacggcgaguacagacugagaggggaagcccgcaagaccuucgucgagcugaugagacggggcgaucuccccguguggcuuagcuauaaagucgcguccgagggauuucaguacagcgaccgcagauggugcuucgauggcgaacggaauaaccaggugcuggaggaaaauauggacguugagauuuggacaaaggaaggggagcgcaagaagcugcgcccucgguggcucgacgccagaaccuauucugauccccuggcccuucgcgaguuuaaagaguucgccgcuggacggagauccgugagcggcgaccugauccucgagauugggaagcugccucaacaccugacgcuccgggcccagaacgcucuugauaaucuggugaugcugcacaacuccgaacagggaggcaaagccuaccgccaugcgauggaggaacuccccgacacaaucgagacccugaugcuucuggcccucaucgcuguccugaccggcgggguuacacuguuuuuccucucuggaaagggccuugggaagaccagcauuggacugcugugugugacagccuccucugcucuccuguggauggccagcguggagccgcacuggaucgccgcuuccauuauccuugaauuuuuccugaugguccuccugauuccugagcccgauagacagcggacgccucaagacaaucagcuggcguaugugguuaucggccuccuuuuuaugauccugaccguggccgcuaacgaaauggggcugcucgagacaaccaaaaaggaucugggaauuggcuacgucgccgccgagaaccaucagcacgcuacaaugcuugacguggaucugcgccccgccagcgcguggacccucuacgccgucgcuacgaccgugaucacaccuaugaugagacacaccauugaaaauacaaccgccaacaucucucugacggcuauugccaaucaagcggccauccugaugggccucgacaaaggguggcccauuuccaagauggauaucggaguuccgcuucuggcucugggcugcuauagccaggugaacccucucacacugaccgccgcuguccuuaugcugguggcccauuacgcuaucauugggcccggacuccaggccaaagcgacacgggaggcccagaagcgcaccgcugccggcaucaugaagaaucccaccguugacgggauuguggcuaucgaucuggacccugucguguaugacgccaaauucgaaaagcaacugggacagauuaugcuccuuauccuguguacaucucagauccugcucaugagaacgaccugggcccugugcgaguccauuacacuugcgaccggcccgcugacaacccucugggaaggcagccccgggaaauuuuggaacacgacaaucgcugugucuauggccaauauuuuccggggaagcuaccuggcuggcgccgggcuggccuucucccucaugaagucucuuggaggcgggcgcagaggaaccggcgcucagggcgagacccugggggagaaauggaagcggcaacugaaccagcucagcaaguccgaauuuaauacauauaaaagaagcggaaucauggagguugaucgcuccgaagccaaggagggccugaaaagaggggaaaccacaaagcacgcggucucuagaggaacggccaaacuucgcugguucguggagcggaaccuggugaagccugagggcaaggucauugaccucggguguggaagaggcggcuggagcuacuauugcgcugggcugaaaaagguuaccgaagugaaaggauacacaaagggcgggcccggacaugaggaaccuauccccauggccaccuacggcuggaaucuggugaaacuccacuccgggaaggaugucuuuuucaugccuccggagaaaugugacacacuucugugcgauaucggagaaucuagccccaacccuaccauugaggagggccgcacgcugcgggugcucaagaugguugaacccuggcugaagggcaaucaguuuuguaucaaaauucuuaacccuuauaugcccuccguggucgagacccuggaacagaugcaaagaaagcaugggggaaugcucgugcgcaauccgcugucucggaacagcacacacgagauguacuggguuuccugcggcaccgggaauaucgugagcgcugucaacaugacaucuagaaugcugcucaaccgcuucaccauggcccaccggaaaccuacauaugagagagacguggaucugggagcgggcacccgccauguggccgucgaacccgagguugcuaaucuugacauuaucgggcagagaauugaaaacaucaagaaugagcacaaauccacguggcauuacgaugaagacaaccccuauaagacaugggccuaccacggaagcuaugaggugaagccuucuggcuccgcuagcucuauggugaauggcgucgugcggcugcucaccaaacccugggauguuaucccuauggugacccagauugccaugacagacacgaccccguuugggcaacagcgcgucuucaaggagaaaguggacacaagaacaccccgggcuaagagaggaacaacccagaucauggaaguuacagccaaauggcuguggggcuuucuuucccggaacaagaagccucgcauuuguaccagagaggaguucacgcggaaagugcgcagcaaugcggccaucggggcugucuuuguggaugagaaccaguggaacuccgccaaggaagcuguugaggacgagagauucugggaucuggugcaccgggaacgcgagcuccauaaacaaggaaagugcgcgaccugcgucuacaacaugaugggcaaaagagaaaagaagcugggggaguuuggcaaagccaagggaagccgggccauuugguacauguggcugggcgcucgcuuccucgaguucgaggcccugggguuuaugaaugaggaccacugguucucuagagaaaacagccuuuccggaguggagggcgaagggcugcauaaacucggauauauccugcgggauaucucuaagauucccggcgggaauauguacgccgacgauacagcuggcugggacacccgcaucacagaggaugaccuucagaacgaggccaaaauuaccgauaucauggaaccugagcacgcucugcucgccacgagcauuuuuaagcugacauaucagaauaaagucgugagaguucagcggcccgcgaagaacggaaccgugauggacgucaucucccgcagagaucaacggggcucuggacaggugggaacauacggccugaacaccuucacgaauauggaagugcagcucaucagacagauggagagcgaagggauuuuucugccguccgagcuugagaccccuaaccuggccgaacgcguucucgacuggcuggagaagcauggagcugaacggcuuaaaagaauggccaucucuggcgacgauuguguggucaagcccauugacgaucgcuucgcuacagcccugaccgcgcucaaugacauggggaaagugcggaaggauaucccucaaugggagcccagcaaaggcuggaacgacuggcagcagguuccuuuuugcucccaccacuuccaucagcugauuaugaaggauggaagagaaaucgugguccccugucgcaaucaagacgagcuggugggccgggccagagucagccagggggcuggauggucucuccgcgagacagccugccugggcaaguccuaugcucagauguggcaacuuauguacuuucaccggagagaucugcgccucgccgcuaacgccaucuguagcgcggugccgguugacugggugccuaccucucggacaaccugguccauucaugcccaccaccaguggaugacgacagaagauaugcugagcgucuggaauagaguguggaucgaggaaaaccccuggauggaggacaaaacccauguuuccucuugggaagaggugcccuaucuugggaagcgggaggaccaguggugcggaagccugauuggccucaccgcuagagccacaugggccaccaauauccaggucgcuauuaaccaagugcgccggcugaucgggaaugaaaacuaccuggauuacaugacauccaugaaaagauucaagaaugagagcgacccugaaggcgcccucugguga

SEQ ID NO: 18776 - RNA, 9879 nt, Artificial Sequence
  derived and/or modified CDS sequence (opt5) from DENV-1__FJ639802__SS-prME
agcgugaccaugcugcucaugcugcuucccaccgcucuggcuuuccaccucacgacccggggcggggaaccucauaugaucgucuccaagcaggaacgggggaaaucucugcuuuuuaagacaagcgccggcguuaauaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccaaaccggcgagcaccggcgggacaagcgcucugucgcccuggcuccucauguggggcucggacuggagacacggaccgaaacguggaugagcuccgagggcgccuggaaacagauucagcggguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaucgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccgcccuuuggcgaguccuauaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaucagguguucgggaccgccuacggaguucuuuuuagcggcguguccuggacgaugaagaucgggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuucgugaccaacgagguucacacauggaccgaacaauaucgguuucaggcugauagcccuaagagacucuccgccgcgauuggcaaagccugggaggagggggugugcggcauccgcucugcuacgcggcuggaaaauauuauguggaagcagaucagcaacgagcuuaaucauauccugcucgaaaacgacaugaaauucacagucguggugggagacgccaauggcauucuggcucaggggaagaaaaugaucagaccgcaacccauggagcacaaguacuccuggaaaucuuggggaaaggccaagauuaucggcgccgauauucagaacaccaccuuuaucaucgacgggccugauacacccgaauguccugacggacagcgcgcuuggaauauuugggaggucgaggauuauggcuucggcaucuuuaccacgaacauuuggcugaaacuucgggacagcuacacacagaugugcgaucacagacucauguccgcggccaucaaggacagcaaagcuguucaugccgauaugggguauuggauugaaucugagaagaaugaaaccuggaaacuggcccgcgcuuccuucaucgaggugaagacauguaucuggcccaagagccacacccuguggucuaacggagugcucgaauccgagaugauuaucccgaaaauuuacggcgggccuaucagccaacauaauuaucggcccggauacuucacacagaccgccggcccuuggcaccuggggaaacuugagcuggacuuugaucucugcgaaggaacgaccgucgugguugacgagcacugcggcaacagaggccccucucugcggacaaccacagugaccgggaaaauuauccaugaaugguguugccgcagcuguacgcugccuccccuuagauuccggggagaggauggcugcugguacgggauggagaucagaccggucaaggaaaaagaggaaaaucucgugcgcuccaugguuagcgcgggaucuggcgagguggacuccuuuagccuggggauucugugugucuccaucaugauugaagaggugaugcggucuagauggagccgcaagaugcucaugacaggaacccuggcuguuuuccuucugcucaucaugggccagcugacauggaacgaccugauuagacuuugcaucauggugggcgccaaugccuccgaucggauggggaugggaaccaccuaucuggcucucauggccacauuuaagaugcgcccuauguucgcggucggccugcucuuuagacggcugacgucucgcgaggugcuucugcucaccauugggcugagccugguggcuuccgucgaacuucccaacucucuggaggaacucggagacggccuggccauggggaucaugaugcucaaacugcuuacagaguuccaaccccaccagcuguggaccacacuccugagccugaccuuuguuaagacgacacuuucccuggauuacgccuggaaaaccaccgcuauggugcucagcaucgugucucuguucccucucugucuguccacaaccagccagaagacaacguggcuuccgguccugcugggaucuuuuggcugcaaaccccucaccauguuccugauuacagaaaacaagaucuggggcagaaaguccuggccucuuaaugaggggauuauggccaucggaauugugagcauccugcucucuucccugcucaaaaacgacguuccccuggcuggcccucuuaucgccgggggaaugcugauugcguguuaugugaucagcggcuccagcgccgaucugucucucgagaaggcugccgaagucagcugggagcaggaagcugagcauuccggggccucucacaauauucugguggaaguucaagacgauggaaccaugaaaaucaaggacgaggagcgggaugacacacuuaccauucugcucaaagccacgcugcucgcugugagcggcgucuaccccauguccaucccugcgacccuguuugugugguauuucuggcagaagaaaaagcagcgcucuggcguccuuugggauacacccagcccgccugaaguggagagagccguucuggacgaugggaucuaccggauucugcagcgcggacuccugggcagaucccaagugggggucggaguguuccaggacggcguuuuucauaccauguggcacgugacaagaggggcuguccuuauguaucagggaaagagacuggaacccucuugggccagcgugaaaaaggaccucaucuccuacggcggcggguggcgcuuccagggaagcuggaacaccggcgaggaggugcaaguuauugccgucgaaccugggaaaaaucccaagaacgugcagacaacgccgggaaccuuuaaaacaccugagggcgaagugggggcuaucgcccuggauuucaagcccggaaccucuggcuccccuauugucaaucgggagggcaagaucguggggcucuacggaaacggcguugugaccacaagcgggacguaugucucugcgauugcucaggccaaagccucccaagaaggaccccugcccgagaucgaggacgaaguguuuaagaaaagaaaucuuaccaucauggaucugcacccuggcagcgggaagacacgccgguaccugccggcuauuguuagagaggccaucaaacgcaagcuccggacccugauucuugcgcccacaagaguggucgcuuccgaaauggccgaggcccugaagggcaugccuauccgcuaucagaccacggcugugaaaucugaacauacaggacgggagauuguugaccucaugugccacgccaccuucaccaugagacugcugagccccgugcgggucccuaacuacaauaugaucaucauggaugaggcucauuuuacagaccccgccuccauugcggcccgcggcuauaucagcaccagaguggggaugggagaagcugccgcuauuuucaugacagccaccccuccgggcucuguggaggccuuuccccaguccaacgcugucauccaggaugaagaacgggacauuccugaacgcagcuggaacucuggguacgauuggaucacggacuuccccggaaagacaguuugguuugugccuagcaucaaauccggcaacgauauugcgaauugucucagaaagaacgggaaacgggugauccaacuuucuagaaagaccuucgacacagaguaucagaagaccaaaaacaaugacugggauuacgucgugacgaccgacauuagcgagaugggcgccaacuuccgcgcugaucggguuaucgaccccagacgcugccugaagccggugauucugaaagauggaccugaacgggucauccucgccggccccaugcccgugacaguugccuccgcugcccagagacgcgggcggauuggaagaaaucagaacaaggagggcgaccaauacguguauauggggcagccucugaauaacgaugaagaccacgcgcauuggaccgaggcuaaaaugcuucuggauaauaucaacacacccgagggaaucauuccugcccucuuugaaccggagcgcgaaaagucugccgcuaucgacggcgaguacagacugagaggggaagcccgcaagaccuucgucgagcugaugagacggggcgaucuccccguguggcuuagcuauaaagucgcguccgagggauuucaguacagcgaccgcagauggugcuucgauggcgaacggaauaaccaggugcuggaggaaaauauggacguugagauuuggacaaaggaaggggagcgcaagaagcugcgcccucgguggcucgacgccagaaccuauucugauccccuggcccuucgcgaguuuaaagaguucgccgcuggacggagauccgugagcggcgaccugauccucgagauugggaagcugccucaacaccugacgcuccgggcccagaacgcucuugauaaucuggugaugcugcacaacuccgaacagggaggcaaagccuaccgccaugcgauggaggaacuccccgacacaaucgagacccugaugcuucuggcccucaucgcuguccugaccggcgggguuacacuguuuuuccucucuggaaagggccuugggaagaccagcauuggacugcugugugugacagccuccucugcucuccuguggauggccagcguggagccgcacuggaucgccgcuuccauuauccuugaauuuuuccugaugguccuccugauuccugagcccgauagacagcggacgccucaagacaaucagcuggcguaugugguuaucggccuccuuuuuaugauccugaccguggccgcuaacgaaauggggcugcucgagacaaccaaaaaggaucugggaauuggcuacgucgccgccgagaaccaucagcacgcuacaaugcuugacguggaucugcgccccgccagcgcguggacccucuacgccgucgcuacgaccgugaucacaccuaugaugagacacaccauugaaaauacaaccgccaacaucucucugacggcuauugccaaucaagcggccauccugaugggccucgacaaaggguggcccauuuccaagauggauaucggaguuccgcuucuggcucugggcugcuauagccaggugaacccucucacacugaccgccgcuguccuuaugcugguggcccauuacgcuaucauugggcccggacuccaggccaaagcgacacgggaggcccagaagcgcaccgcugccggcaucaugaagaaucccaccguugacgggauuguggcuaucgaucuggacccugucguguaugacgccaaauucgaaaagcaacugggacagauuaugcuccuuauccuguguacaucucagauccugcucaugagaacgaccugggcccugugcgaguccauuacacuugcgaccggcccgcugacaacccucugggaaggcagccccgggaaauuuuggaacacgacaaucgcugugucuauggccaauauuuuccggggaagcuaccuggcuggcgccgggcuggccuucucccucaugaagucucuuggaggcgggcgcagaggaaccggcgcucagggcgagacccugggggagaaauggaagcggcaacugaaccagcucagcaaguccgaauuuaauacauauaaaagaagcggaaucauggagguugaucgcuccgaagccaaggagggccugaaaagaggggaaaccacaaagcacgcggucucuagaggaacggccaaacuucgcugguucguggagcggaaccuggugaagccugagggcaaggucauugaccucggguguggaagaggcggcuggagcuacuauugcgcugggcugaaaaagguuaccgaagugaaaggauacacaaagggcgggcccggacaugaggaaccuauccccauggccaccuacggcuggaaucuggugaaacuccacuccgggaaggaugucuuuuucaugccuccggagaaaugugacacacuucugugcgauaucggagaaucuagccccaacccuaccauugaggagggccgcacgcugcgggugcucaagaugguugaacccuggcugaagggcaaucaguuuuguaucaaaauucuuaacccuuauaugcccuccguggucgagacccuggaacagaugcaaagaaagcaugggggaaugcucgugcgcaauccgcugucucggaacagcacacacgagauguacuggguuuccugcggcaccgggaauaucgugagcgcugucaacaugacaucuagaaugcugcucaaccgcuucaccauggcccaccggaaaccuacauaugagagagacguggaucugggagcgggcacccgccauguggccgucgaacccgagguugcuaaucuugacauuaucgggcagagaauugaaaacaucaagaaugagcacaaauccacguggcauuacgaugaagacaaccccuauaagacaugggccuaccacggaagcuaugaggugaagccuucuggcuccgcuagcucuauggugaauggcgucgugcggcugcucaccaaacccugggauguuaucccuauggugacccagauugccaugacagacacgaccccguuugggcaacagcgcgucuucaaggagaaaguggacacaagaacaccccgggcuaagagaggaacaacccagaucauggaaguuacagccaaauggcuguggggcuuucuuucccggaacaagaagccucgcauuuguaccagagaggaguucacgcggaaagugcgcagcaaugcggccaucggggcugucuuuguggaugagaaccaguggaacuccgccaaggaagcuguugaggacgagagauucugggaucuggugcaccgggaacgcgagcuccauaaacaaggaaagugcgcgaccugcgucuacaacaugaugggcaaaagagaaaagaagcugggggaguuuggcaaagccaagggaagccgggccauuugguacauguggcugggcgcucgcuuccucgaguucgaggcccugggguuuaugaaugaggaccacugguucucuagagaaaacagccuuuccggaguggagggcgaagggcugcauaaacucggauauauccugcgggauaucucuaagauucccggcgggaauauguacgccgacgauacagcuggcugggacacccgcaucacagaggaugaccuucagaacgaggccaaaauuaccgauaucauggaaccugagcacgcucugcucgccacgagcauuuuuaagcugacauaucagaauaaagucgugagaguucagcggcccgcgaagaacggaaccgugauggacgucaucucccgcagagaucaacggggcucuggacaggugggaacauacggccugaacaccuucacgaauauggaagugcagcucaucagacagauggagagcgaagggauuuuucugccguccgagcuugagaccccuaaccuggccgaacgcguucucgacuggcuggagaagcauggagcugaacggcuuaaaagaauggccaucucuggcgacgauuguguggucaagcccauugacgaucgcuucgcuacagcccugaccgcgcucaaugacauggggaaagugcggaaggauaucccucaaugggagcccagcaaaggcuggaacgacuggcagcagguuccuuuuugcucccaccacuuccaucagcugauuaugaaggauggaagagaaaucgugguccccugucgcaaucaagacgagcuggugggccgggccagagucagccagggggcuggauggucucuccgcgagacagccugccugggcaaguccuaugcucagauguggcaacuuauguacuuucaccggagagaucugcgccucgccgcuaacgccaucuguagcgcggugccgguugacugggugccuaccucucggacaaccugguccauucaugcccaccaccaguggaugacgacagaagauaugcugagcgucuggaauagaguguggaucgaggaaaaccccuggauggaggacaaaacccauguuuccucuugggaagaggugcccuaucuugggaagcgggaggaccaguggugcggaagccugauuggccucaccgcuagagccacaugggccaccaauauccaggucgcuauuaaccaagugcgccggcugaucgggaaugaaaacuaccuggauuacaugacauccaugaaaagauucaagaaugagagcgacccugaaggcgcccucugguga

SEQ ID NO: 18777 - RNA, 9879 nt, Artificial Sequence
  derived and/or modified CDS sequence (opt5) from DENV-1__JN819410__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacacucgucgauagaggcuggggcaauggguguggacuguucggcaaagggaaccuucugaccugcgccaaguuuaagugcgugacaaaacucgaaggaaagauuguucaguacgagaaucugaaauauagcgugaucgucacggugcacaccggcgaccagcaucaaguugggaacgaaacaaccgagcacggaacaaucgcuaccauuacgccccaggccccuaccucugaaauccagcugacagauuacggcgcccucacccuggacuguuccccccggacaggccuugacuucaaugagauggugcugcucaccaugaaggagaaaagcuggcugguccauaagcagugguuucuugaucugccucuccccuggacgucuggggcuuccacaagccaagaaaccuggaaccgccaggaccugcuggugacauucaaaaccgcgcacgccaagaagcaggaggucgugguucucggaucccaagaaggcgcuaugcacaccgcccugacaggggccacggagauucagaccucuggaacaaccacaaucuuugcuggccaucuuaaaugcagacugaagauggauaaacucacccugaaggggaugagcuaugugauguguacgggcuccuucaaacuggaaaaggaggucgccgagacacagcacggaaccgugcuuguucaggugaaguacgaaggcaccgacgcgccgugcaaaauuccuuucagcacacaagaugagaagggggucacccagaauggacggcucaucacagcuaaccccaucgugacggacaaagaaaagccugugaauauugagaccgagccccccuuuggcgaaucuuauaucguugucggggccggagagaaagcccugaagcuguccugguucaagagaggcagcucuauugggaaaauguuugaagcuacagcccgcggcgcucggagaauggccauccucggagauaccgcgugggacuucggcagcauugggggaguguuuacauccgugggcaagcugguccaucagguguucgggaccgccuacggaguucuuuuuucuggcgugagcuggacgaugaaaaucgggaucggcauucugcucaccuggcugggacugaacucccgcagcacaucucuuuccaugaccuguaucgcugucggcauggugacacucuaccuggggguuauggugcaggccgauagcggaugcgucauuaacuggaagggccgggagcugaaaugugggucuggaaucuucgugaccaaugaaguucacacauggaccgagcaauauaaguuucaggcugacuccccuaagagacucagcgccgcgauuggcaaagccugggaggaaggggugugcggcauccgcuccgcuacgcggcuggagaacauuauguggaagcagaucucuaaugaacuuaaccauauccugcucgagaaugauaugaaauucacagucguggugggagacgccaacggcauucuggcucaggggaagaaaaugaucagaccgcaacccauggaacacaaguacagcuggaaauccuggggaaaggccaagauuaucggcgccgacauucagaauaccaccuuuaucaucgaugggccugacacacccgaguguccugauggacagcgcgcuuggaacauuugggaggucgaagacuauggcuucggcguuuuuaccacgaauaucuggcugaaacuucgggauucuuacacacagaugugcgaccacagacucaugagcgcggccauuaaggauuccaaagcugugcaugccgacaugggguauuggaucgagagcgaaaagaacgagaccuggaaacuggcccgcgcuucuuucauugaagugaagacauguaccuggcccaagucccacacacuguggagcaauggaguccucgagucugagaugaucaucccgaaaauuuacggcgggccuaucucccaacauaacuaucggcccggauacuucacccagacggccggcccuuggcaccuggggaagcuugaacuggauuuugaccucugcgagggaaccacagugguuguggaugaacacugcggcaauagaggccccagccugcggaccacaaccgucacggggaaaauuauccaugagugguguugccgcucuuguacacugccuccccuuagauuccggggagaggacggcugcugguacgggauggaaauuagaccggugaaggagaaagaagagaaccucguucgcagcaugguguccgcgggaagcggcgaagucgauucuuuuucccuggggauccugugugugagcaucaugauugaggagguuaugcgguccagauggucucgcaagaugcucaugaccggaacacuggcuguguuccuucugcucaucaugggccagcugaccuggaaugaccugauuagacuuugcaucauggucggcgccaacgccagcgaccggauggggaugggaaccacauaucuggcucucauggccacguuuaagaugcgcccuauguucgcggugggccugcucuuuagacggcugaccucccgcgaagugcuucugcucacaauugggcugucucuggucgcuagcguugagcuucccaacucccuggaagagcucggagauggccuggccauggggaucaugaugcucaaacugcuuaccgaauuccaaccccaccagcuguggacaacccuccugucucugacguuuauuaagacaacccuuagccuggacuacgccuggaaaaccacagcuauggugcucuccaucgugagccuguucccucucugucugucuaccacaucccagaagacgaccuggcuuccgguccugcugggaagcuuuggcugcaaaccccucacaauguuccugaucaccgagaauaagauuuggggcagaaagucuuggccucuuaacgaggggaucauggccauuggaaucguguccauucugcucagcucucugcucaaaaaugauguuccccuggcuggcccucuuaucgccgggggaaugcugaucgcguguuaugugauuuccggcagcuccgccgaccugagccucgaaaaggcugccgaggucucuugggaacaggaggcugaacauagcggggccucccacaacauccugguggagguucaagaugacggaacaaugaaaauuaaggaugaggaacgggacgauacccuuacgauccugcucaaagccacccugcucgcugugucuggcgucuaccccaugagcauuccugcgacacuguuugugugguauuucuggcagaagaaaaagcagcgcuccggcguccuuugggacacccccucuccgccugagguggaaagagccguucuggaugacgggaucuaccggauccugcagcgcggacuccugggcagaagccaagugggggucggaguguuccaggauggcguuuuucauacaauguggcacgugacccggggggcuguccuuauguaucagggaaagagacuggagcccuccugggccucugugaaaaaggaccucauuagcuacggcggcggguggcgcuuccagggauccuggaauacaggcgaggaagugcaaguuaucgccgucgagccugggaaaaaccccaagaaugugcagacgaccccgggaacauuuaaaaccccugaaggcgaggugggggcuauugcccuggacuucaagcccggaaccagcggcucuccuaucgucaaccgggaaggcaagauuguggggcucuacggaaauggcguugugacaacguccgggaccuaugucagcgcgaucgcucaggccaaagccucucaagagggaccccugcccgagauugaagaugagguguuuaagaaaagaaaccuuacaaucauggaccugcacccuggcuccgggaagacccgccgguaccugccggcuaucguuagagaagccauuaaacgcaagcuccggacacugauccuugcgcccaccagaguggucgcuagcgagauggccgaagcccugaagggcaugccuauucgcuaucagacgacagcugugaaauccgagcauaccggacgggagaucguugaucucaugugccacgccaccuucacaaugagacugcugucucccgugcgggucccuaauuacaacaugauuaucauggacgaagcucauuuuaccgaucccgccagcaucgcggcccgcggcuauauuuccacaagaguggggaugggagaggcugccgcuaucuucaugaccgccacgccuccgggcagcguggaagccuuuccccagucuaaugcugucauucaggacgaggaacgggauaucccugagcgcuccuggaacagcggguacgacuggauuacagauuuccccggaaagaccguuugguuugugccuucuaucaaaagcggcaaugacaucgcgaacugucucagaaagaacgggaaacgggugauucaacuuuccagaaagacauucgauaccgaguaucagaagacgaaaaauaacgacugggacuacgucgugaccacagauaucucugaaaugggcgccaauuuccgcgcugaccggguuauugaucccagacgcugccugaagccggugauccugaaagacggaccugagcgggucauucucgccggccccaugcccgugaccguugccagcgcugcccagagacgcgggcggaucggaagaaaccagaauaaggaaggcgaucaauacguguauauggggcagccucugaacaaugacgaggaucacgcgcauuggacagaggcuaaaaugcuucuggacaacauuaauacccccgaaggaaucaucccugcccucuuugagccggaacgcgagaaguccgccgcuauugauggcgaauacagacugcggggggaggcccgcaagacauucgucgagcugaugagacggggcgaccuccccguguggcuuucuuauaaagucgcgagcgaaggauuucaguacuccgaucgcagauggugcuucgacggcgagcggaacaaucaggugcuggaagagaacauggauguugaaaucuggaccaaggagggggagagaaaaaagcugcgcccucgguggcucgacgccagaacguauagcgacccccuggcucuucgcgaauuuaaagaguucgccgcuggacggagaucuguguccggcgaucugauucucgaaaucgggaagcugccucaacaccugacacuccgggcccagaaugcucuugacaaccuggugaugcugcacaauagcgagcagggaggcaaagccuaccgccaugcgauggaagagcuccccgauaccauugagacccugaugcuucuggcccucaucgcuguccugacaggcgggguuacccuguuuuuccucuccggaaagggccuugggaagacaucuaucggacugcugugugugacggccagcuccgcucuccuguggauggccucuguggaaccgcacuggauugccgcuagcaucauucuugaguuuuuccugaugguccuccugaucccugaacccgacagacagcggaccccucaagauaaccagcuggcguaugugguuauuggccuccuuuuuaugauccugacaguggccgcuaacgagauggggcugcucgagaccacaaaaaaggaccugggaaucggcuacgucgccgccgaaaaucaucagcacgcuaccaugcuugauguggaccugcaccccgccuccgcguggacgcucuacgccgucgcuaccacagugauuaccccuaugaugcgccauacaaucgagaacaccacggccaauauuagccugacagcuaucgccaaccaagcggccauucugaugggccucgauaaaggguggcccaucucuaagauggacauuggaguuccgcuucuggcucugggcugcuauucccaggugaauccucucacccugacagccgcuguccuuaugcugguggcccacuacgcuaucaucgggcccggacuccaggccaaagcgaccagagaagcccagaagcggaccgcugccggcauuaugaagaaccccacaguugaugggaucguggcuauugaccuggauccugucguguaugacgccaaauucgagaagcaacugggacagaucaugcuccuuauucuguguacgagccagauccugcucaugcgcaccacaugggcccugugcgaaucuaucacccuugcgacaggcccgcugaccacgcucugggagggcucccccgggaaauuuuggaauacaaccauugcugugagcauggccaacaucuucagaggaucuuaccuggcuggcgccgggcuggccuucagccucaugaagucccuuggaggcgggcggcgcggaaccggcgcucagggcgagacacugggggaaaaauggaagagacaacugaaucagcucucuaagagcgaguuuaacaccuauaaacgguccggaauuauggaaguugacagaagcgaggccaaggaaggccugaaacgcggggagacaacgaagcaugcggucucccggggaaccgccaaacuuagaugguucguggagcgcaaucuggugaagccugaaggcaaggucaucgaucucggguguggacggggcggcuggucuuacuauugcgcugggcugaaaaagguuacagaggugaaaggauacaccaagggcgggcccggacacgaagagccuauucccauggccacauacggcuggaaccuggugaaacuccauagcgggaaggacgucuuuuucaugccuccggaaaaaugugauacccuucugugcgacaucggagaguccucucccaauccuacgaucgaggaaggcagaacccugcgcgugcucaagaugguugagcccuggcugcggggcaaccaguuuuguauuaagauccuuaauccuuauaugcccagcguggucgaaacacuggagcagaugcaaagaaaacacgggggaaugcucgugcgcaacccgcugucccggaauucuacccacgagauguacuggguuagcugcggcacagggaacauuguguccgcugucaacaugaccagcagaaugcugcucaaucgcuucacaauggcccaucggaagccuaccuaugaaagagauguggaccugggagcgggcacgcgccacguggccgucgagcccgaaguugcuaaccuugauaucauugggcagagaaucgagaauauuaaaaacgaacauaagucuacauggcacuacgacgaggauaaucccuauaaaaccugggccuaccacggauccuaugaggugaagccuagcggcucugcuuccagcauggugaacggcgucgugcggcugcucaccaagcccugggacguuaucccuauggugacacagaucgccaugacggauaccacaccguuugggcaacagcgcgucuucaaagaaaagguggacaccagaacaccccgggcuaaaagaggaaccacacagauuauggagguuaccgccaaguggcuguggggcuuucuuucucggaauaaaaagccucgcaucuguacgagagaagaguucacccggaaggugcgcuccaacgcggccauuggggcugucuuuguggacgaaaaucaguggaacagcgccaaagaggcuguugaggaugaaagauucugggaccuggugcaucgggagcgcgaacuccacaagcaaggaaaaugcgccacaugcgucuacaauaugaugggcaagagagagaaaaagcugggggaauuuggcaaggccaaaggaucccgggcgaucugguacauguggcugggcgcucgcuuccucgaguucgaggcccugggguuuaugaacgaagaucauugguucagcagagagaauucucuuagcggaguggaaggcgaggggcugcacaagcucggauauauucugcgggacaucuccaaaauccccggcgggaacauguacgccgaugacaccgcuggcugggauacacgcauuaccgaggacgaucuucagaaugaagccaagaucacggacauuauggagccugaacaugcucugcucgccacaucuaucuuuaaacugaccuaucagaacaaggucgugagaguucagcggcccgcgaaaaacggaacagugauggaugucauuagccgcagagaccaacggggcuccgggcaggugggaaccuacggccugaauacguucaccaacauggaggugcagcucaucagacagauggaaucugaggggaucuuucugccgagcgagcuugaaacaccuaaucuggccgagcgcgcucucgauuggcuggaaaagcacggagccgagcggcuuaagagaauggcuauuuccggcgacgacuguguugugaaacccaucgaugaccgcuucgccaccgcgcugacagcccucaacgauauggggaagguccggaaagacauuccucaaugggaacccucuaagggcuggaaugauuggcagcaggugccuuuuugcagccaccauuuccaccagcugaucaugaaagacggaagagagauuguugugcccugucgcaaccaagaugagcuggucggccgggcuagagugucccagggggccggauggagccuccgcgaaaccgcuugccugggcaagucuuaugcccagauguggcaacuuauguacuuucaucggagagaccugcgccucgcugccaaugcgaucuguuccgccgucccgguggauuggguuccuacaagccggaccacguggucuauccacgcucaccaucaguggaugacaaccgaggacaugcuguccguguggaacagagucuggauugaagagaaucccuggauggaagauaagacccacgugagcuccugggaggagguucccuaucuugggaaacgggaagaccaguggugcggaucucugaucggccucacagccagagccaccugggcuacaaacauucagguggccaucaaucaaguccgccggcugauugggaacgagaauuaccuggacuacaugacgagcaugaagagauucaaaaacgaauccgauccugagggcgcgcucugguga

SEQ ID NO: 18778 - RNA, 9879 nt, Artificial Sequence
  derived and/or modified CDS sequence (opt5) from DENV-1__FJ639806__SS-prME
agcgugaccaugcugcucaugcugcuucccaccgcucuggcuuuccaccucacgacccggggcggggaaccucauaugaucgucuccaagcaggaacgggggaaaucucugcuuuuuaagacaagcgccggcguuaauaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccaaaccggcgagcaccggcgggacaagcgcucugucgcccuggcuccucauguggggcucggacuggagacacggaccgaaacguggaugagcuccgagggcgccuggaaacagauucagcggguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaucgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccgcccuuuggcgaguccuauaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaucagguguucgggaccgccuacggaguucuuuuuagcggcguguccuggacgaugaagaucgggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuucgugaccaacgagguucacacauggaccgaacaauauaaguuucaggcugauagcccuaaacggcucuccgccgcgauuggcagagccugggaggagggggugugcggcauccgcucugcuacgcggcuggaaaauauuauguggaagcagaucagcaacgagcuuaaucauauccugcucgaaaacgacaugaaauucacagucguggugggagacgccaauggcauucuggcucaggggaagaaaaugaucagaccgcaacccauggagcacaaguacuccuggaaaucuuggggaaaggccaagauuaucggcgccgauauucagaacaccaccuuuaucaucgacgggccugauacacccgaauguccugacggacagcgcgcuuggaauauuugggaggucgaggauuauggcuucggcaucuuuaccacgaacauuuggcugaaacuucgggacagcuacacacagaugugcgaucacagacucauguccgcggccaucaaggacagcaaagcuguucaugccgauaugggguauuggauugaaucugagaagaaugaaaccuggaaacuggcccgcgcuuccuucaucgaggugaagacauguaucuggcccaagagccacacccuguggucuaacggagugcucgaauccgagaugauuaucccgaaaauuuacggcgggccuaucagccaacauaauuaucggcccggauacuucacacagaccgccggcccuuggcaccuggggaaacuugagcuggacuuugaucucugcgaaggaacgaccgucgugguugacgagcacugcggcaacagaggccccucucugcggacaaccacagugaccgggaaaauuauccaugaaugguguugccgcagcuguacgcugccuccccuuagauuccggggagaggauggcugcugguacgggauggagaucagaccggucaaggaaaaagaggaaaaucucgugcgcuccaugguuagcgcgggaucuggcgagguggacuccuuuagccuggggauucugugugucuccaucaugauugaagaggugaugcggucuagauggagccgcaagaugcucaugacaggaacccuggcuguuuuccuucugcucaucaugggccagcugacauggaacgaccugauuagacuuugcaucauggugggcgccaaugccuccgaucggauggggaugggaaccaccuaucuggcucucauggccacauuuaagaugcgcccuauguucgcggucggccugcucuuuagacggcugacgucucgcgaggugcuucugcucaccauugggcugagccugguggcuuccgucgaacuucccaacucucuggaggaacucggagacggccuggccauggggaucaugaugcucaaacugcuuacagaguuccaaccccaccagcuguggaccacacuccugagccugaccuuuguuaagacgacacuuucccuggauuacgccuggaaaaccaccgcuauggugcucagcaucgugucucuguucccucucugucuguccacaaccagccagaagacaacguggcuuccgguccugcugggaucuuuuggcugcaaaccccucaccauguuccugauuacagaaaacaagaucuggggcagaaaguccuggccucuuaaugaggggauuauggccaucggaauugugagcauccugcucucuucccugcucaaaaacgacguuccccuggcuggcccucuuaucgccgggggaaugcugauugcguguuaugugaucagcggcuccagcgccgaucugucucucgagaaggcugccgaagucagcugggagcaggaagcugagcauuccggggccucucacaauauucugguggaaguucaagacgauggaaccaugaaaaucaaggacgaggagcgggaugacacacuuaccauucugcucaaagccacgcugcucgcugugagcggcgucuaccccauguccaucccugcgacccuguuugugugguauuucuggcagaagaaaaagcagcgcucuggcguccuuugggauacacccagcccgccugaaguggagagagccguucuggacgaugggaucuaccggauucugcagcgcggacuccugggcagaucccaagugggggucggaguguuccaggacggcguuuuucauaccauguggcacgugacaagaggggcuguccuuauguaucagggaaagagacuggaacccucuugggccagcgugaaaaaggaccucaucuccuacggcggcggguggcgcuuccagggaagcuggaacaccggcgaggaggugcaaguuauugccgucgaaccugggaaaaaucccaagaacgugcagacaacgccgggaaccuuuaaaacaccugagggcgaagugggggcuaucgcccuggauuucaagcccggaaccucuggcuccccuauugucaaucgggagggcaagaucguggggcucuacggaaacggcguugugaccacaagcgggacguaugucucugcgauugcucaggccaaagccucccaagaaggaccccugcccgagaucgaggacgaaguguuuaagaaaagaaaucuuaccaucauggaucugcacccuggcagcgggaagacacgccgguaccugccggcuauuguuagagaggccaucaaacgcaagcuccggacccugauucuugcgcccacaagaguggucgcuuccgaaauggccgaggcccugaagggcaugccuauccgcuaucagaccacggcugugaaaucugaacauacaggacgggagauuguugaccucaugugccacgccaccuucaccaugagacugcugagccccgugcgggucccuaacuacaauaugaucaucauggaugaggcucauuuuacagaccccgccuccauugcggcccgcggcuauaucagcaccagaguggggaugggagaagcugccgcuauuuucaugacagccaccccuccgggcucuguggaggccuuuccccaguccaacgcugucauccaggaugaagaacgggacauuccugaacgcagcuggaacucuggguacgauuggaucacggacuuccccggaaagacaguuugguuugugccuagcaucaaauccggcaacgauauugcgaauugucucagaaagaacgggaaacgggugauccaacuuucuagaaagaccuucgacacagaguaucagaagaccaaaaacaaugacugggauuacgucgugacgaccgacauuagcgagaugggcgccaacuuccgcgcugaucggguuaucgaccccagacgcugccugaagccggugauucugaaagauggaccugaacgggucauccucgccggccccaugcccgugacaguugccuccgcugcccagagacgcgggcggauuggaagaaaucagaacaaggagggcgaccaauacguguauauggggcagccucugaauaacgaugaagaccacgcgcauuggaccgaggcuaaaaugcuucuggauaauaucaacacacccgagggaaucauuccugcccucuuugaaccggagcgcgaaaagucugccgcuaucgacggcgaguacagacugagaggggaagcccgcaagaccuucgucgagcugaugagacggggcgaucuccccguguggcuuagcuauaaagucgcguccgagggauuucaguacagcgaccgcagauggugcuucgauggcgaacggaauaaccaggugcuggaggaaaauauggacguugagauuuggacaaaggaaggggagcgcaagaagcugcgcccucgguggcucgacgccagaaccuauucugauccccuggcccuucgcgaguuuaaagaguucgccgcuggacggagauccgugagcggcgaccugauccucgagauugggaagcugccucaacaccugacgcuccgggcccagaacgcucuugauaaucuggugaugcugcacaacuccgaacagggaggcaaagccuaccgccaugcgauggaggaacuccccgacacaaucgagacccugaugcuucuggcccucaucgcuguccugaccggcgggguuacacuguuuuuccucucuggaaagggccuugggaagaccagcauuggacugcugugugugacagccuccucugcucuccuguggauggccagcguggagccgcacuggaucgccgcuuccauuauccuugaauuuuuccugaugguccuccugauuccugagcccgauagacagcggacgccucaagacaaucagcuggcguaugugguuaucggccuccuuuuuaugauccugaccguggccgcuaacgaaauggggcugcucgagacaaccaaaaaggaucugggaauuggcuacgucgccgccgagaaccaucagcacgcuacaaugcuugacguggaucugcgccccgccagcgcguggacccucuacgccgucgcuacgaccgugaucacaccuaugaugagacacaccauugaaaauacaaccgccaacaucucucugacggcuauugccaaucaagcggccauccugaugggccucgacaaaggguggcccauuuccaagauggauaucggaguuccgcuucuggcucugggcugcuauagccaggugaacccucucacacugaccgccgcuguccuuaugcugguggcccauuacgcuaucauugggcccggacuccaggccaaagcgacacgggaggcccagaagcgcaccgcugccggcaucaugaagaaucccaccguugacgggauuguggcuaucgaucuggacccugucguguaugacgccaaauucgaaaagcaacugggacagauuaugcuccuuauccuguguacaucucagauccugcucaugagaacgaccugggcccugugcgaguccauuacacuugcgaccggcccgcugacaacccucugggaaggcagccccgggaaauuuuggaacacgacaaucgcugugucuauggccaauauuuuccggggaagcuaccuggcuggcgccgggcuggccuucucccucaugaagucucuuggaggcgggcgcagaggaaccggcgcucagggcgagacccugggggagaaauggaagcggcaacugaaccagcucagcaaguccgaauuuaauacauauaaaagaagcggaaucauggagguugaucgcuccgaagccaaggagggccugaaaagaggggaaaccacaaagcacgcggucucuagaggaacggccaaacuucgcugguucguggagcggaaccuggugaagccugagggcaaggucauugaccucggguguggaagaggcggcuggagcuacuauugcgcugggcugaaaaagguuaccgaagugaaaggauacacaaagggcgggcccggacaugaggaaccuauccccauggccaccuacggcuggaaucuggugaaacuccacuccgggaaggaugucuuuuucaugccuccggagaaaugugacacacuucugugcgauaucggagaaucuagccccaacccuaccauugaggagggccgcacgcugcgggugcucaagaugguugaacccuggcugaagggcaaucaguuuuguaucaaaauucuuaacccuuauaugcccuccguggucgagacccuggaacagaugcaaagaaagcaugggggaaugcucgugcgcaauccgcugucucggaacagcacacacgagauguacuggguuuccugcggcaccgggaauaucgugagcgcugucaacaugacaucuagaaugcugcucaaccgcuucaccauggcccaccggaaaccuacauaugagagagacguggaucugggagcgggcacccgccauguggccgucgaacccgagguugcuaaucuugacauuaucgggcagagaauugaaaacaucaagaaugagcacaaauccacguggcauuacgaugaagacaaccccuauaagacaugggccuaccacggaagcuaugaggugaagccuucuggcuccgcuagcucuauggugaauggcgucgugcggcugcucaccaaacccugggauguuaucccuauggugacccagauugccaugacagacacgaccccguuugggcaacagcgcgucuucaaggagaaaguggacacaagaacaccccgggcuaagagaggaacaacccagaucauggaaguuacagccaaauggcuguggggcuuucuuucccggaacaagaagccucgcauuuguaccagagaggaguucacgcggaaagugcgcagcaaugcggccaucggggcugucuuuguggaugagaaccaguggaacuccgccaaggaagcuguugaggacgagagauucugggaucuggugcaccgggaacgcgagcuccauaaacaaggaaagugcgcgaccugcgucuacaacaugaugggcaaaagagaaaagaagcugggggaguuuggcaaagccaagggaagccgggccauuugguacauguggcugggcgcucgcuuccucgaguucgaggcccugggguuuaugaaugaggaccacugguucucuagagaaaacagccuuuccggaguggagggcgaagggcugcauaaacucggauauauccugcgggauaucucuaagauucccggcgggaauauguacgccgacgauacagcuggcugggacacccgcaucacagaggaugaccuucagaacgaggccaaaauuaccgauaucauggaaccugagcacgcucugcucgccacgagcauuuuuaagcugacauaucagaauaaagucgugagaguucagcggcccgcgaagaacggaaccgugauggacgucaucucccgcagagaucaacggggcucuggacaggugggaacauacggccugaacaccuucacgaauauggaagugcagcucaucagacagauggagagcgaagggauuuuucugccguccgagcuugagaccccuaaccuggccgaacgcguucucgacuggcugaagaaacauggagcugagcggcuuaagagaauggccaucucuggcgacgauuguguggucaaacccauugacgaucgcuucgcuacagcccugaccgcgcucaaugacauggggaaggugcggaaagauaucccucaaugggaacccagcaagggcuggaacgacuggcagcagguuccuuuuugcucccaccacuuccaucagcugauuaugaaggauggaagagagaucgugguccccugucgcaaucaagacgaacuggugggccgggccagagucagccagggggcuggauggucucuccgcgagacagccugccugggcaaauccuaugcucagauguggcaacuuauguacuuucaccggagagaucugcgccucgccgcuaacgccaucuguagcgcggugccgguugacugggugccuaccucucggacaaccugguccauucaugcccaccaccaguggaugacgacagaggauaugcugagcgucuggaauagaguguggaucgaagagaaccccuggauggaagacaagacccauguuuccucuugggaggaagugcccuaucuugggaaacgggaggaccaguggugcggaagccugauuggccucaccgcuagagccacaugggccaccaauauccaggucgcuauuaaccaagugcgccggcugaucgggaaugagaacuaccuggauuacaugacauccaugaagagauucaaaaaugaaagcgacccugagggcgcccucugguga

SEQ ID NO: 18779 - RNA, 9879 nt, Artificial Sequence
  derived and/or modified CDS sequence (opt5) from DENV-1__JN819411__SS-prME
agcgugaccaugcugcucaugcugcuucccacagcucuggcuuuccaccucacgaccagaggcggggaaccucauaugaucgucuccaagcaggaacggggaaagucucugcuuuuuaagacaagcgccggcguuaauaugugcacccugauugcgauggaccucggggaacugugugaagauacaaugaccuacaagugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcccuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccgcccuuuggcgaguccuauaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaucagguguucgggaccgccuacggaguucuuuuuagcggcguguccuggacgaugaagaucgggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuucgugaccaacgagguucacacauggaccgaacaauauaaguuucaggcugauagcccuaaacggcucuccgccgcgauuggcaaggccugggaggagggggugugcggcaucagaucugcuacgcgccuggaaaauauuauguggaaacagaucagcaacgagcuuaaucauauccugcucgaaaacgacaugaaguucacagucguggugggagacgccaauggcauucuggcucaggggaaaaagaugauccggccgcaacccauggagcacaaauacuccuggaagucuuggggaaaggccaaaauuaucggcgccgauauucagaacaccaccuuuaucaucgacgggccugauacacccgaauguccugacggacagagagcuuggaauauuugggaggucgaggauuauggcuucggcaucuuuaccacgaacauuuggcugaaacuucgcgacagcuacacacagaugugcgaucaccggcucauguccgcggccaucaaagacagcaaggcuguucaugccgauaugggguauuggauugaaucugagaaaaaugaaaccuggaagcuggccagagcuuccuucaucgaggugaagacauguaccuggcccaaaagccacacacuguggucuaacggagugcucgaauccgagaugaucauuccgaagaucuacggcgggccuauuagccaacauaauuaucgccccggauacuucacccagacggccggcccuuggcaccuggggaaacuugagcuggacuuugaucucugcgaaggaaccacagucgugguugacgagcacugcggcaaccggggccccucucugagaaccacaaccgugacggggaagaucauucaugaaugguguugccggagcuguacacugccuccccuucgcuucagaggagaggauggcugcugguacgggauggagauccggccggucaaagaaaaggaggaaaaucucgugagauccaugguuagcgcgggaucuggcgagguggacuccuuuagccuggggauccugugugucuccauuaugaucgaagaggugaugcgcucucgguggagcagaaagaugcucaugaccggaacacuggcuguuuuccuucugcucauugugggccagcugaccuggaacgaccugauccgccuuugcauuauggucggcgccaaugccuccgauagaauggggaugggaaccacauaucuggcucucauggccacguuuaaaaugcggccuauguucgcggugggccugcucuuucgcagacugaccucucgggaggugcuucugcucacaaucgggcugagccuggucgcuuccguugaacuucccaacucucuggaggaacucggagacggccuggccauggggauuaugaugcucaagcugcuuaccgaguuccaaccccaccagcuguggacaacccuccugagccugacguuugugaaaacaacccuuucccuggauuacgccuggaagaccacagcuauggugcucagcaucgucucucuguucccucucugucuguccaccacaagccagaaaacgaccuggcuuccggugcugcugggaucuuuuggcugcaagccccucacaauguuccugaucaccgaaaacaagauuuggggccgcaaauccuggccucuuaaugaggggaucauggccauuggaaucguuagcauucugcucucuucccugcucaagaacgacgugccccuggcuggcccucuuaucgccgggggaaugcugaucgcguguuaugucauuagcggcuccagcgccgaucugucucucgagaaagcugccgaagugagcugggagcaggaagcugagcauuccggggccucucacaauauccugguugaagugcaagacgauggaacaaugaagauuaaagacgaggagagagaugacacccuuacgauccugcucaaggccacccugcucgcugucagcggcguguaccccauguccauuccugcgacacuguuugucugguauuucuggcagaaaaagaagcagcggucuggcgugcuuugggauacccccagcccgccugaaguugagcgcgccgugcuggacgaugggaucuacagaauccugcagcggggacuccugggccgcucccaagucggggugggaguuuuccaggacggcguguuucauacaauguggcacgucaccagaggggcugugcuuauguaucagggaaaacggcuggaacccucuugggccagcgugaagaaagaccucauuuccuacggcggcggguggagauuccagggaagcuggaacacaggcgaggagguucaagucaucgccguggaaccugggaagaaucccaaaaacgugcagacgaccccgggaacauuuaagaccccugagggcgaagucggggcuauugcccuggauuucaagcccggaaccucuggcuccccuaucgugaaucgcgagggcaaaauuguugggcucuacggaaacggcguggucacaacgagcgggaccuaugugucugcgaucgcucaggccaaggccucccaagaaggaccccugcccgagauugaggacgaaguuuuuaaaaagcggaaucuuacaaucauggaucugcacccuggcagcgggaaaaccagacgcuaccugccggcuaucgugcgggaggccauuaagagaaagcuccgcacacugauccuugcgcccacccgggucguggcuuccgaaauggccgaggcccugaaaggcaugccuauuagauaucagacgacagcuguuaagucugaacauaccggacgcgagaucguggaccucaugugccacgccaccuucacaaugcggcugcugagccccgucagagugccuaacuacaauaugauuaucauggaugaggcucauuuuaccgaccccgccuccaucgcggcccggggcuauauuagcacacgcguggggaugggagaagcugccgcuaucuucaugaccgccacgccuccgggcucugucgaggccuuuccccaguccaacgcuguuauucaggaugaagagagagacaucccugaacggagcuggaacucuggguacgauuggauuacagacuuccccggaaaaaccgugugguuugugccuagcaucaaguccggcaacgauaucgcgaauugucuccgcaaaaacgggaagagagucauucaacuuucucggaagacauucgacaccgaguaucagaaaacgaagaacaaugacugggauuacgugguuaccacagacaucagcgagaugggcgccaacuucagagcugaucgcgugauugacccccggagaugccugaaaccggucauccugaaggauggaccugaacgcgugauucucgccggccccaugcccguuaccguggccuccgcugcccagcggagagggcgcaucggacggaaucagaacaaagagggcgaccaauacgucuauauggggcagccucugaauaacgaugaagaccacgcgcauuggacagaggcuaagaugcuucuggauaauauuaacacccccgagggaaucaucccugcccucuuugaaccggagagagaaaagucugccgcuauugacggcgaguaccgccugagaggggaagcccggaaaacauucguggagcugaugcgcagaggcgaucuccccgucuggcuuagcuauaagguggcguccgagggauuucaguacagcgaccggcgcuggugcuucgauggcgaaagaaauaaccagguucuggaggaaaauauggacguggagaucuggaccaaagaaggggagcggaagaaacugagaccucgcuggcucgacgcccggacguauucugauccccuggcucuuagagaguuuaaggaguucgccgcuggacgccgguccgugagcggcgaccugauucucgagaucgggaaacugccucaacaccugacacucagagcccagaacgcucuugauaaucuggucaugcugcacaacuccgaacagggaggcaaggccuaccggcaugcgauggaggaacuccccgacaccauugagacccugaugcuucuggcccucaucgcuguucugacaggcggggugacccuguuuuuccucucuggaaagggccuugggaaaacaagcaucggacugcugugugugacggccuccucugcucuccuguggauggccagcgucgagccgcacuggauugccgcuuccaucauucuugaauuuuuccugauggugcuccugaucccugagcccgaucgccagagaaccccucaagacaaucagcuggcguauguugugauuggccuccuuuuuaugauccugacagucgccgcuaacgaaauggggcugcucgagaccacaaagaaagaucugggaaucggcuacguggccgccgagaaccaucagcacgcuaccaugcuugacgucgaucugcggcccgccagcgcguggacgcucuacgccguggcuaccacaguuauuaccccuaugaugcgccacacaaucgaaaauaccacggccaacauuucucugacagcuaucgccaaucaagcggccauucugaugggccucgacaagggguggcccaucuccaaaauggauauuggagugccgcuucuggcucugggcugcuauagccaggucaacccucucacccugacagccgcugugcuuaugcugguugcccauuacgcuaucaucgggcccggacuccaggccaaggcgaccagagaggcccagaagcggaccgcugccggcauuaugaaaaaucccacaguggacgggaucgucgcuauugaucuggacccugugguguaugacgccaaguucgaaaaacaacugggacagaucaugcuccuuauucuguguacgucucagauccugcucaugcgcaccacaugggcccugugcgaguccaucacccuugcgacaggcccgcugaccacgcucugggaaggcagccccgggaaguuuuggaacacaaccauugcuguuucuauggccaauaucuucagaggaagcuaccuggcuggcgccgggcuggccuucucccucaugaaaucucuuggaggcgggcggcgcggaaccggcgcucagggcgagacacugggggagaaguggaagagacaacugaaccagcucagcaaauccgaauuuaauaccuauaagcggagcggaauuauggaggucgauagauccgaagccaaagagggccugaagcgcggggaaacaacgaaacacgcggugucucggggaaccgccaaacuuagaugguucguggagcgcaaccuggucaagccugagggcaaaguuaucgaccucggguguggacggggcggcuggagcuacuauugcgcugggcugaagaaagugacagaagugaagggauacaccaaaggcgggcccggacaugaggaaccuguccccauggccacauacggcuggaaucuggugaagcuccacuccgggaaagauguguuuuucaugccuccggagaagugugacacccuucugugcgauauuggagaaucuagccccaacccuacgaucgaggagggcagaacccugcgcguucucaagauggucgaacccuggcugaaaggcaaucaguuuuguaucaagauucuuaacccuuauaugcccuccgugguugagacacuggaacagaugcaacggaaacaugggggaaugcucgugagaaauccgcugucucgcaacagcacccacgagauguacugggucuccugcggcacagggaauaucgugagcgcugugaacaugaccucucggaugcugcucaacagauucacaauggcccaccgcaagccuaccuaugagcgggacgucgaucugggagcgggcacgagacauguugccguggaacccgagguggcuaaucuugacauuaucgggcagcgcauugaaaacaucaaaaaugagcacaagcugacauggcauuacgaugaagacaaccccuauaagaccugggccuaccacggauccuaugaggucaaaccuagcggcucugcuuccagcauggugaauggcguugugagacuccugaccaagcccugggaugucauuccuauggugacacagaucgccaugacggacaccacaccguuugggcaacagcggguuuucaaagagaagguggacacccgcacacccagagcuaaacggggaaccacacagaucauggaagucaccgccaaguggcuuuggggcuuucugucuagaaacaagaaaccucggauuuguacgcgcgaggaguucaccagaaaggugcgguccaaugcggccaucggggcuguuuuuguggaugagaaccaguggaauagcgccaaagaagcugucgaggacgagcgcuucugggaucucgugcacagagaacgggagcugcauaagcaaggaaaaugcgccacaugcgucuacaacaugaugggcaagcgcgaaaagaaacugggggaguuuggcaaggccaaaggauccagagcgauuugguacauguggcucggcgcucgguuccuggaguucgaggcccuuggguuuaugaaugaggaccacugguucagccgcgaaaacucucugagcggaguggagggcgaagggcuccauaagcugggauauauccuuagagauauuuccaaaauccccggcgggaauauguacgccgacgauaccgcuggcugggacacacggaucaccgaggaugaccugcagaacgaggccaagauuacggauaucauggaaccugagcacgcucuccuggccacaucuauuuuuaaacugaccuaucagaauaagguugugcgcguccagagacccgcgaagaacggaacagugauggacgugaucagccggcgcgaucaaagaggcuccgggcagguuggaaccuacggccucaacacguucaccaauauggaagugcagcugauucggcagauggagucugaagggaucuuuagcccguccgagcuugagacaccuaaccuggccgaaagaguccucgacuggcuggagaaacauggagcugaacgccuuaagcggauggccaucucuggcgacgauugugugguuaaacccauugacgauagauucgcuaccgcccugacagcgcucaaugacauggggaaggugcgcaaagauaucccucaaugggagcccagcaagggcuggaacgacuggcagcaggucccuuuuugcucccaccacuuccaucagcugauuaugaaggauggacgggaaaucgugguccccuguagaaaucaagacgagcuggugggccgcgcccggguuagccagggggcuggauggucucucagagagaccgccugccugggcaaauccuaugcucagauguggcaacuuauguacuuucaccgccgggaucugagacucgccgcuaacgccauuuguagcgcggugccggucgacugggugccuacaucucgcaccacgugguccauccaugcccaccaccaguggaugacaaccgaagauaugcugagcguuuggaaucggguguggaucgaggaaaaccccuggauggaggacaagacccaugucuccucuugggaagaggugcccuaucuugggaaaagagaggaccaguggugcggaagccugauuggccucacagcucgggccaccugggccacaaauauccagguggcuauuaaccaaguuagacgccugaucgggaaugaaaacuaccuggauuacaugacguccaugaagcgguucaaaaaugagagcgacccugaaggcgcccucugguga

SEQ ID NO: 18780 - RNA, 9879 nt, Artificial Sequence
  derived and/or modified CDS sequence (opt5) from DENV-1__FJ639812__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaaugaugcugcucaccaugaaggagaaaucuuggcuggugcauaagcagugguuucuugaccugccucuccccuggacguccggggcuagcacaucccaagagaccuggaaucgccaggaucugcuggucacauucaaaaccgcgcacgccaagaagcaggaaguggucgugcucggaucucaagagggcgcuaugcacaccgcccugacaggggccacggaaauucagaccagcggaacaaccacaaucuuugcuggccaucuuaaaugcagacugaagauggacaaacucacccugaaggggauguccuauguuauguguacgggcagcuucaaacuggagaaggaaguggccgagacacagcacggaaccguccuugugcagguuaaguacgagggcaccgaugcgccgugcaaaauuccuuucucuacacaagacgaaaagggggugacccagaacggacggcucaucacagcuaaucccaucgucacggauaaagagaagccugugaacauugaaaccgagccccccuuuggcgaguccuauaucgugguuggggccggagaaaaagcccugaagcugagcugguucaagaaaggcucuagcauugggaagauguuugaggcuacagccagaggcgcucgccggauggccauccucggagacaccgcgugggauuucggcuccauugggggagucuuuacaucugugggcaaacuggugcaucaggucuucgggaccgccuacggagugcuuuuuagcggcguuuccuggacgaugaagaucgggaucggcauucugcucaccuggcugggacugaauagcagaucuacaucccuuagcaugaccuguaucgcugugggcauggucacacucuaccugggggugaugguucaggccgacucuggaugcgugauuaacuggaaaggccgcgaacugaaguguggguccggaaucuucgucaccaacgaggugcacacauggaccgaacaauauaaguuucaggcugauagcccuaaacggcucuccgccgcgauuggcaaggccugggaggaggggguuugcggcaucagaucugcuacgcgccuggaaaauauuauguggaaacagaucagcaacgagcuuaaucauauccugcucgaaaacgacaugaaguucacaguggucgugggagacgccaauggcauucuggcucaggggaaaaagaugauccggccgcaacccauggagcacaaauacuccuggaagucuuggggaaaggccaaaauuaucggcgccgauauucagaacaccaccuuuaucaucgacgggccugauacacccgaauguccugacggacagagagcuuggaauauuugggagguggaggauuauggcuucggcaucuuuaccacgaacauuuggcugaagcuucgcgacagcuacacacagaugugcgaucaccggcucauguccgcggccaucaaagacagcaaggcuguccaugccgauaugggguauuggauugaaucugagaaaaaugaaaccuggaagcuggccagagcuuccuucaucgagguuaagacauguaccuggcccaaaagccacacacuguggucuaacggagugcucgaauccgagaugaucauuccgaagaucuacggcgggccuauuagccaacauaauuaucgccccggauacuucacccagacggccggcccuuggcaccuggggaaacuugagcuggacuuugaucucugcgaaggaaccacaguggucguggacgagcacugcggcaaccggggccccucucugagaaccacaaccguuacggggaagaucauucaugaaugguguugccggagcuguacacugccuccccuucgcuucagaggagaggauggcugcugguacgggauggagauccggccggugaaagaaaaggaggaaaaucucgucagauccauggugagcgcgggaucuggcgagguugacuccuuuagccuggggauccuguguguguccauuaugaucgaagaggucaugcgcucucgguggagcagaaagaugcucaugaccggaacacuggcuguguuccuucugcucauuaugggccagcugaccuggaacgaccugauccgccuuugcauuaugguuggcgccaaugccuccgauagaauggggaugggaaccacauaucuggcucucauggccacguuuaaaaugcggccuauguucgcggugggccugcucuuucgcagacugaccucucgggagguccuucugcucacaaucgggcugagccugguggcuuccguggaacuucccaacucucuggaggaacucggagacggccuggccauggggauuaugaugcucaagcugcuuaccgaguuccaaccccaccagcuguggacaacccuccugagccugacguuugucaaaacaacccuuucccuggauuacgccuggaagaccacagcuaugguucucagcaucgugucucuguucccucucugucuguccaccacaagccagaaaacgaccuggcuuccggugcugcugggaucuuuuggcugcaagccccucacaauguuccugaucaccgaaaacaagauuuggggccgcaaauccuggccucuuaaugaggggaucauggccauuggaaucgucagcauucugcucucuucccugcucaagaacgacgugccccuggcuggcccucuuaucgccgggggaaugcugaucgcguguuauguuauuagcggcuccagcgccgaucugcuccuggagaaagcugccgaagugucuugggagcaggaagcugagcauagcggggccucccacaauauccuugucgaagugcaagacgauggaacaaugaagauuaaagacgaggagagagaugacacccugacgauccuccugaaggccacccuccuggcuguuucuggcguguaccccaugagcauuccugcgacacuuuuugucugguauuucuggcagaaaaagaagcagcgguccggcgugcugugggauacccccucuccgccugaagucgagcgcgccgugcuggacgaugggaucuacagaauccuccagcggggacugcuuggccgcagccaaguuggggugggagucuuccaggacggcguguuucauacaauguggcacguuaccagaggggcugugcugauguaucagggaaaacggcucgaacccuccugggccucugucaagaaagaccugauuagcuacggcggcggguggagauuccagggauccuggaacacaggcgaggaggugcaagugaucgccguugaaccugggaagaaucccaaaaacguccagacgaccccgggaacauuuaagaccccugagggcgaagugggggcuauugcccucgauuucaagcccggaaccagcggcucuccuaucgugaaucgcgagggcaaaauugucgggcuguacggaaacggcgugguuacaacguccgggaccuaugugagcgcgaucgcucaggccaaggccucucaagaaggaccccuucccgagauugaggacgaagucuuuaaaaagcggaaucugacaaucauggaucugcacccuggcuccgggaaaaccagacgcuaccucccggcuaucgugcgggaggccauuaagagaaagcugcgcacacuuauccuggcgcccacccggguuguggcuagcgaaauggccgaggcccucaaaggcaugccuauuagauaucagacgacagcugucaaguccgaacauaccggacgcgagaucguggaccugaugugccacgccaccuucacaaugcggcugcucucucccguuagagugccuaacuacaauaugauuaucauggaugaggcucauuuuaccgaccccgccagcaucgcggcccggggcuauauuuccacacgcgucgggaugggagaagcugccgcuaucuucaugaccgccacgccuccgggcagcguggaggccuuuccccagucuaacgcugugauucaggaugaagagagagacaucccugaacgguccuggaauagcggguacgauuggauuacagacuuccccggaaaaaccgucugguuuguuccuucuaucaagagcggcaacgauaucgcgaauugucuucgcaaaaacgggaagagagugauucaacugucccggaagacauucgacaccgaguaucagaaaacgaagaacaaugacugggauuacguggucaccacagacaucucugagaugggcgccaacuucagagcugaucgcgugauugacccccggagaugccugaaaccgguuauccucaaggauggaccugaacgcgugauucuggccggccccaugcccgucaccguggccagcgcugcccagcggagagggcgcaucggacggaaucagaacaaagagggcgaccaauacguuuauauggggcagccucuuaauaacgaugaagaccacgcgcauuggacagaggcuaagaugcugcucgauaauauuaacacccccgagggaaucaucccugcccuguuugaaccggagagagaaaaguccgccgcuauugacggcgaguaccgccugagaggggaagcccggaaaacauucguggagcucaugcgcagaggcgaucuucccgucuggcugucuuauaagguggcgagcgagggauuucaguacuccgaccggcgcuggugcuucgauggcgaaagaaauaaccagguccuggaggaaaauauggacguggagaucuggaccaaagaaggggagcggaagaaacucagaccucgcuggcuggacgcccggacguauagcgauccccuugcucugagagaguuuaaggaauucgccgcuggacgccggucuguuuccggcgaccucauucuggagaucgggaaacugccucaacaccucacacuuagagcccagaacgcucuggauaaucuggugaugcuccacaacagcgaacagggaggcaaggccuaccggcaugcgauggaggaacugcccgacaccauugagacccuuaugcugcucgcccugaucgcugugcugacaggcggggucacccucuuuuuccuuuccggaaagggccuggggaaaacaucuaucggacugcucuguguuacggccagcuccgcucugcuuuggauggccucuguggagccgcacuggauugccgcuagcaucauucuggaauuuuuccucauggugcugcugaucccugagcccgaucgccagagaaccccucaagacaaucagcucgcguaugucgugauuggccuucuguuuaugauccugacaguugccgcuaacgaaauggggcuccuggagaccacaaagaaagaucuuggaaucggcuacguggccgccgagaaccaucagcacgcuaccaugcuggacgucgaucuccggcccgccuccgcguggacgcuguacgccguggcuaccacagucauuaccccuaugaugcgccacacaaucgaaaauaccacggccaacauuagccugacagcuaucgccaaucaagcggccauucucaugggccuugacaagggguggcccaucucuaaaauggauauuggagugccgcugcuggcucucggcugcuauucccagguuaacccucugacccuuacagccgcugugcugaugcucgucgcccauuacgcuaucaucgggcccggacugcaggccaaggcgaccagagaggcccagaagcggaccgcugccggcauuaugaaaaaucccacaguggacgggaucguugcuauugaucuggacccuguggucuaugacgccaaguucgaaaaacaacucggacagaucaugcuucugauucuguguacgagccagauccuccugaugcgcaccacaugggcccuuugcgagucuaucacccuggcgacaggcccgcucaccacgcugugggaaggcucccccgggaaguuuuggaacacaaccauugcugugagcauggccaauaucuucagaggaucuuaccuggcuggcgccgggcucgccuucagccuuaugaaaucccugggaggcgggcggcgcggaaccggcgcucagggcgagacacugggggagaaguggaagagacaacucaaccagcugucuaaaagcgaauuuaauaccuauaagcgguccggaauuauggagguggauagaagcgaagccaaagagggccuuaagcgcggggaaacaacgaaacacgcgguuucccggggaaccgccaagcugagaugguucgucgagcgcaaccucgugaagccugagggcaaagugaucgaccugggguguggacggggcggcuggucuuacuauugcgcugggcugaagaaagucacagaaguuaagggauacaccaaaggcgggcccggacaugaggaaccuauucccauggccacauacggcuggaaucucgugaagcuucacagcgggaaagauguguuuuucaugccuccggagaagugugacacccugcugugcgauaucggagaauccucucccaacccuacgaucgaggagggcagaacccuccgcguccugaagaugguggaacccuggcuuaaaggcaaucaguuuuguauuaagauccugaacccuuauaugcccagcguuguggagacacucgaacagaugcaacggaaacaugggggaaugcuggucagaaauccgcugucccgcaacucuacccacgagauguacugggugagcugcggcacagggaauauuguuuccgcugugaacaugaccagccggaugcuccugaacagauucacaauggcccaccgcaagccuaccuaugagcgggacgucgaucuuggagcgggcacgagacauguggccguggaacccgaggucgcuaaucuggacaucauugggcagcgcaucgaaaacauuaaaaaugagcacaagucuacauggcauuacgaugaagacaaccccuauaagaccugggccuaccacggauccuaugagguuaaaccuagcggcucugcuuccagcauggugaauggcguggucagacuccugaccaagcccugggaugugaucccuaugguuacacagaucgccaugacggacaccacaccguuugggcaacagcggguguucaaagagaaggucgacacccgcacacccagagcuaaacggggaaccacacagauuauggaagugaccgccaaguggcuuuggggcuuucugucuagaaacaagaaaccucggaucuguacgcgcgaggaauucaccagaaagguucgguccaaugcggccauuggggcuguguuugucgaugagaaccaguggaauagcgccaaagaagcuguggaggacgagcgcuucugggaucucguucacagagaacgggagcugcauaagcaaggaaaaugcgccacaugcguguacaacaugaugggcaagcgcgaaaagaaacugggggaguuuggcaaggccaaaggauccagagcgaucugguacauguggcucggcgcucgguuccuggaauucgaggcccuuggguuuaugaaugaggaccacugguucagccgcgaaaacucucugagcggagucgagggcgaagggcuccauaagcugggauauauucuuagagauaucuccaaaauccccggcgggaauauguacgccgacgauaccgcuggcugggacacacggauuaccgaggaugaccugcagaacgaggccaagaucacggauauuauggaaccugagcacgcucuccuggccacaucuaucuuuaaacugaccuaucagaauaaggugguccgcgugcagagacccgcgaagaacggaacaguuauggacgugauuagccggcgcgaucaaagaggcuccgggcaggucggaaccuacggccucaacacguucaccaauauggaagugcagcugauccggcagauggagucugaagggaucuuucuuccgagcgagcuggagacaccuaaccucgccgaaagagugcuggacuggcuugagaaacauggagcugaacgccugaagcggauggccauuuccggcgacgauuguguugugaaacccaucgacgauagauucgcuaccgcccucacagcgcugaaugacauggggaagguccgcaaagauauuccucaaugggagcccucuaagggcuggaacgacuggcagcaggugccuuuuugcagccaccacuuccaucagcugaucaugaaggauggacgggaaauuguugugcccuguagaaaucaagacgagcucgucggccgcgcccgggugucccagggggcuggauggagccugagagagaccgccugccuuggcaaaucuuaugcucagauguggcaacugauguacuuucaccgccgggaucucagacuggccgcuaacgccaucuguuccgcggucccgguggacuggguuccuacaagccgcaccacguggucuauccaugcccaccaccaguggaugacaaccgaagauaugcuuuccguguggaaucgggucuggauugaggaaaaccccuggauggaggacaagacccaugugagcuccugggaagagguucccuaucuggggaaaagagaggaccaguggugcggaucucucaucggccugacagcucgggccaccugggccacaaauauucagguggcuaucaaccaagucagacgccugauugggaaugaaaacuaccucgauuacaugacgagcaugaagcgguucaaaaaugaguccgacccugaaggcgcccugugguga

SEQ ID NO: 18781 - RNA, 9879 nt, Artificial Sequence
  derived and/or modified CDS sequence (opt5) from DENV-1__FJ639813__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucaugaacccugccguucuucgcaaacugugcauugaagcgaagaucucuaauacaaccacggacuccagauguccgacacaaggagaggccacccucguggaagagcaggaugcuaacuucgugugccggcgcaccuuugucgacagaggcuggggcaauggguguggacuguucggcaaagggagccuucugacaugcgccaaguuuaagugcgugaccaaacucgagggaaagauuguucaguacgaaaaccugaaauauucugugaucgucacagugcacacgggcgaucagcaucaaguugggaaugagaccacagaacacggaaccaucgcuacaauuaccccccaggccccuacguccgagauccagcugaccgacuacggcgcccucacacuggacuguagcccccggaccggccuugauuucaacgaaauggugcugcucacaaugaaggagaaaucuuggcugguccauaagcagugguuucuugaccugccucuccccuggaccuccggggcuagcacgucccaagagacauggaaucgccaggaucugcuggugaccuucaaaacagcgcacgccaagaagcaggaagucgugguucucggaucucaagagggcgcuaugcacaccgcccugaccggggccacagaaauucagacgagcggaaccacaaccaucuuugcuggccaucuuaaaugcagacugaagauggacaaacucacacugaaggggauguccuaugugauguguaccggcagcuucaaacuggagaaggaagucgccgagacgcagcacggaacagugcuuguucaggugaaguacgagggcaccgaugcgccgugcaaaauuccuuucucuacccaagacgaaaagggggucacacagaacggacggcucaucaccgcuaaucccaucgugacagauaaagagaagccugugaacauugaaacggagccccccuuuggcgaguccuauaucguugucggggccggagaaaaagcccugaagcugagcugguucaagaaaggcucuagcauugggaagauguuugaggcuaccgccagaggcgcucgccggauggccauccucggagacacagcgugggauuucggcuccauugggggaguguuuaccucugugggcaaacugguccaucagguguucgggacagccuacggaguucuuuuuagcggcguguccuggaccaugaagaucgggaucggcauucugcucacguggcugggacugaauagcagaucuaccuccuucagcaugacauguaucgcugucggcauggugacccuuuaccucgggguuauggugcaggccgacucuggaugcgucauuaacuggaaaggccgcgaacugaaguguggguccggaaucuuugugacaaacgagguucacaccuggacagaacaauauaaguuccaggcugauagcccuaaacggcuguccgccgcgauuggcaaggccugggaggagggggugugcggcaucagaucugcuacccgccucgaaaauauuauguggaaacagaucagcaacgagcugaaucauauccuucuggaaaacgacaugaaguuuacggucguggugggagacgccaauggcauucucgcucaggggaaaaagaugauccggccgcaacccauggagcacaaauacuccuggaagucuuggggaaaggccaaaauuaucggcgccgauauucagaacacaaccuucaucaucgacgggccugauacccccgaauguccugacggacagagagcuuggaauauuugggaggucgaggauuauggcuuuggcaucuucacaaccaacauuuggcugaagcugcgcgacagcuacacgcagaugugcgaucaccggcuuauguccgcggccaucaaagacagcaaggcuguucaugccgauaugggguauuggauugaaucugagaaaaaugaaacauggaagcucgccagagcuuccuucaucgaggugaagaccuguacauggcccaaaagccacacccuguggucuaacggagugcuggaauccgagaugaucauuccgaagaucuacggcgggccuauuagccaacauaauuaucgccccggauacuuuacacagaccgccggcccuuggcaccucgggaaacuggagcuugacuucgaucugugcgaaggaacgaccgucgugguugacgagcacugcggcaaccggggccccucucucagaacaaccacagugaccgggaagaucauucaugaaugguguugccggagcuguacgcugccuccccugcgcuuuagaggagaggauggcugcugguacgggauggagauccggccggucaaagaaaaggaggaaaaucuugugagauccaugguuagcgcgggaucuggcgagguggacuccuucagccucgggauccugugugucuccauuaugaucgaagaggugaugcgcucucgguggagcagaaagaugcugaugacaggaacccucgcuguuuuucugcuucugauuaugggccagcucacauggaacgaccugauccgccugugcauuauggugggcgccaaugccuccgauagaauggggaugggaaccaccuaucuugcucugauggccacauucaaaaugcggccuauguuugcggucggccuccuguuccgcagacucacgucucgggaggugcugcuucugaccaucgggcucagccugguggcuuccgucgaacugcccaacucucuugaggaacugggagacggccucgccauggggauuaugaugcugaagcuccugacagaguuucaaccccaccagcuuuggaccacacugcucagccugaccuucguuaaaacgacacugucccuugauuacgccuggaagaccaccgcuauggugcugagcaucgugucucucuuuccucugugucucuccacaaccagccagaaaacaacguggcugccgguccuucugggaucuuucggcugcaagccccugaccauguuucucaucacagaaaacaagauuuggggccgcaaauccuggccucugaaugaggggaucauggccauuggaaucgugagcauucuucugucuucccuccugaagaacgacguuccccucgcuggcccucugaucgccgggggaaugcuuaucgcguguuaugugauuagcggcuccagcgccgaucugucucuggagaaagcugccgaagucagcugggagcaggaagcugagcauuccggggccucucacaauauccucguggaaguucaagacgauggaaccaugaagauuaaagacgaggagagagaugacacacugaccauccuucugaaggccacgcuccuggcugugagcggcgucuaccccauguccauuccugcgacccucuucgugugguauuucuggcagaaaaagaagcagcggucuggcguccugugggauacacccagcccgccugaaguggagcgcgccguucuugacgaugggaucuacagaauccugcagcggggacugcucggccgcucccaagugggggucggaguguuucaggacggcguuuuccauaccauguggcacgugacaagaggggcuguccugauguaucagggaaaacggcuugaacccucuugggccagcgugaagaaagaccugauuuccuacggcggcggguggagauuucagggaagcuggaacaccggcgaggaggugcaaguuaucgccgucgaaccugggaagaaucccaaaaacgugcagacaacgccgggaaccuucaagacaccugagggcgaagugggggcuauugcccucgauuuuaagcccggaaccucuggcuccccuaucgucaaucgcgagggcaaaauuguggggcuguacggaaacggcguugugaccacaagcgggacguaugucucugcgaucgcucaggccaaggccucccaagaaggaccccuccccgagauugaggacgaaguguucaaaaagcggaaucugaccaucauggaucuucacccuggcagcgggaaaacaagacgcuaccugccggcuaucguucgggaggccauuaagagaaagcugcgcacccucauccuggcgcccacacggguggucgcuuccgaaauggccgaggcccuuaaaggcaugccuauuagauaucagaccacggcugugaagucugaacauacaggacgcgagaucguugaccugaugugccacgccaccuuuaccaugcggcuccugagccccgugagagucccuaacuacaauaugauuaucauggaugaggcucauuucacagaccccgccuccaucgcggcccggggcuauauuagcacccgcguggggaugggagaagcugccgcuaucuuuaugacagccaccccuccgggcucuguggaggccuucccccaguccaacgcugucauucaggaugaagagagagacaucccugaacggagcuggaauucuggguacgauuggauuacggacuuucccggaaaaacaguuugguucgugccuagcaucaaguccggcaacgauaucgcgaauugucugcgcaaaaacgggaagagagugauucaacucucucggaagaccuucgacacagaguaucagaaaaccaagaacaaugacugggauuacgucgugacgaccgacaucagcgagaugggcgccaacuuuagagcugaucgcguuauugacccccggagaugccuuaaaccggugauccugaaggauggaccugaacgcgucauucuggccggccccaugcccgugacaguugccuccgcugcccagcggagagggcgcaucggacggaaucagaacaaagagggcgaccaauacguguauauggggcagccucucaauaacgaugaagaccacgcgcauuggaccgaggcuaagaugcugcuugauaauauuaacacacccgagggaaucaucccugcccuguucgaaccggagagagaaaagucugccgcuauugacggcgaguaccgccucagaggggaagcccggaaaaccuuugucgagcugaugcgcagaggcgaucugcccguguggcucagcuauaaggucgcguccgagggauuccaguacagcgaccggcgcuggugcuuugauggcgaaagaaauaaccaggugcuugaggaaaauauggacguugagaucuggacaaaagaaggggagcggaagaaacugagaccucgcuggcuggacgcccggaccuauucugauccccucgcucugagagaguucaaggaauuugccgcuggacgccgguccgugagcggcgaccuuauucuggagaucgggaaacucccucaacaccugacgcugagagcccagaacgcucucgauaaucuugugaugcugcacaacuccgaacagggaggcaaggccuaccggcaugcgauggaggaacugcccgacacaauugagacccucaugcugcuugcccugaucgcuguccucaccggcgggguuacacuguucuuucugucuggaaagggccucgggaaaaccagcaucggacuucugugugugacagccuccucugcucugcucuggauggccagcguggagccgcacuggauugccgcuuccaucauucuggaauucuuucuuaugguccugcucaucccugagcccgaucgccagagaacgccucaagacaaucagcuggcguaugugguuauuggccugcucuucaugauccuuaccguggccgcuaacgaaauggggcugcuggagacaaccaagaaagaucucggaaucggcuacgucgccgccgagaaccaucagcacgcuacaaugcuggacguggaucuucggcccgccagcgcguggacccuguacgccgucgcuacgaccgugauuacaccuaugaugcgccacaccaucgaaaauacaaccgccaacauuucucucacggcuaucgccaaucaagcggccauucugaugggccuggacaagggguggcccaucuccaaaauggauauuggaguuccgcuccuugcucugggcugcuauagccaggugaacccucugacacucaccgccgcuguccugaugcuuguggcccauuacgcuaucaucgggcccggacugcaggccaaggcgacaagagaggcccagaagcggaccgcugccggcauuaugaaaaaucccaccguugacgggaucguggcuauugaucucgacccugucguguaugacgccaaguuugaaaaacaacugggacagaucaugcugcucauucuuuguacaucucagauccugcugaugcgcacgaccugggcccucugcgaguccaucacacuggcgaccggcccgcuuacaacccugugggaaggcagccccgggaaguucuggaacacgacaauugcugugucuauggccaauaucuucagaggaagcuaccucgcuggcgccgggcuggccuuuucccugaugaaaucucucggaggcgggcggcgcggaaccggcgcucagggcgagacccuuggggagaaguggaagagacaacugaaccagcugagcaaauccgaauucaauacauauaagcggagcggaauuauggagguugauagauccgaagccaaagagggccucaagcgcggggaaaccacaaaacacgcggucucucggggaacggccaagcugagaugguuuguggagcgcaaccuugugaagccugagggcaaagucaucgaccugggguguggacggggcggcuggagcuacuauugcgcugggcucaagaaaguuaccgaagugaagggauacacaaaaggcgggcccggacaugaggaaccuaugcccauggccaccuacggcuggaaucuggugaagcugcacuccgggaaagaugucuucuuuaugccuccggagaagugugacacacuccuuugcgauauuggagaaucuagccccaacccuaccaucgaggagggcagaacgcugcgcgugcugaagaugguugaacccuggcucaaaggcaaucaguucuguaucaagauucugaacccuuauaugcccuccguggucgagacccuugaacagaugcaacggaaacaugggggaaugcuggugagaaauccgcucucucgcaacagcacacacgagauguacuggguuuccugcggcaccgggaauaucgugagcgcugucaacaugacaucucggaugcugcugaacagauuuaccauggcccaccgcaagccuacauaugagcgggacguggaucucggagcgggcaccagacauguggccgucgaacccgagguugcuaaucuggacauuaucgggcagcgcauugaaaacaucaaaaaugagcacaaguccacguggcauuacgaugaagacaaccccuauaagacaugggccuaccacggaagcuaugaggugaaaccuucuggcuccgcuagcucuauggugaauggcgucgugagacuucugaccaagcccugggauguuauuccuauggugacccagaucgccaugacagacacgaccccguucgggcaacagcgggucuuuaaagagaagguggacacacgcacccccagagcuaaacggggaacaacccagaucauggaaguuacagccaaguggcucuggggcuuccuguccagaaacaagaaaccucggauuuguacccgcgaggaauuuacgagaaaggugcggagcaauuccgcgaucggggccgucuucguggaugagaaccaguggaauagcgcuaaagaagccguugaggacgagcgcuuuugggaucuugugcacagagaacgggagcugcauaagcaaggaaaaugcgcuaccugcgucuacaacaugaugggcaagcgcgaaaagaaacucggggaguucggcaaggccaaaggaucuagagccauuugguacauguggcugggcgcgcgguuccuggaauuugaggcucucggguucaugaaugaggaccacugguuuagccgcgaaaacucccugucuggaguggagggcgaagggcuucauaagcugggauauauccucagagauauuagcaaaauccccggcgggaauauguacgccgacgauacagccggcugggacacccggaucacagaggaugaccugcagaacgaggcuaagauuaccgauaucauggaaccugagcacgcccuucuggcuacguccauuuucaaacucacauaucagaauaaggucgugcgcguucagagacccgccaagaacggaaccgugauggacgucaucucucggcgcgaucaaagaggcagcgggcaggugggaacauacggccugaacaccuuuacgaauauggaagugcagcugauucggcagauggaguccgaagggaucuucucuccgagcgagcucgagaccccuaaccuggcggaaagaguucuugacuggcuggagaaacauggagccgaacgccucaagcggauggcuaucuccggcgacgauuguguggucaaacccauugacgauagauuugccacagcucugaccgcccuuaaugacauggggaaggugcgcaaagauaucccucaaugggagcccagcaagggcuggaacgacuggcagcagguuccuuucugcucucaccacuuucaucagcugauuaugaaggauggacgggaaaucgugguccccuguagaaaucaagacgagcucgugggccgcgcgcgggucucccagggggccggauggagccugagagagacagcuugccugggcaaaucuuaugcccagauguggcaacucauguacuuccaccgccgggaucugagacuugcugccaacgcuauuuguuccgccgugccgguugacugggugccuaccagccgcacaaccugguccauccaugcgcaccaccaguggaugacgacagaagauaugcugucugucuggaaucggguguggaucgaggaaaaccccuggauggaggacaagacccauguuagcuccugggaagaggugcccuaucucgggaaaagagaggaccaguggugcggaagccugauuggccuuaccgcccgggcuacaugggccaccaauauccaggucgccauuaaccaagugagacgccugaucgggaaugaaaacuaccucgauuacaugacaucuaugaagcgguuuaaaaaugaguccgacccugaaggcgcucugugguga

SEQ ID NO: 18782 - RNA, 9879 nt, Artificial Sequence
  derived and/or modified CDS sequence (opt5) from DENV-1__JN819412__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccccccuuuggcgaguccuauaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaucagguguucgggaccgccuacggaguucuuuuuagcggcguguccuggacgaugaagaucgggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuucgugaccaacgagguucacacauggaccgaacaauauaaguuucaggcugauagcccuaaacggcucuccgccgcgauuggcaaggccugggaggagggggugugcggcaucagaucugcuacgcgccuggaaaauauuauguggaaacagaucagcaacgagcuuaaucauauccugcucgaaaacgacaugaaguucacagucguggugggagacgccaauggcauucuggcucaggggaaaaagaugauccggccgcaacccauggagcacaaauacuccuggaagucuuggggaaaggccaaaauuaucggcgccgauauucagaacaccaccuuuaucaucgacgggccugauacacccgaauguccugacggacagagagcuuggaauauuugggaggucgaggauuauggcuucggcaucuuuaccacgaacauuuggcugaagcuucgcgacagcuacacacagaugugcgaucaccggcucauguccgcggccaucaaagacagcaaggcuguucaugccgauaugggguauuggauugaaucugagaaaaaugaaaccuggaagcuggccagagcuuccuucaucgaggugaagacauguaccuggcccaaaagccacacacuguggucuaacggagugcucgaauccgagaugaucauuccgaagaucuacggcgggccuauuagccaacauaauuaucgccccggauacuucacccagacggccggcccuuggcaccuggggaaacuugagcuggacuuugaucucugcgaaggaaccacagucgugguugacgagcacugcggcaaccggggccccucucugagaaccacaaccgugacggggaagaucauucaugaaugguguugccggagcuguacacugccuccccuucgcuucagaggagaggauggcugcugguacgggauggagauccggccggucaaagaaaaggaggaaaaucucgugagauccaugguuagcgcgggaucuggcgagguggacuccuuuagccuggggauccugugugucuccauuaugaucgaagaggugaugcgcucucgguggagcagaaagaugcucaugaccggaacacuggcuguuuuccuucugcucauuaugggccagcugaccuggaacgaccugauccgccuuugcauuauggugggcgccaaugccuccgauagaauggggaugggaaccacauaucuggcucucauggccacguuuaaaaugcggccuauguucgcggucggccugcucuuucgcagacugaccucucgggaggugcuucugcucacaaucgggcugagccugguggcuuccgucgaacuucccaacucucuggaggaacucggagacggccuggccauggggauuaugaugcucaagcugcuuaccgaguuccaaccccaccagcuguggacaacccuccugagccugacguuuguuaaaacaacccuuucccuggauuacgccuggaagaccacagcuauggugcucagcaucgugucucuguucccucucugucuguccaccacaagccagaaaacgaccuggcuuccgguccugcugggaucuuuuggcugcaagccccucacaauguuccugaucaccgaaaacaagauuuggggccgcaaauccuggccucuuaaugaggggaucauggccauuggaaucgugagcauucugcucucuucccugcucaagaacgacguuccccuggcuggcccucuuaucgccgggggaaugcugaucgcguguuaugugauuagcggcuccagcgccgaucugcuccuggagaaagcugccgaagucucuugggagcaggaagcugagcauagcggggccucccacaauauccuuguggaaguucaagacgauggaacaaugaagauuaaagacgaggagagagaugacacccugacgauccuccugaaggccacccuccuggcugugucuggcgucuaccccaugagcauuccugcgacacuuuuugugugguauuucuggcagaaaaagaagcagcgguccggcguccugugggauacccccucuccgccugaaguggagcgcgccguucuggacgaugggaucuacagaauccuccagcggggacugcuuggccgcagccaagugggggucggaguguuccaggacggcguuuuucauacaauguggcacgugaccagaggggcuguccugauguaucagggaaaacggcucgaacccuccugggccucugugaagaaagaccugauuagcuacggcggcggguggagauuccagggauccuggaacacaggcgaggaggugcaaguuaucgccgucgaaccugggaagaaucccaaaaacgugcagacgaccccgggaacauuuaagaccccugagggcgaagugggggcuauugcccucgauuucaagcccggaaccagcggcucuccuaucgucaaucgcgagggcaaaauuguggggcuguacggaaacggcguugugacaacguccgggaccuaugucagcgcgaucgcucaggccaaggccucucaagaaggaccccuucccgagauugaggacgaaguguuuaaaaagcggaaucugacaaucauggaucugcacccuggcuccgggaaaaccagacgcuaccucccggcuaucguucgggaggccauuaagagaaagcugcgcacacuuauccuggcgcccacccggguggucgcuagcgaaauggccgaggcccucaaaggcaugccuauuagauaucagacgacagcugugaaguccgaacauaccggacgcgagaucguugaccugaugugccacgccaccuucacaaugcggcugcucucucccgugagagucccuaacuacaauaugauuaucauggaugaggcucauuuuaccgaccccgccagcaucgcggcccggggcuauauuuccacacgcguggggaugggagaagcugccgcuaucuucaugaccgccacgccuccgggcagcguggaggccuuuccccagucuaacgcugucauucaggaugaagagagagacaucccugaacgguccuggaauagcggguacgauuggauuacagacuuccccggaaaaaccguuugguuugugccuucuaucaagagcggcaacgauaucgcgaauugucuucgcaaaaacgggaagagagugauucaacugucccggaagacauucgacaccgaguaucagaaaacgaagaacaaugacugggauuacgucgugaccacagacaucucugagaugggcgccaacuucagagcugaucgcguuauugacccccggagaugccugaaaccggugauccucaaggauggaccugaacgcgucauucuggccggccccaugcccgugaccguugccagcgcugcccagcggagagggcgcaucggacggaaucagaacaaagagggcgaccaauacguguauauggggcagccucuuaauaacgaugaagaccacgcgcauuggacagaggcuaagaugcugcucgauaauauuaacacccccgagggaaucaucccugcccuguuugaaccggagagagaaaaguccgccgcuauugacggcgaguaccgccugagaggggaagcccggaaaacauucgucgagcucaugcgcagaggcgaucuucccguguggcugucuuauaaggucgcgagcgagggauuucaguacuccgaccggcgcuggugcuucgauggcgaaagaaauaaccaggugcuggaggaaaauauggacguugagaucuggaccaaagaaggggagcggaagaaacucagaccucgcuggcuggacgcccggacguauagcgauccccuugcucugagagaguuuaaggaauucgccgcuggacgccggucuguguccggcgaccucauucuggagaucgggaaacugccucaacaccucacacuuagagcccagaacgcucuggauaaucuggugaugcuccacaacagcgaacagggaggcaaggccuaccggcaugcgauggaggaacugcccgacaccauugagacccuuaugcugcucgcccugaucgcuguccugacaggcgggguuacccucuuuuuccuuuccggaaagggccuggggaaaacaucuaucggacugcucugugugacggccagcuccgcucugcuuuggauggccucuguggagccgcacuggauugccgcuagcaucauucuggaauuuuuccucaugguccugcugaucccugagcccgaucgccagagaaccccucaagacaaucagcucgcguaugugguuauuggccuucuguuuaugauccugacaguggccgcuaacgaaauggggcuccuggagaccacaaagaaagaucuuggaaucggcuacgucgccgccgagaaccaucagcacgcuaccaugcuggacguggaucuccggcccgccuccgcguggacgcuguacgccgucgcuaccacagugauuaccccuaugaugcgccacacaaucgaaaauaccacggccaacauuagccugacagcuaucgccaaucaagcggccauucucaugggccuugacaagggguggcccaucucuaaaauggauauuggaguuccgcugcuggcucucggcugcuauucccaggugaacccucugacccuuacagccgcuguccugaugcucguggcccauuacgcuaucaucgggcccggacugcaggccaaggcgaccagagaggcccagaagcggaccgcugccggcauuaugaaaaaucccacaguugacgggaucguggcuauugaucuggacccugucguguaugacgccaaguucgaaaaacaacucggacagaucaugcuucugauucuguguacgagccagauccuccugaugcgcaccacaugggcccuuugcgagucuaucacccuggcgacaggcccgcucaccacgcugugggaaggcucccccgggaaguuuuggaacacaaccauugcugugagcauggccaauaucuucagaggaucuuaccuggcuggcgccgggcucgccuucagccuuaugaaaucccugggaggcgggcggcgcggaaccggcgcucagggcgagacacugggggagaaguggaagagacaacucaaccagcugucuaaaagcgaauuuaauaccuauaagcgguccggaauuauggagguugauagaagcgaagccaaagagggccuuaagcgcggggaaacaacgaaacacgcggucucccggggaaccgccaagcugagaugguucguggagcgcaaccucgugaagccugagggcaaagucaucgaccugggguguggacggggcggcuggucuuacuauugcgcugggcugaagaaaguuacagaagugaagggauacaccaaaggcgggcccggacaugaggaaccuauucccauggccacauacggcuggaaucucgugaagcuucacagcgggaaagaugucuuuuucaugccuccggagaagugugacacccugcugugcgauaucggagaauccucucccaacccuacgaucgaggagggcagaacccuccgcgugcugaagaugguugaacccuggcuuaaaggcaaucaguuuuguauuaagauccugaacccuuauaugcccagcguggucgagacacucgaacagaugcaacggaaacaugggggaaugcuggugagaaauccgcugucccgcaacucuacccacgagauguacuggguuagcugcggcacagggaauauuguguccgcugucaacaugaccagccggaugcuccugaacagauucacaauggcccaccgcaagccuaccuaugagcgggacguggaucuuggagcgggcacgagacauguggccgucgaacccgagguugcuaaucuggacaucauugggcagcgcaucgaaaacauuaaaaaugagcacaagucuacauggcauuacgaugaagacaaccccuauaagaccugggccuaccacggauccuaugaggugaaaccuagcggcucugcuuccagcauggugaauggcgucgugagacuccugaccaagcccugggauguuaucccuauggugacacagaucgccaugacggacaccacaccguuugggcaacagcgggucuucaaagagaagguggacacccgcacacccagagcuaaacggggaaccacacagauuauggaaguuaccgccaaguggcuuuggggcuuucugucuagaaacaagaaaccucggaucuguacgcgcgaggaauucaccagaaaggugcgguccaaugcggccauuggggcugucuuuguggaugagaaccaguggaauagcgccaaagaagcuguugaggacgagcgcuucugggaucucgugcacagagaacgggagcugcauaagcaaggaaaaugcgccacaugcgucuacaacaugaugggcaagcgcgaaaagaaacugggggaguuuggcaaggccaaaggauccagagcgaucugguacauguggcucggcgcucgguuccuggaauucgaggcccuuggguuuaugaaugaggaccacugguucagccgcgaaaacucucugagcggaguggagggcgaagggcuccauaagcugggauauauucuuagagauaucuccaaaauccccggcgggaauauguacgccgacgauaccgcuggcugggacacacggauuaccgaggaugaccugcagaacgaggccaagaucacggauauuauggaaccugagcacgcucuccuggccacaucuaucuuuaaacugaccuaucagaauaaggucgugcgcguucagagacccgcgaagaacggaacagugauggacgucauuagccggcgcgaucaaagaggcuccgggcaggugggaaccuacggccucaacacguucaccaauauggaagugcagcugauccggcagauggagucugaagggaucuuucuuccgagcgagcuggagacaccuaaccucgccgaaagaguucuggacuggcuugagaaacauggagcugaacgccugaagcggauggccauuuccggcgacgauuguguggucaaacccaucgacgauagauucgcuaccgcccucacagcgcugaaugacauggggaaggugcgcaaagauauuccucaaugggagcccucuaagggcuggaacgacuggcagcagguuccuuuuugcagccaccacuuccaucagcugaucaugaaggauggacgggaaauugugguccccuguagaaaucaagacgagcucgugggccgcgcccgggucucccagggggcuggauggagccugagagagaccgccugccuuggcaaaucuuaugcucagauguggcaacugauguacuuucaccgccgggaucucagacuggccgcuaacgccaucuguuccgcggugccgguugacugggugccuacaagccgcaccacguggucuauccaugcccaccaccaguggaugacaaccgaagauaugcuuuccgucuggaaucggguguggauugaggaaaaccccuggauggaggacaagacccauguuagcuccugggaagaggugcccuaucuggggaaaagagaggaccaguggugcggaucucucaucggccugacagcucgggccaccugggccacaaauauucaggucgcuaucaaccaagugagacgccugauugggaaugaaaacuaccucgauuacaugacgagcaugaagcgguucaaaaaugaguccgacccugaaggcgcccugugguga

SEQ ID NO: 18783 - RNA, 9879 nt, Artificial Sequence
  derived and/or modified CDS sequence (opt5) from DENV-1__FJ810415__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggagucaucuuuauucuccugaugcuugugaccccuagcauggcuaugagaugcguuggcaucgggaaccgggacuucguggagggacuguccggcgccacaugggucgauguggugcucgaacacgggagcugugucacgaccauggcuaagaauaaacccacacuggacauugagcugcucaagaccgaaguuacaaacccugccgugcugcgcaaacuuugcaucgaggcgaagauuucuaauaccacgacagauuccagauguccgacccaaggagaagccacccugguggaggagcaggacgcuaacuuugucugccggcgcacauucguggauagaggcuggggcaauggguguggacucuuuggcaaagggagccugcuuaccugcgccaaguucaagugcguuacaaaacuggaaggaaagaucgugcaguacgagaaccucaaauauucugucauugugacgguucacaccggcgaccagcaucaaguggggaaugaaacaaccgagcacggaacaaucgcuaccaucacgccccaggccccuaccuccgaaauucagcugacagauuacggcgcccugacccucgacuguagcccccggacaggccuggacuuuaacgagaugguccuucugaccaugaaggagaaaucuuggcucgugcauaagcagugguuccuggaucuuccucugcccuggacguccggggcuagcacaucccaagaaaccuggaaucgccaggaccuccuggucacauuuaaaaccgcgcacgccaagaagcaggaggugguugugcugggaucucaagaaggcgcuaugcacaccgcccucacaggggccacggagauccagaccagcggaacaaccacaauuuucgcuggccaucugaaaugcagacuuaagauggauaaacugacccucaaggggauguccuaugucauguguacgggcagcuucaaacuggaaaaggagguggccgagacacagcacggaaccguucuggugcaggucaaguacgaaggcaccgacgcgccgugcaaaaucccuuuuucuacacaagaugagaagggggugacccagaacggacggcuuauuacagcuaaucccaucgugacggacaaagaaaagccuguuaacaucgagaccgagccccccuucggcgaauccuauauugucgugggggccggagagaaagcccucaagcugaauugguuuaagagaggcagcucuaucgggaaaauguucgaagcuacagcccgcggcgcucggagaauggccauucugggagauaccgcgugggacuuuggcagcaucgggggaguguucacauccgucggcaagcucgugcaucagguuuuugggaccgccuacggagugcuguucucuggcgucagcuggacgaugaaaauugggaucggcauccuucugaccuggcucggacugaacucccgcagcacaucucuguccaugaccuguauugcugugggcaugguuacacuuuaccucggggugaugguccaggccgauagcggaugcgugaucaacuggaagggccgggagcugaaaugugggucuggaauuuuuguuaccaaugaagugcacacauggaccgagcaauauaaguuccaggcugacuccccuaagagacugagcgccgcgaucggcaaagccugggaggaaggggucugcggcauucgcuccgcuacgcggcucgagaacaucauguggaagcagauuucuaaugaacugaaccauauccuucuggagaaugauaugaaauuuacagugguggucggagacgccaacggcauccucgcucaggggaagaaaaugauuagaccgcaacccauggaacacaaguacagcuggaaauccuggggaaaggccaagaucauuggcgccgacauccagaauaccaccuucauuaucgaugggccugacacacccgaguguccugauggacagcgcgcuuggaacaucugggagguugaagacuauggcuuuggcguguucaccacgaauauuuggcugaaacugcgggauucuuacacacagaugugcgaccacagacuuaugagcgcggccaucaaggauuccaaagcugugcaugccgacaugggguauuggauugagagcgaaaagaacgagaccuggaaacucgcccgcgcuucuuucaucgaagucaagacauguaccuggcccaagucccacacacuguggagcaauggagugcuggagucugagaugauuaucccgaaaaucuacggcgggccuauuucccaacauaacuaucggcccggauacuuuacccagacggccggcccuuggcaccucgggaagcuggaacuugauuucgaccugugcgagggaaccacaguuguggucgaugaacacugcggcaauagaggccccagccuccggaccacaaccgugacggggaaaaucauucaugagugguguugccgcucuuguacacugccuccccugagauuucggggagaggacggcugcugguacgggauggaaaucagaccgguuaaggagaaagaagagaaccuugugcgcagcauggucuccgcgggaagcggcgaaguggauucuuucucccucgggauucuguguguuagcaucaugaucgaggaggugaugcgguccagauggucucgcaagaugcugaugaccggaacacucgcugucuuucugcuucugauuaugggccagcucaccuggaaugaccugaucagacugugcauuauggugggcgccaacgccagcgaccggauggggaugggaaccacauaucuugcucugauggccacguucaagaugcgcccuauguuugcggugggccuccuguucagacggcucaccucccgcgaaguccugcuucugacaaucgggcucucucugguugcuagcguggagcugcccaacucccuugaagagcugggagauggccucgccauggggauuaugaugcugaaacuccugaccgaauuucaaccccaccagcuuuggacaacccugcucucucugacguucgugaagacaacccugagccuugacuacgccuggaaaaccacagcuaugguccuguccaucgugagccucuuuccucugugucucucuaccacaucccagaagacgaccuggcugccgguucuucugggaagcuucggcugcaaaccccugacaauguuucucauuaccgagaauaagaucuggggcagaaagucuuggccucugaacgaggggaucauggccauuggaaucguguccauucuucugagcucucuccugaaaaaugaugucccccucgcuggcccucugaucgccgggggaaugcuuauugcguguuaugugaucuccggcagcuccgccgaccugagccuggaaaaggcugccgagguuucuugggaacaggaggcugaacauagcggggccucccacaacauccucguggagguccaagaugacggaacaaugaaaauuaaggaugaggaacgggacgauacccugacgauccuucugaaagccacccuccuggcugugucuggcgucuaccccaugagcauuccugcgacacucuucgugugguauuucuggcagaagaaaaagcagcgcuccggcguucugugggacacccccucuccgccugagguggaaagagccguccuugaugacgggaucuaccggauucugcagcgcggacugcucggcagaagccaaguggggguuggaguguuucaggauggcgucuuccauacaauguggcacgugacccggggggcugugcugauguaucagggaaagagacuugagcccuccugggccucuguuaaaaaggaccugaucagcuacggcggcggguggcgcuuucagggauccuggaauacaggcgaggaaguccaagugaucgccguggagccugggaaaaaccccaagaauguccagacgaccccgggaacauucaaaaccccugaaggcgaggugggggcuauugcccucgacuuuaagcccggaaccagcggcucuccuaucguuaaccgggaaggcaagauuguggggcuguacggaaauggcgucgugacaacguccgggaccuauguuagcgcgaucgcucaggccaaagccucucaagagggaccccuccccgagauugaagaugagguguucaagaaaagaaaccugacaaucauggaccuucacccuggcuccgggaagacccgccgguaccugccggcuauugucagagaagccaucaaacgcaagcugcggacacucauccuggcgcccaccagagugguugcuagcgagauggccgaagcccuuaagggcaugccuauucgcuaucagacgacagcugugaaauccgagcauaccggacgggagaucgucgaucugaugugccacgccaccuuuacaaugagacuccugucucccgugcgggugccuaauuacaacaugauuaucauggacgaagcucauuucaccgaucccgccagcauugcggcccgcggcuauaucuccacaagagucgggaugggagaggcugccgcuaucuuuaugaccgccacgccuccgggcagcguugaagccuucccccagucuaaugcugugauucaggacgaggaacgggauaucccugagcgcuccuggaacagcggguacgacuggauuacagauuuucccggaaagaccgugugguucgucccuucuaucaaaagcggcaaugacauugcgaacugucugagaaagaacgggaaacgggugauccaacucuccagaaagacauucgauaccgaguaucagaagacgaaaaauaacgacugggacuacguugugaccacagauaucucugaaaugggcgccaauuuucgcgcugaccgggucauugaucccagacgcugccuuaagccggugauccugaaagacggaccugagcggguuauucuggccggccccaugcccgugaccgucgccagcgcugcccagagacgcgggcggaucggaagaaaccagaauaaggaaggcgaucaauacguguauauggggcagccucucaacaaugacgaggaucacgcgcauuggacagaggcuaaaaugcugcuugacaacauuaauacccccgaaggaaucauuccugcccuguucgagccggaacgcgagaaguccgccgcuaucgauggcgaauacagacuccggggggaggcccgcaagacauuugucgagcugaugagacggggcgaccugcccguguggcucucuuauaaaguugcgagcgaaggauuccaguacuccgaucgcagauggugcuuugacggcgagcggaacaaucaggugcuugaagagaacauggauguggaaaucuggaccaaggagggggagagaaaaaagcugcgcccucgguggcuggacgccagaacguauagcgacccccucgcucugcgcgaauucaaagaguuugccgcuggacggagaucugucuccggcgaucuuauucuggaaaucgggaagcucccucaacaccugacacugcgggcccagaaugcucucgacaaccuuguuaugcugcacaauagcgagcagggaggcaaagccuaccgccaugcgauggaagagcugcccgauaccauugagacccucaugcugcuugcccugaucgcugugcucacaggcggggugacccuguucuuucuguccggaaagggccucgggaagacaucuauuggacuucugugugucacggccagcuccgcucugcucuggauggccucuguggaaccgcacuggaucgccgcuagcaucauucuggaguucuuucuuaugguucugcucaucccugaacccgacagacagcggaccccucaagauaaccagcuggcguauguggucauuggccugcucuucaugauccuuacaguggccgcuaacgagauggggcugcuggagaccacaaaaaaggaccucggaauuggcuacgucgccgccgaaaaucaucagcacgcuaccaugcuggauguggaccuucaccccgccuccgcguggacgcuguacgccguugcuaccacagugaucaccccuaugaugcgccauacaaucgagaacaccacggccaauauuagccucacagcuaucgccaaccaagcggccauucugaugggccuggauaaaggguggcccaucucuaagauggacauuggagucccgcuccuugcucugggcugcuauucccaggugaauccucugacccucacagccgcuguucugaugcuuguggcccacuacgcuaucauugggcccggacugcaggccaaagcgaccagagaagcccagaagcggaccgcugccggcaucaugaagaaccccacagucgaugggaucguggcuauugaccucgauccugugguuuaugacgccaaauuugagaagcaacugggacagaucaugcugcucauucuuuguacgagccagauccugcugaugcgcaccacaugggcccucugcgaaucuauuacccuggcgacaggcccgcuuaccacgcugugggagggcucccccgggaaauucuggaauacaaccaucgcugucagcauggccaacaucuucagaggaucuuaccucgcuggcgccgggcuggccuuuagccugaugaagucccucggaggcgggcggcgcggaaccggcgcucagggcgagacacuuggggaaaaauggaagagacaacugaaucagcugucuaagagcgaguucaacaccuauaaacgguccggaauuauggaaguggacagaagcgaggccaaggaaggccucaaacgcggggagacaacgaagcaugcggugucccggggaaccgccaaacugagaugguuugucgagcgcaaucuuguuaagccugaaggcaaggugaucgaucugggguguggacggggcggcuggucuuacuauugcgcugggcucaaaaaggugacagaggucaaaggauacaccaagggcgggcccggacacgaagagccuauucccauggccacauacggcuggaaccuggugaaacugcauagcgggaaggacguuuucuuuaugccuccggaaaaaugugauacccuccuuugcgacaucggagaguccucucccaauccuacgauugaggaaggcagaacccugcgcgugcugaagauggucgagcccuggcuccggggcaaccaguucuguaucaagauccugaauccuuauaugcccagcgugguugaaacacuugagcagaugcaaagaaaacacgggggaaugcuggugcgcaacccgcucucccggaauucuacccacgagauguacugggucagcugcggcacagggaacauuguguccgcugugaacaugaccagcagaaugcugcugaaucgcuuuacaauggcccaucggaagccuaccuaugaaagagaugucgaccucggagcgggcacgcgccacguugccguggagcccgaaguggcuaaccuggauaucauugggcagagaaucgagaauauuaaaaacgaacauaagucuacauggcacuacgacgaggauaaucccuauaaaaccugggccuaccacggauccuaugaggucaagccuagcggcucugcuuccagcauggugaacggcguugugcggcuucugaccaagcccugggacgucaucccuauggugacacagauugccaugacggauaccacaccguucgggcaacagcgcguuuuuaaagaaaagguggacaccagaacaccccgggcuaaaagaggaaccacacagaucauggaggucaccgccaaguggcucuggggcuuccugucucggaauaaaaagccucgcaucuguacgagagaagaguuuacccggaaggugcgcuccaacgcggccauuggggcuguuuucguggacgaaaaucaguggaacagcgccaaagaggcugucgaggaugaaagauuuugggaccuugugcaucgggagcgcgaacugcacaagcaaggaaaaugcgccacaugcgucuacaauaugaugggcaagagagagaaaaagcucggggaauucggcaaggccaaaggaucccgggcgaucugguacauguggcugggcgcucgcuuccuggaguuugaggcccucggguucaugaacgaagaucauugguuuagcagagagaauucucugagcggaguggaaggcgaggggcuucacaagcugggauauauucuccgggacaucuccaaaauucccggcgggaacauguacgccgaugacaccgcuggcugggauacacgcaucaccgaggacgaucugcagaaugaagccaagaucacggacauuauggagccugaacaugcucuucuggccacaucuaucuucaaacucaccuaucagaacaagguugugagaguccagcggcccgcgaaaaacggaacagugauggaugugauuagccgcagagaccaacggggcuccgggcagguuggaaccuacggccugaauacguuuaccaacauggaggugcagcugaucagacagauggaaucugaggggauuuuccucccgagcgagcuggaaacaccuaaucuugccgagcgcgcucuggauuggcucgaaaagcacggagccgagcggcugaagagaauggcuaucuccggcgacgacugugucgugaaacccaucgaugaccgcuuugccaccgcgcuuacagcccugaacgauauggggaagguucggaaagacauuccucaaugggaacccucuaagggcuggaaugauuggcagcaggugccuuucugcagccaccauuuucaccagcucaucaugaaagacggaagagagauugucgugcccugucgcaaccaagaugagcuggucggccgggcuagagugucccagggggccggauggagccugcgcgaaaccgcuugccucggcaagucuuaugcccagauguggcaacugauguacuuccaucggagagaccuucgccuggcugccaaugcgaucuguuccgccguuccgguggauugggucccuacaagccggaccacguggucuauucacgcucaccaucaguggaugacaaccgaggacaugcucuccguguggaacagaguuuggaucgaagagaaucccuggauggaagauaagacccacgugagcuccugggaggagguccccuaucuggggaaacgggaagaccaguggugcggaucucuuaucggccugacagccagagccaccugggcuacaaacauucagguggccaucaaucaagugcgccggcucauugggaacgagaauuaccuggacuacaugacgagcaugaagagauuuaaaaacgaauccgauccugagggcgcgcugugguga

SEQ ID NO: 18784 - RNA, 9879 nt, Artificial Sequence
  derived and/or modified CDS sequence (opt5) from DENV-1__FJ639814__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccccccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagguguuugggaccgccuacggaguucuguucagcggcguguccuggacgaugaaaaucgggaucggcauucuucugaccuggcucggacugaauagccgcucuacaucccugagcaugaccuguaucgcugucggcauggugacacuuuaccucgggguuauggugcaggccgauucuggaugcgucauuaacuggaagggccgggagcugaaauguggguccggaaucuuugugaccaacgaaguucacacauggaccgagcaauauaaguuccaggcugacagcccuaagagacuguccgccgcgauuggcaaagccugggaggaaggggugugcggcauccgcucugcuacgcggcucgagaauauuauguggaagcagaucagcaacgaacugaaucauauccuucuggagaacgauaugaaauuuacagucguggugggagacgccaauggcauucucgcucaggggaagaaaaugaucagaccgcaacccauggaacacaaguacuccuggaaaucuuggggaaaggccaagauuaucggcgccgacauucagaacaccaccuucaucaucgaugggccugacacacccgaguguccugauggacagcgcgcuuggaauauuugggaggucgaagacuauggcuuuggcguuuucaccacgaacaucuggcugaaacugcgggauagcuacacacagaugugcgaccacagacuuauguccgcggccauuaaggauagcaaagcugugcaugccgacaugggguauuggaucgagucugaaaagaaugagaccuggaaacucgcccgcgcuuccuucauugaagugaagacauguaccuggcccaagagccacacacuguggucuaacggaguccuggaguccgagaugaucaucccgaaaauuuacggcgggccuaucagccaacauaauuaucggcccggauacuuuacccagacggccggcccuuggcaccucgggaagcuggaacuugauuucaaccugugcgagggaaccacagugguuguggacgaacacugcggcaauagaggccccucucuccggaccacaaccgucacggggaaaauuauccaugagugguguugccgcagcuguacacugccuccccugagauuucggggagaggauggcugcugguacgggauggaaauuagaccggugaaggagaaagaagagaaccuuguucgcuccauggugagcgcgggaucuggcgaagucgacuccuucagccucgggauccuguguguguccaucaugauugaggagguuaugcggucuagauggagccgcaagaugcugaugaccggaacacucgcuguguuucugcuucugaucaugggccagcucaccuggaaugaucugauuagacugugcaucauggucggcgccaacgccuccgaccggauggggaugggaaccacauaucuugcucugauggccacguucaagaugcgcccuauguuugcggugggccuccuguucagacggcucaccucucgcgaagugcugcuucugacaauugggcucagccuggucgcuuccguugagcugcccaacucucuugaagagcugggagacggccucgccauggggaucaugaugcugaaacuccugaccgaauuucaaccccaccagcuuuggacaacccugcucagccugacguucgugaagacaacccugucccuugauuacgccuggaaaaccacagcuauggugcugagcauugucucucucuuuccucugugucucuccaccacaagccagaagacgaccuggcugccggugcuucugggaucuuucggcugcaaaccccugacaauguuucucaucaccgagaauaagaucuggggcagaaaguccuggccucugaacgaggggauuauggccaucggaauuguuagcauccuucugucuucccuccugaaaaaugacgugccccucgcuggcccucugauugccgggggaaugcuuaucgcguguuaugucaucagcggcuccagcgccgaucugucucuggaaaaggcugccgaggugagcugggaacaggaggcugaacauuccggggccucucacaacauucucguugaggugcaagacgauggaacaaugaaaaucaaggacgaggaacgggaugacacccugacgauucuucugaaagccacccuccuggcugucagcggcguguaccccauguccaucccugcgacacucuucgucugguauuucuggcagaagaaaaagcagcgcucuggcgugcugugggauacccccagcccgccugagguugaaagagccgugcuugacgaugggauuuaccggauccugcagcgcggacugcucggcagaucccaagucggggugggaguuuuucaggacggcguguuccauacaauguggcacgucacccggggggcugugcugauguaucagggaaagagacuugagcccucuugggccagcgugaaaaaggaucugaucuccuacggcggcggguggcgcuuucagggaagcuggaauacaggcgaggaaguucaagucauugccguggagccugggaaaaaccccaagaaugugcagacgaccccgggaacauucaaaaccccugaaggcgaggucggggcuaucgcccucgacuuuaagcccggaaccucuggcuccccuauugugaaccgggaaggcaagaucguugggcuguacggaaauggcguggucacaacgagcgggaccuaugugucugcgauugcucaggccaaagccucccaagagggaccccuccccgagaucgaagacgagguuuucaagaaaagaaaccugacaauuauggaucuucacccuggcagcgggaagacccgccgguaccugccggcuaucgugagagaagccaucaaacgcaagcugcggacacucauucuggcgcccaccagagucguggcuuccgagauggccgaagcccuuaagggcaugccuauccgcuaucagacgacagcuguuaaaucugagcauaccggacgggagauuguggaccugaugugccacgccaccuuuacaaugagacuccugagccccguccgggugccuaauuacaacaugaucauuauggaugaagcucauuucaccgaccccgccuccaucgcggcccgcggcuauaucagcacaagaguggggaugggagaggcugccgcuauuuuuaugaccgccacgccuccgggcucugucgaagccuucccccaguccaaugcuguuauccaggaugaggaacgggacauuccugagcgcagcuggaacucuggguacgauuggaucacagacuuucccggaaagaccgugugguucgugccuagcauuaaauccggcaaugauaucgcgaacugucugagaaagaacgggaaacgggucauccaacucucuagaaagacauucgacaccgaguaucagaagacgaaaaauaacgauugggacuacgugguuaccacagacauuagcgaaaugggcgccaauuuucgcgcugaucgggugaucgaccccagacgcugccuuaagccggucauucugaaagauggaccugagcgggugauccuggccggccccaugcccguuaccguggccuccgcugcccagagacgcgggcggauuggaagaaaccagaauaaggaaggcgaccaauacgucuauauggggcagccucucaacaaugaugaggaccacgcgcauuggacagaggcuaaaaugcugcuugauaacaucaauacccccgaaggaauuaucccugcccuguucgagccggaacgcgagaagucugccgcuaucgacggcgaauacagacuccggggggaggcccgcaagacauuuguggagcugaugagacggggcgaucugcccgucuggcucagcuauaaaguggcguccgaaggauuccaguacagcgaccgcagauggugcuuugauggcgagcggaacaaucagguucuugaagagaacauggacguggaaauuuggaccaaggagggggagagaaaaaagcugcgcccucgguggcuggaugccagaacguauucugacccccucgcucugcgcgaauucaaagaguuugccgcuggacggagauccgugagcggcgaccuuauccuggaaauugggaagcucccucaacaccugacacugcgggcccagaaugcucucgauaaccuugucaugcugcacaauuccgagcagggaggcaaagccuaccgccaugcgauggaagagcugcccgacaccaucgagacccucaugcugcuugcccugauugcuguucucacaggcggggugacccuguucuuucugucuggaaagggccucgggaagacaagcaucggacuucugugugugacggccuccucugcucugcucuggauggccagcgucgaaccgcacuggaucgccgcuuccauuauccuggaguucuuucuuauggugcugcucauuccugaacccgauagacagcggaccccucaagacaaccagcuggcguauguugugaucggccugcucuucaugauucuuacagucgccgcuaacgagauggggcugcuggagaccacaaaaaaggaucucggaaucggcuacguggccgccgaaaaucaucagcacgcuaccaugcuggacgucgaucuucaccccgccagcgcguggacgcuguacgccguggcuaccacaguuaucaccccuaugaugcgccauacaauugagaacaccacggccaauaucucucucacagcuauugccaaccaagcggccauccugaugggccuggacaaaggguggcccauuuccaagauggauaucggagugccgcuccuugcucugggcugcuauagccaggucaauccucugacccucacagccgcugugcugaugcuuguugcccacuacgcuauuaucgggcccggacugcaggccaaagcgaccagagaagcccagaagcggaccgcugccggcaucaugaagaaccccacaguggacgggauugucgcuaucgaucucgacccugugguguaugaugccaaauuugagaagcaacugggacagauuaugcugcucauccuuuguacgucucagauucugcugaugcgcaccacaugggcccucugcgaauccaucacccuggcgacaggcccgcuuaccacgcugugggagggcagccccgggaaauucuggaauacaaccaucgcuguuucuauggccaacauuuucagaggaagcuaccucgcuggcgccgggcuggccuuuucccugaugaagucucucggaggcgggcggcgcggaaccggcgcucagggcgagacacuuggggaaaaauggaagagacaacugaaucagcugagcaaguccgaguucaacaccuauaaacggagcggaaucauggaagucgacagauccgaggccaaggaaggccucaaacgcggggagacaacgaagcaugcggugucucggggaaccgccaaacugagaugguuuguggagcgcaaucuugucaagccugaaggcaagguuauugaccugggguguggacggggcggcuggagcuacuauugcgcugggcucaaaaaggugacagaggugaaaggauacaccaagggcgggcccggacacgaagagccuauccccauggccacauacggcuggaaccuggucaaacugcauuccgggaaggauguguucuuuaugccuccggaaaaaugugacacccuccuuugcgauauuggagagucuagccccaauccuacgaucgaggaaggcagaacccugcgcguucugaagaugguggagcccuggcuccggggcaaccaguucuguaucaagauucugaauccuuauaugcccuccgucguggaaacacuugagcagaugcaaagaaaacacgggggaaugcugguucgcaacccgcucucucggaauagcacccacgagauguacuggguguccugcggcacagggaacaucgucagcgcugugaacaugaccucuagaaugcugcugaaucgcuuuacaauggcccaucggaagccuaccuaugaaagagacguggaucucggagcgggcacgcgccacgucgccguugagcccgaaguggcuaaccuggacauuaucgggcagagaauugagaauaucaaaaacgaacauaaguccacauggcacuacgaugaggacaaucccuauaaaaccugggccuaccacggaagcuaugaggugaagccuucuggcuccgcuagcucuauggucaacggcgugguucggcuucugaccaagcccugggaugugauuccuauggucacacagaucgccaugacggacaccacaccguucgggcaacagcgcguguuuaaagaaaagguugauaccagaacaccccgggcuaaaagaggaaccacacagaucauggaggugaccgccaaguggcucuggggcuuccugucccggaauaaaaagccucgcauuuguacgagagaagaguuuacccggaagguccgcagcaacgcggccaucggggcuguguucguugacgaaaaucaguggaacuccgccaaagaggcuguggaggacgaaagauuuugggaucuuguccaucgggagcgcgaacugcacaagcaaggaaaaugcgccacaugcguguacaauaugaugggcaagagagagaaaaagcucggggaauucggcaaggccaaaggaagccgggcgauuugguacauguggcugggcgcucgcuuccuggaguuugaggcccucggguucaugaacgaagaccauugguuuucuagagagaauagccuguccggagucgaaggcgaggggcuucacaagcugggauauauccuccgggauauuucuaaaauccccggcgggaacauguacgccgacgauaccgcuggcugggacacacgcaucaccgaggaugaccugcagaaugaagccaagauuacggauaucauggagccugaacaugcucuucuggccacaagcauuuucaaacucaccuaucagaacaaggugguuagagugcagcggcccgcgaaaaacggaacagucauggacgugaucucccgcagagaucaacggggcucugggcaggugggaaccuacggccugaauacguuuaccaacauggagguucagcugauuagacagauggaaagcgaggggaucuuccucccguccgagcuggaaacaccuaaucuugccgagcgcgcucuggacuggcucgaaaagcacggagccgagcggcugaagagaauggcuaucucuggcgaugacuguguggucaaacccauugacgaucgcuuugccaccgcgcuuacagcccugaacgacauggggaaggugcggaaagauaucccucaaugggaacccagcaagggcuggaaugacuggcagcagguuccuuucugcucccaccauuuucaccagcucauuaugaaagauggaagagagaucgugguccccugucgcaaccaagacgagcuggugggccgggcuagagucagccagggggccggauggucucugcgcgaaaccgcuugccucggcaaguccuaugcccagauguggcaacugauguacuuccaucggagagaucuucgccuggcugccaaugcgauuuguagcgccgugccgguugacugggugccuacaucucggaccacgugguccauccacgcucaccaucaguggaugacaaccgaggauaugcucagcgucuggaacagaguguggaucgaagagaaucccuggauggaagacaagacccacguuuccucuugggaggaggugcccuaucuggggaaacgggaagaucaguggugcggaagccuuauuggccugacagccagagccaccugggcuacaaacauccaggucgccauuaaucaagugcgccggcucaucgggaacgagaauuaccuggacuacaugacguccaugaagagauuuaaaaacgaaagcgacccugagggcgcgcugugguga

SEQ ID NO: 18785 - RNA, 9879 nt, Artificial Sequence
  derived and/or modified CDS sequence (opt5) from DENV-1__FJ639815__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccccccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagguguuugggaccgccuacggaguucuguucagcggcguguccuggacgaugaaaaucgggaucggcauucuucugaccuggcucggacugaauagccgcucuacaucccugagcaugaccuguaucgcugucggcauggugacacuuuaccucgggguuauggugcaggccgauucuggaugcgucauuaacuggaagggccgggagcugaaauguggguccggaaucuuugugaccaacgaaguucacacauggaccgagcaauauaaguuccaggcugacagcccuaagagacuguccgccgcgauuggcaaagccugggaggaaggggugugcggcauccgcucugcuacgcggcucgagaauauuauguggaagcagaucagcaacgaacugaaucauauccuucuggagaacgauaugaaauuuacagucguggugggagacgccaauggcauucucgcucaggggaagaaaaugaucagaccgcaacccauggaacacaaguacuccuggaaaucuuggggaaaggccaagauuaucggcgccgacauucagaacaccaccuucaucaucgaugggccugacacacccgaguguccugauggacagcgcgcuuggaauauuugggaggucgaagacuauggcuuuggcguuuucaccacgaacaucuggcugaaacugcgggauagcuacacacagaugugcgaccacagacuuauguccgcggccauuaaggauagcaaagcugugcaugccgacaugggguauuggaucgagucugaaaagaaugagaccuggaaacucgcccgcgcuuccuucauugaagugaagacauguaccuggcccaagagccacacacuguggucuaacggaguccuggaguccgagaugaucaucccgaaaauuuacggcgggccuaucagccaacauaauuaucggcccggauacuuuacccagacggccggcccuuggcaccucgggaagcuggaacuugauuucgaccugugcgagggaaccacagugguuguggaugaacacugcggcaacagaggccccucucuccggaccacaaccgucacggggaaaauuauccaugagugguguugccgcagcuguacacugccuccccugagauuucggggagaggacggcugcugguacgggauggaaauuagaccggugaaggagaaagaagagaaucuuguucgcuccauggugagcgcgggaucuggcgaagucgauuccuucagccucgggauccuguguguguccaucaugauugaggagguuaugcggucuagauggagccgcaagaugcugaugaccggaacacucgcuguguuucugcuucugaucaugggccagcucaccuggaacgaccugauuagacugugcaucauggucggcgccaaugccuccgaccggauggggaugggaaccacauaucuugcucugauggccacguucaagaugcgcccuauguuugcggugggccuccuguucagacggcucaccucucgcgaagugcugcuucugacaauugggcucagccuggucgcuuccguugagcugcccaacucucuugaagagcugggagauggccucgccauggggaucaugaugcugaaacuccugaccgaauuucaaccccaccagcuuuggacaacccugcucagccugacguucgugaagacaacccugucccuugacuacgccuggaaaaccacagcuaugcugcucagcauugugucucuguuuccucucugucuguccaccacaagccagaagacgaccuggcuuccgguccugcugggaucuuucggcugcaaaccccucacaauguuucugaucaccgagaacaagaucuggggcagaaaguccuggccucuuaaugaggggauuauggccaucggaauugugagcauccugcucucuucccugcucaaaaacgauguuccccuggcuggcccucuuauugccgggggaaugcugaucgcguguuaugugaucagcggcuccagcgccgaccugucucucgaaaaggcugccgaggucagcugggaacaggaggcugaacauuccggggccucucacaauauucugguggagguucaagaugacggaacaaugaaaaucaaggaugaggaacgggacgauacccuuacgauucugcucaaagccacccugcucgcugugagcggcgucuaccccauguccaucccugcgacacuguucgugugguauuucuggcagaagaaaaagcagcgcucuggcguccuuugggacacccccagcccgccugagguggaaagagccguucuggaugacgggauuuaccggauccugcagcgcggacuccugggcagaucccaagugggggucggaguguuucaggauggcguuuuccauacaauguggcacgugacccggggggcuguccuuauguaucagggaaagagacuggagcccucuugggccagcgugaaaaaggaccucaucuccuacggcggcggguggcgcuuucagggaagcuggaacacaggcgaggaagugcaaguuauugccgucgagccugggaaaaaucccaagaacgugcagacgaccccgggaacauucaaaaccccugaaggcgaggugggggcuaucgcccuggacuuuaagcccggaaccucuggcuccccuauugucaaucgggaaggcaagaucguggggcucuacggaaacggcguugugacaacgagcgggaccuaugucucugcgauugcucaggccaaagccucccaagagggaccccugcccgagaucgaagaugagguguucaagaaaagaaaucuuacaauuauggaccugcacccuggcagcgggaagacccgccgguaccugccggcuaucguuagagaagccaucaaacgcaagcuccggacacugauucuugcgcccaccagaguggucgcuuccgagauggccgaagcccugaagggcaugccuauccgcuaucagacgacagcugugaaaucugagcauaccggacgggagauuguugaucucaugugccacgccaccuuuacaaugagacugcugagccccgugcgggucccuaacuacaauaugaucauuauggacgaagcucauuucaccgaucccgccuccaucgcggcccgcggcuauaucagcacaagaguggggaugggagaggcugccgcuauuuuuaugaccgccacgccuccgggcucuguggaagccuucccccaguccaacgcugucauccaggacgaggaacgggauauuccugagcgcagcuggaauucuggguacgacuggaucacagauuuucccggaaagaccguuugguucgugccuagcauuaaauccggcaacgacaucgcgaauugucucagaaagaacgggaaacgggugauccaacuuucuagaaagacauucgauaccgaguaucagaagacgaaaaacaaugacugggacuacgucgugaccacagauauuagcgaaaugggcgccaacuuucgcgcugaccggguuaucgaucccagacgcugccugaagccggugauucugaaagacggaccugagcgggucauccucgccggccccaugcccgugaccguugccuccgcugcccagagacgcgggcggauuggaagaaaucagaacaaggaaggcgaucaauacguguauauggggcagccucugaauaacgacgaggaucacgcgcauuggacagaggcuaaaaugcuucuggacaauaucaacacccccgaaggaauuaucccugcccucuucgagccggaacgcgagaagucugccgcuaucgauggcgaauacagacugcggggggaggcccgcaagacauuugucgagcugaugagacggggcgaccuccccguguggcuuagcuauaaagucgcguccgaaggauuccaguacagcgaucgcagauggugcuuugacggcgagcggaauaaccaggugcuggaagagaauauggauguugaaauuuggaccaaggagggggagagaaaaaagcugcgcccucgguggcucgacgccagaacguauucugacccccuggcucuucgcgaauucaaagaguuugccgcuggacggagauccgugagcggcgaucugauccucgaaauugggaagcugccucaacaccugacacuccgggcccagaacgcucuugacaaucuggugaugcugcacaacuccgagcagggaggcaaagccuaccgccaugcgauggaagagcuccccgauaccaucgagacccugaugcuucuggcccucauugcuguccugacaggcgggguuacccuguucuuucucucuggaaagggccuugggaagacaagcaucggacugcugugugugacggccuccucugcucuccuguggauggccagcguggaaccgcacuggaucgccgcuuccauuauccuugaguucuuucugaugguccuccugauuccugaacccgacagacagcggaccccucaagauaaucagcuggcguaugugguuaucggccuccuuuucaugauucugacaguggccgcuaacgagauggggcugcucgagaccacaaaaaaggaccugggaaucggcuacgucgccgccgaaaaccaucagcacgcuaccaugcuugauguggaccugcaccccgccagcgcguggacgcucuacgccgucgcuaccacagugaucaccccuaugaugcgccauacaauugagaauaccacggccaacaucucucugacagcuauugccaaucaagcggccauccugaugggccucgauaaaggguggcccauuuccaagauggacaucggaguuccgcuucuggcucugggcugcuauagccaggugaacccucucacccugacagccgcuguccuuaugcugguggcccacuacgcuauuaucgggcccggacuccaggccaaagcgaccagagaagcccagaagcggaccgcugccggcaucaugaagaaucccacaguugaugggauuguggcuaucgaccuggauccugucguguaugacgccaaauuugagaagcaacugggacagauuaugcuccuuauccuguguacgucucagauucugcucaugcgcaccacaugggcccugugcgaauccaucacccuugcgacaggcccgcugaccacgcucugggagggcagccccgggaaauucuggaacacaaccaucgcugugucuauggccaauauuuucagaggaagcuaccuggcuggcgccgggcuggccuuuucccucaugaagucucuuggaggcgggcggcgcggaaccggcgcucagggcgagacacugggggaaaaauggaagagacaacugaaccagcucagcaaguccgaguucaauaccuauaaacggagcggaaucauggaaguugacagauccgaggccaaggaaggccugaaacgcggggagacaacgaagcaugcggucucucggggaaccgccaaacuuagaugguuuguggagcgcaaccuggugaagccugaaggcaaggucauugaucucggguguggacggggcggcuggagcuacuauugcgcugggcugaaaaagguuacagaggugaaaggauacaccaagggcgggcccggacacgaagagccuauccccauggccacauacggcuggaaucuggugaaacuccauuccgggaaggacgucuucuuuaugccuccggaaaaaugugauacccuucugugcgacauuggagagucuagccccaacccuacgaucgaggaaggcagaacccugcgcgugcucaagaugguugagcccuggcugcggggcaaucaguucuguaucaagauucuuaacccuuauaugcccuccguggucgaaacacuggagcagaugcaaagaaaacacgggggaaugcucgugcgcaauccgcugucucggaacagcacccacgagauguacuggguuuccugcggcacagggaauaucgugagcgcugucaacaugaccucuagaaugcugcucaaccgcuuuacaauggcccaucggaagccuaccuaugaaagagauguggaccugggagcgggcacgcgccacguggccgucgagcccgaaguugcuaaucuugauauuaucgggcagagaauugagaacaucaaaaaugaacauaaguccacauggcacuacgacgaggauaaccccuauaaaaccugggccuaccacggaagcuaugaggugaagccuucuggcuccgcuagcucuauggugaauggcgucgugcggcugcucaccaagcccugggacguuauuccuauggugacacagaucgccaugacggauaccacaccguucgggcaacagcgcgucuuuaaagaaaagguggacaccagaacaccccgggcuaaaagaggaaccacacagaucauggagguuaccgccaaguggcuguggggcuuccuuucccggaacaaaaagccucgcauuuguacgagagaagaguuuacccggaaggugcgcagcaaugcggccaucggggcugucuucguggacgaaaaccaguggaauuccgccaaagaggcuguugaggaugaaagauuuugggaccuggugcaucgggagcgcgaacuccacaagcaaggaaaaugcgccacaugcgucuacaacaugaugggcaagagagagaaaaagcugggggaauucggcaaggccaaaggaagccgggcgauuugguacauguggcugggcgcucgcuuccucgaguuugaggcccugggguucaugaaugaagaucauugguuuucuagagagaacagccuuuccggaguggaaggcgaggggcugcacaagcucggauauauccugcgggacauuucuaaaauccccggcgggaauauguacgccgaugacaccgcuggcugggauacacgcaucaccgaggacgaucuucagaacgaagccaagauuacggacaucauggagccugaacaugcucugcucgccacaagcauuuucaaacugaccuaucagaauaaggucgugagaguucagcggcccgcgaaaaacggaacagugauggaugucaucucccgcagagaccaacggggcucugggcaggugggaaccuacggccugaacacguuuaccaauauggaggugcagcucauuagacagauggaaagcgaggggaucuuccugccguccgagcuugaaacaccuaaccuggccgagcgcgcucucgauuggcuggaaaagcacggagccgagcggcuuaagagaauggcuaucucuggcgacgacuguguugugaaacccauugaugaccgcuuugccaccgcgcugacagcccucaaugauauggggaagguccggaaagacaucccucaaugggaacccagcaagggcuggaacgauuggcagcaggugccuuucugcucccaccauuuucaccagcugauuaugaaagacggaagagagaucguugugcccugucgcaaucaagaugagcuggucggccgggcuagagugagccagggggccggauggucucuccgcgaaaccgcuugccugggcaaguccuaugcccagauguggcaacuuauguacuuccaucggagagaccugcgccucgcugccaacgcgauuuguagcgccgucccgguggauuggguuccuacaucucggaccacgugguccauccacgcucaccaucaguggaugacaaccgaggacaugcugagcguguggaauagagucuggaucgaagagaaccccuggauggaagauaagacccacguguccucuugggaggagguucccuaucuugggaaacgggaagaccaguggugcggaagccugauuggccucacagccagagccaccugggcuacaaauauccagguggccauuaaccaaguccgccggcugaucgggaaugagaacuaccuggacuacaugacguccaugaagagauuuaaaaaugaaagcgauccugagggcgcgcucugguga

SEQ ID NO: 18786 - RNA, 9879 nt, Artificial Sequence
  derived and/or modified CDS sequence (opt5) from DENV-1__FJ639818__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaauaccacggauaccugggugacauauggaaccuguucccaaacaggcgagcacagacgggacaagcgcucugucgcccuggccccucauguggggcucggacuggagaccagaacggaaacauggaugagcuccgagggcgcuuggaaacagauucagcggguugaaaccugggcccuucgccaccccggcuucacagugaucgcucuguuucucgcccaugcgauugggaccucuaucacccagaagggaaucauuuucauccugcuuaugcuggucacaccuagcauggccaugagaugcgugggcauugggaaccgggauuuuguugagggacucuccggcgcuacguggguggacgucgugcuggagcacgggagcugugugaccacaauggccaagaauaaacccacccuggauaucgaacuccugaagacagaggucaccaacccugcuguucuucgcaaacugugcauugaagccaagaucucuaauacgacaaccgacuccagauguccgacccaaggagaggcgacacucguggaagagcaggaugccaacuucgugugccggcgcaccuuugucgacagaggcuggggcaauggguguggacuguucggcaaagggagccuucugacaugcgcuaaguuuaagugcgugacgaaacucgagggaaagauuguucaguacgaaaaccugaaauauucugugaucgucaccgugcacacaggcgaucagcaucaaguugggaaugagaccacagaacacggaaccaucgccacgauuaccccccaggcuccuacauccgagauccagcugaccgacuacggcgcccucacacuggacuguagcccccggaccggccuugauuucaacgaaauggugcugcucacgaugaaggagaaaucuuggcugguccauaagcagugguuucuugaccugccucuccccuggacauccggggccagcaccucccaagagacauggaaucgccaggaucugcuggugaccuucaaaaccgcucacgcgaagaagcaggaagucgugguucucggaucucaagagggcgccaugcacacagcucugacgggggccaccgaaauucagacaagcggaaccacaaccaucuuugccggccaucuuaaaugcagacugaagauggagaaacucacgcugaaggggauguccuaugugauguguacaggcagcuucaaacuggaaaaggaggucgcugagacccagcacggaaccgugcuuguucaggugaaguacgaaggcacagacgccccgugcaaaauuccuuucucuacccaagaugagaagggggucacacagaacggacggcucaucacggcgaaucccaucgugaccgacaaagaaaagccugugaacauugagacagagccccccuuuggcgaauccuauaucguugucggggcuggagagaaagcccugaagcugagcugguucaagaaaggcucuagcauugggaagauguuugaagccaccgcuagaggcgcccgccggauggcuauccucggagauacagccugggacuucggcuccauugggggaguguuuaccucugugggcaaacugguccaucagguguucgggacggcguacggaguucuuuuuagcggcguguccuggaccaugaagaucgggaucggcauucugcucacauggcugggacugaauagcagaucuaccucccuuagcaugacauguaucgccgucggcauggugacccucuaccuggggguuauggugcaggcugauucuggaugcgucauuaacuggaaaggccgcgagcugaaguguggguccggaaucuucgugacaaacgaaguucacaccuggacggagcaauauaaguuucaggccgacagcccuaaacggcucuccgcugccauuggcaaggcgugggaggaaggggugugcggcaucagaucugccacacgccuggagaauauuauguggaaacagaucagcaacgaacuuaaucauauccugcucgagaacgauaugaaguucaccgucguggugggagacgcuaauggcauucuggcccaggggaaaaagaugauccggccgcaacccauggaacacaaauacuccuggaagucuuggggaaaggcuaaaauuaucggcgccgacauucagaacaccacauuuaucaucgaugggccugacacccccgaguguccugauggacagagagccuggaauauuugggaggucgaagacuauggcuucggcaucuuuacgacaaacauuuggcugaagcuucgcgauagcuacacccagaugugcgaccaccggcucauguccgcugcgaucaaagauagcaaggccguucaugcugacaugggguauuggauugagucugaaaaaaaugagacauggaagcuggccagagccuccuucaucgaagugaagaccuguacauggcccaaaagccacacccuguggucuaacggagugcucgaguccgagaugaucauuccgaagaucuacggcgggccuauuagccaacauaauuaucgccccggauacuucacgcagaccgcuggcccuuggcaccuggggaaacuugaacuggauuuugaccucugcgagggaacaaccgucgugguugaugaacacugcggcaaccggggccccucucugagaacaaccacggugacagggaagaucauucaugagugguguugccggagcuguacccugccuccccuucgcuucagaggagaggacggcugcugguacgggauggaaauccggccggucaaagagaaggaagagaaucucgugagauccaugguuagcgccggaucuggcgaaguggauuccuuuagccuggggauccugugugucuccauuaugaucgaggaggugaugcgcucucgguggagcagaaagaugcucaugacaggaacccuggcgguuuuccuucugcucauuaugggccagcugaccuggaacgaccugauccgccuuugcauuauggugggcgcuaaugccuccgacagaauggggaugggaacaacgcaccuggcccucauggcuaccuuuaaaaugcggccuauguucgccgucggccugcucuuucgcagacugacaucucgggaagugcuucugcucaccaucgggcugagccugguggcguccgucgagcuucccaacucucuggaagagcucggagauggccuggcuauggggauuaugaugcucaagcugcuuacagaauuccaaccccaucagcuguggaccacgcuccugagccugacauuuguuaaaaccacccuuucccuggacuaugccuggaagacaaccgccauggugcucagcaucgugucucuguucccucucugucuguccacaacgagccagaaaaccacauggcuuccgguccugcugggaucuuuuggcugcaagccccucaccauguuccugaucacagagaacaagauuuggggccgcaaauccuggccucuuaaugaggggaucauggcuauuggaaucgugagcauucugcucucuucccugcucaagaacgauguuccccuggccggcccucuuaucgcugggggaaugcugaucgccuguuacgugauuagcggcuccagcgcggaccugucucucgaaaaagccgcugaggucagcugggaacaggaggccgaacacuccggggcuucucauaauauccugguggagguucaagaugacggaaccaugaagauuaaagaugaggaaagagacgauacgcuuaccauccugcucaaggccacacugcucgccgugagcggcgucuaucccauguccauuccugcuacccuguuugugugguacuucuggcagaaaaagaagcagcggucuggcguccuuugggacacacccagcccgccugagguggaacgcgcgguucuggaugacgggaucuauagaauccugcagcggggacuccugggccgcucccaagugggggucggaguguuccaggauggcguuuuucacaccauguggcacgugacaagaggggccguccuuauguaccagggaaaacggcuggagcccucuugggcuagcgugaagaaagaccucauuuccuauggcggcggguggagauuccagggaagcuggaacacgggcgaggaagugcaaguuaucgccgucgagccugggaagaaucccaaaaacgugcagaccacaccgggaaccuuuaagaccccugaaggcgaggugggggccauugcucuggacuucaagcccggaacaucuggcuccccuaucgucaaucgcgaaggcaaaauuguggggcucuacggaaacggcguugugacgaccagcgggacauacgucucugccaucgcgcaggcuaaggccucccaagagggaccccugcccgagauugaagaugagguguuuaaaaagcggaaucuuaccaucauggaccugcauccuggcagcgggaaaacaagacgcuaucugccggccaucguucgggaagcuauuaagagaaagcuccgcacccugauccuugcccccacgcggguggucgcguccgagauggcugaagcccugaaaggcaugccuauuagauaccagacaaccgccgugaagucugagcacaccggacgcgagaucguugaucucaugugccaugcuacauucaccaugcggcugcugagccccgugagagucccuaacuauaauaugauuaucauggacgaagcccacuuuacagaucccgcuuccaucgccgcgcggggcuacauuagcacccgcguggggaugggagaggccgcugccaucuucaugacggcuacaccuccgggcucuguggaagccuuuccccaguccaacgccgucauucaggacgaggaaagagauaucccugagcggagcuggaauucuggguaugacuggauuaccgauuuccccggaaaaacaguuugguuugugccuagcaucaaguccggcaacgacaucgcuaauugucuccgcaaaaacgggaagagagugauucaacuuucucggaagaccuucgauacggaguaccagaaaaccaagaacaaugacugggacuaugucgugacaaccgauaucagcgaaaugggcgcgaacuucagagccgaccgcguuauugauccccggagaugccugaaaccggugauccugaaggacggaccugagcgcgucauucucgcuggccccaugcccgugacaguugccuccgccgcucagcggagagggcgcaucggacggaaucagaacaaagaaggcgaucaauacguguacauggggcagccucugaauaacgacgaggaucaugcccacuggaccgaggcgaagaugcuucuggacaauauuaacacacccgaaggaaucaucccugcucucuuugagccggaaagagagaagucugccgccauugauggcgaauaucgccugagaggggaggcucggaaaaccuucgucgagcugaugcgcagaggcgaccuccccguguggcuuagcuacaaggucgccuccgaaggauuucaguauagcgaucggcgcuggugcuucgacggcgagagaaauaaccaggugcuggaagagaauauggauguugaaaucuggacgaaagagggggagcggaagaaacugagaccucgcuggcucgacgcgcggacauacucugacccccuggcccuuagagaauuuaaggaguucgcugccggacgccgguccgugagcggcgaucugauucucgaaaucgggaaacugccucaacaccugacccucagagcucagaacgcccuugacaaucuggugaugcugcauaacuccgagcagggaggcaaggcuuaucggcacgccauggaagagcuccccgauaccauugagacacugaugcuucuggcgcucaucgccguccugaccggcgggguuacacuguuuuuccucucuggaaagggccuugggaaaacgagcaucggacugcugugugugaccgcuuccucugcccuccuguggauggcuagcguggaaccgcauuggauugccgccuccaucauucuugaguuuuuccugaugguccuccugaucccugaacccgaccgccagagaacaccucaagauaaucagcuggcuuacgugguuauuggccuccuuuuuaugauccugaccguggcggccaacgagauggggcugcucgagacaaccaagaaagaccugggaaucggcuaugucgcugccgaaaaccaccagcacgccacgaugcuugauguggaccugcggcccgcuagcgccuggacccucuacgcggucgccacaaccgugauuacaccuaugaugcgccauaccaucgagaauacgacagcuaacauuucucugaccgccaucgcuaaucaagccgcgauucugaugggccucgauaagggguggcccaucuccaaaauggacauuggaguuccgcuucuggcccugggcugcuacagccaggugaacccucucacacugaccgcugccguccuuaugcugguggcucacuaugccaucaucgggcccggacuccaggcuaaggccaccagagaagcgcagaagcggacagccgcuggcauuaugaaaaaucccacgguugaugggaucguggccauugaccuggauccugucguguacgacgcuaaguucgagaaacaacugggacagaucaugcuccuuauucuguguaccucucagauccugcucaugcgcacaaccugggcccugugcgaauccaucacacuugccaccggcccgcugacgacacucugggagggcagccccgggaaguuuuggaacaccaccauugcggugucuauggcuaauaucuucagaggaagcuaucuggccggcgcugggcuggccuucucccucaugaaaucucuuggaggcgggcggcgcggaacaggcgcccagggcgagacccugggggaaaaguggaagagacaacugaaccagcucagcaaauccgaguuuaauacauacaagcggagcggaauuauggaaguugacagauccgaggcuaaagaaggccugaagcgcggggagacgaccaaacaugccgucucucggggaacagcgaagcuuagaugguucguggagcgcaaccuggugaagccugaaggcaaagucaucgaucucggguguggacggggcggcuggagcuauuacugcgccgggcugaagaaaguuaccgaggugaagggauauacaaaaggcgggcccggacacgaagagccuauucccauggcuaccuacggcuggaaucuggugaagcuccauuccgggaaagacgucuuuuucaugccuccggaaaagugugauacgcuucugugcgacaucggagagucuagccccaacccuaccaucgaggaaggcagaacacugcgcgugcucaagaugguugagcccuggcugaaaggcaaucaguuuuguauuaagauccuuaacccuuacaugcccuccguggucgaaacccuggagcagaugcaacggaaacacgggggaaugcucgugagaaauccgcugucucgcaacagcacacacgagauguauuggguuuccugcggcaccgggaauauugugagcgccgucaacaugacaucucggaugcugcucaacagauucaccauggcucaucgcaagccuacguacgaacgggauguggaccugggagccggcacaagacacguggcggucgagcccgaaguugccaaucuugauaucauugggcagcgcaucgagaacauuaaaaaugaacauaaguccaccuggcacuaugacgaggauaaccccuacaagaccugggcuuaucacggaagcuacgaggugaaaccuucuggcuccgccagcucuauggugaauggcgucgugagacugcucacaaagcccugggacguuaucccuauggugacgcagaucgcuaugaccgauacaaccccguuugggcaacagcgggucuucaaagaaaagguggacacacgcacccccagagccaaacggggaacaacccagauuauggagguuacggcuaaguggcuguggggcuuucuuuccagaaacaagaaaccucggaucuguacccgcgaagaguucacaagaaaggugcggagcaaugccgcgauuggggccgucuuuguggacgaaaaccaguggaauuccgcuaaagaggccguugaggaugaacgcuucugggaccuggugcauagagagcgggaacuccacaagcaaggaaaaugcgcuaccugcgucuauaacaugaugggcaagcgcgagaagaaacugggggaauuuggcaaggccaaaggaagcagagccaucugguacauguggcugggcgcgcgguuccucgaguucgaggcucugggguuuaugaaugaagaucauugguucucucgcgagaacagccuuuccggaguggaaggcgaggggcugcacaagcucggauacauucugagagacaucucuaaaauccccggcgggaauauguaugccgaugacacagccggcugggauacccggauuacggaggacgaucuucagaacgaagcuaagaucacagacauuauggagccugaacaugcccugcucgcuaccagcaucuuuaaacugacauaccagaauaaggucgugcgcguucagagacccgccaagaacggaaccgugauggaugucauuucccggcgcgaccaaagaggcucugggcaggugggaacguauggccugaacaccuucacaaauauggaggugcagcucauccggcagauggaaagcgaggggaucuuucugccguccgagcuugaaaccccuaaccuggcggagagaguucucgauuggcuggaaaaacacggagccgagcgccuuaagcggauggcuauuucuggcgacgacuguguggucaaacccaucgaugacagauucgccacagcucugaccgcccucaaugauauggggaaggugcgcaaagacauuccucaaugggaacccagcaagggcuggaacgauuggcagcagguuccuuuuugcucccaccauuuccaccagcugaucaugaaggacggacgggagauugugguccccuguagaaaucaagaugagcuggugggccgcgcgcgggucagccagggggccggauggucucucagagaaacagcuugccugggcaaauccuacgcccagauguggcaacuuauguauuuucaucgccgggaccugagacucgcugccaacgcuaucuguagcgccgugccgguugauugggugccuaccucucgcacgacaugguccauccacgcgcaccaucaguggaugaccaccgaggacaugcugagcgucuggaaucggguguggauugaagagaaccccuggauggaagauaagacacacguuuccucuugggaggaggugcccuaccuugggaaaagagaagaccaguggugcggaagccugaucggccucaccgcccgggcuacaugggccacgaauauucaggucgccaucaaccaagugagacgccugauugggaaugagaacuaucuggacuacaugaccuccaugaagcgguucaaaaaugaaagcgauccugagggcgcucucugguga

SEQ ID NO: 18787 - RNA, 9879 nt, Artificial Sequence
  derived and/or modified CDS sequence (opt5) from DENV-1__FJ639819__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccccccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagguguuugggaccgccuacggaguucuguucagcggcguguccuggacgaugaaaaucgggaucggcauucuucugaccuggcucggacugaauagccgcucuacaucccugagcaugaccuguaucgcugucggcauggugacacuuuaccucgggguuauggugcaggccgauucuggaugcgucauuaacuggaagggccgggagcugaaauguggguccggaaucuuugugaccaacgaaguucacacauggaccgagcaauauaaguuccaggcugacagcccuaagagacuguccgccgcgauuggcaaagccugggaggaaggggugugcggcauccgcucugcuacgcggcucgagaauauuauguggaagcagaucagcaacgaacugaaucauauccuucuggagaacgauaugaaauuuacagucguggugggagacgccaauggcauucucgcucaggggaagaaaaugaucagaccgcaacccauggaacacaaguacuccuggaaaucuuggggaaaggccaagauuaucggcgccgacauucagaacaccaccuucaucaucgaugggccugacacacccgaguguccugauggacagcgcgcuuggaauauuugggaggucgaagacuauggcuuuggcaucuucaccacgaacauuuggcugaaacugcgggauagcuacacacagaugugcgaccacagacuuauguccgcggccaucaaggauagcaaagcuguucaugccgacaugggguauuggauugagucugaaaagaaugagaccuggaaacucgcccgcgcuuccuucaucgaagugaagacauguaccuggcccaagagccacacacuguggucuaacggagugcuggaguccgagaugaucauuccgaaaaucuacggcgggccuauuagccaacauaauuaucggcccggauacuuuacccagacggccggcccuuggcaccucgggaagcuggaacuugauuucgaccugugcgagggaaccacagucgugguugaugaacacugcggcaacagaggccccucucuccggaccacaaccgugacggggaaaaucauucaugagugguguugccgcagcuguacacugccuccccugagauuucggggagaggacggcugcugguacgggauggaaaucagaccggucaaggagaaagaagagaaucuugugcgcuccaugguuagcgcgggaucuggcgaaguggauaacuucucccucgggauccugugugucagcauuaugaucgaggaggugaugcgguccagauggucucgcaagaugcugaugaccggaacacucgcuguuuuucugcuucugauuaugggccagcucaccuggaaugaccugaucagacugugcauuauggugggcgccaacgccagcgaccggauggggaugggaaccacauaucuugcucugauggccacguucaagaugcgcccuauguuugcggucggccuccuguucagacggcucaccucccgcgaagugcugcuucugacaaucgggcucucucugguggcuagcgucgagcugcccaacucccuugaagagcugggagauggccucgccauggggauuaugaugcugaaacuccugaccgaauuucaaccccaccagcuuuggacaacccugcucucucugacguucguuaagacaacccugagccuugacuacgccuggaaaaccacagcuauggugcuguccaucgugagccucuuuccucugugucucucuaccacaucccagaagacgaccuggcugccgguccuucugggaagcuucggcugcaaaccccugacaauguuucucaucaccgagaauaagauuuggggcagaaagucuuggccucugaacgaggggaucauggccauuggaaucguguccauucuucugagcucucuccugaaaaaugauguuccccucgcuggcccucugaucgccgggggaaugcuuaucgcguguuaugugauuuccggcagcuccgccgaccugagccuggaaaaggcugccgaggucucuugggaacaggaggcugaacauagcggggccucccacaacauccucguggagguucaagaugacggaacaaugaaaauuaaggaugaggaacgggacgauacccugacgauccuucugaaagccacccuccuggcugugucuggcgucuaccccaugagcauuccugcgacacucuucgugugguauuucuggcagaagaaaaagcagcgcuccggcguccugugggacacccccucuccgccugagguggaaagagccguucuugaugacgggaucuaccggauccugcagcgcggacugcucggcagaagccaagugggggucggaguguuucaggauggcguuuuccauacaauguggcacgugacccggggggcuguccugauguaucagggaaagagacuugagcccuccugggccugcgugaaaaaggaccugauuucuuacggcggcggguggcgcuuucagggacucuggaauacaggcgaggaagugcaaguuaucgccgucgagccugggaaaaaccccaagaaugugcagacgaccccgggaacauucaaaaccccugaaggcgaggugggggcuauugcccuggacuuuaagcccggaaccagcggcuccccuaucgucaaccgggaaggcaagauuguggggcucuacggaaauggcguugugacaacgagcgggaccuaugucucugcgaucgcucaggccaaagccucccaagagggaccccugcccgagauugaagaugagguguucaagaaaagaaaccuuacaaucauggaccugcacccuggcagcgggaagacccgccgguaccugccggcuaucguuagagaagccauuaaacgcaagcuccggacacugauccuugcgcccaccagaguggucgcuucugagauggccgaagcccugaagggcaugccuauucgcuaucagacgacagcugugaaauccgagcauaccggacgggagaucguugaucucaugugucacgccaccuuuacaaugagacugcugagccccgugcgggucccuaauuacaacaugauuaucauggacgaagcucauuucaccgaucccgccuccaucgcggcccgcggcuauauuucuacaagaguggggaugggagaggcugccgcuaucuuuaugaccgccacgccuccgggcagcguggaagccuucccccaguccaaugcugucauucaggacgaggaacgggauaucccugagcgcagcuggaacucuggguacgacuggauuacagauuuucccggaaagaccguuugguucgugccuuccaucaaaagcggcaaugacaucgcgaacugccucagaaagaacgggaaacgggugauucaacuuucuagaaagacauucgauaccgaguaucagaagacgaaaaauaacgacugggacuacgucgugaccacagauaucagcgaaaugggcgccaauuuucgcgcugaccggguuauugaucccagacgcugccugaagccggugauccugaaagacggaccugagcgggucauucucgccggccccaugcccgugaccguugccuccgcugcccagagacgcgggcggaucggaagaaaccagaauaaggaaggcgaucaauacguguauauggggcagccucugaacaaugacgaggaucacgcgcauuggacagaggcuaaaaugcuucuggacaacauuaauacccccgaaggaaucaucccugcccucuucgagccggaacgcgagaagucugccgcuauugauggcgaauacagacugcggggggaggcccgcaagacauuugucgagcugaugagacggggcgaccuccccguguggcuuagcuauaaagucgcguccgaaggauuccaguacucugaucgcagaugguguuuugacggcgagcggaacaaucaggugcuggaagagaacauggauguugaaaucuggaccaaggagggggagagaaaaaagcugcgcccucgguggcucgacgccagaacguauagcgacccccuggcucuucgcgaauucaaagaguuugccgcuggacggagauccgugagcggcgaucugauucucgaaaucgggaagcugccucaacaccugacacuccgggcccagaaugcucuugacaaccuggugaugcugcacaauucugagcagggaggcaaagccuaccgccaugcgauggaagagcuccccgauaccauugagacccugaugcuucuggcccucaucgcuguccugacaggcgggguuacccuguucuuucucuccggaaagggccuugggaagacaagcaucggacugcugugcgugacggccuccucugcucuccuguggauggccagcguggaaccgcacuggauugccgcuuccaucauucuugaguucuuucugaugguccuccugaucccugaacccgacagacagcggaccccucaagauaaccagcuggcguaugugguuauuggccuccuuuucaugauccugacaguggccgcuaacgagauggggcugcucgagaccacaaaaaaggaccugggaaucggcuacgucgccgccgaaaaucaucagcacgcuaccaugcuugauguggaccugcaccccgccucugcguggacgcucuacgccgucgcuaccacagugauuaccccuaugaugcgccauacaaucgagaacaccacggccaauauuagccugacagcuaucgccaaccaagcggccauucugaugggccucgauaaaggguggcccaucuccaagauggacauuggaguuccgcuucuggcucugggcuguuauagccaggugaauccucucacccugacagccgcuguccuuaugcugguggcccacuacgcuaucaucgggcccggacuccaggccaaagcgaccagagaagcccagaagcggaccgcugccggcauuaugaagaaccccacaguugaugggaucguggcuauugaccuggauccugucguguaugacgccaaauuugagaagcaacugggacagaucaugcuccuuauucugugcacgucucagauccugcucaugcgcaccacaugggcccugugugaauccaucacccuugcgacaggcccgcugaccacgcucugggagggcagccccgggaaauucuggaauacaaccauugcugugucuauggccaacaucuucagaggauccuaccuggcuggcgccgggcuggccuuuagccucaugaagucucuuggaggcgggcggcgcggaaccggcgcucagggcgagacacugggggaaaaauggaagagacaacugaaucagcucagcaaguccgaguucaacaccuauaaacggucuggaauuauggaaguugacagaagcgaggccaaggaaggccugaaacgcggggagacaacgaagcaugcggucucccggggaaccgccaaacuuagaugguuuguggagcgcaaucuggugaagccugaaggcaaggucaucgaucucgggugcggacggggcggcuggagcuacuauugugcugggcugaaaaagguuacagaggugaaaggauacaccaagggcgggcccggacacgaagagccuauucccauggccacauacggcuggaaccuggugaaacuccauuccgggaaggacgucuucuuuaugccuccggaaaaaugcgauacccuucugugugacaucggagagucuagccccaauccuacgaucgaggaaggcagaacccugcgcgugcucaagaugguugagcccuggcugcggggcaaccaguucugcauuaagauccuuaauccuuauaugcccuccguggucgaaacacuggagcagaugcaaagaaaacacgggggaaugcucgugcgcaacccgcugucucggaauagcacccacgagauguacuggguuuccuguggcacagggaacauugugucugcugucaacaugaccagcagaaugcugcucaaucgcuuuacaauggcccaucggaagccuaccuaugaaagagauguggaccugggagcgggcacgcgccacguggccgucgagcccgaaguugcuaaccuugauaucauugggcagagaaucgagaauauuaaaaacgaacauaaguccacauggcacuacgacgaggauaaucccuauaaaaccugggccuaccacggaagcuaugaggugaagccuucuggcuccgcuagcucuauggugaacggcgucgugcggcugcucaccaagcccugggacguuaucccuauggugacacagaucgccaugacggauaccacaccguucgggcaacagcgcgucuuuaaagaaaagguggacaccagaacaccccgggcuaaaagaggaaccacacagauuauggagguuaccgccaaguggcuguggggcuuccuuucccggaauaaaaagccucgcaucugcacgagagaagaguuuacccggaaggugcgcagcaacgcggccauuggggcugucuucguggacgaaaaucaguggaacucugccaaagaggcuguugaggaugaaagauuuugggaccuggugcaucgggagcgcgaacuccacaagcaaggaaaaugcgccacaugugucuacaauaugaugggcaagagagagaaaaagcugggggaauucggcaaggccaaaggaucccgggcgaucugguacauguggcugggcgcucgcuuccucgaguuugaggcccugggguucaugaacgaagaucauugguuuagcagagagaauucccuuagcggaguggaaggcgaggggcugcacaagcucggauauauucugcgggacaucucuaaaauccccggcgggaacauguacgccgaugacaccgcuggcugggauacacgcauuaccgaggacgaucuucagaaugaagccaagaucacggacauuauggagccugaacaugcucugcucgccacaagcaucuucaaacugaccuaucagaacaaggucgugagaguucagcggcccgcgaaaaacggaacagugauggaugucauuucccgcagagaccaacggggcucugggcaggugggaaccuacggccugaauacguuuaccaacauggaggugcagcucaucagacagauggaaagcgaggggaucuuccugccguccgagcuugaaacaccuaaucuggccgagcgcguucucgauuggcuggaaaagcacggagcugagcggcuuaagagaauggccauuucuggcgacgacugcguggucaaacccaucgaugaccgcuuugcuaccgcccugacagcgcucaacgauauggggaaggugcggaaagacauuccucaaugggaacccagcaagggcuggaaugauuggcagcagguuccuuucuguucccaccauuuucaccagcugaucaugaaagacggaagagagauugugguccccugccgcaaccaagaugagcuggugggccgggccagagucucucagggggcuggauggagccuccgcgaaaccgccugucugggcaaguccuaugcucagauguggcaacuuauguacuuccaucggagagaccugcgccucgccgcuaaugccaucugcagcgcggugccgguugauugggugccuacaucucggaccacgugguccauccacgcccaccaucaguggaugacaaccgaggacaugcugagcgucuggaacagaguguggauugaagagaaucccuggauggaagauaagacccacguuucuuccugggaggaggugcccuaucuugggaaacgggaagaccagugguguggaagccugaucggccucacagcuagagccaccugggccacaaacauucaggucgcuaucaaucaagugcgccggcugauugggaacgagaauuaccuggacuacaugacguccaugaagagauuuaaaaacgaaucugauccugagggcgcccucugguga

SEQ ID NO: 18788 - RNA, 9879 nt, Artificial Sequence
  derived and/or modified CDS sequence (opt5) from DENV-1__FJ639820__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccccccuuuggcgaguccuauaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaucagguguucgggaccgccuacggaguucuuuuuagcggcguguccuggacgaugaagaucgggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuucgugaccaacgagguucacacauggaccgaacaauauaaguuucaggcugauagcccuaaacggcucuccgccgcgauuggcaaggccugggaggagggggugugcggcaucagaucugcuacgcgccuggaaaauauuauguggaaacagaucagcaacgagcuuaaucauauccugcucgaaaacgacaugaaguucacagucguggugggagacgccaauggcauucuggcucaggggaaaaagaugauccggccgcaacccauggagcacaaauacuccuggaagucuuggggaaaggccaaaauuaucggcgccgauauucagaacaccaccuuuaucaucgacgggccugauacacccgaauguccugacggacagagagcuuggaauauuugggaggucgaggauuauggcuucggcaucuuuaccacgaacauuuggcugaagcuucgcgacagcuacacacagaugugcgaucaccggcucauguccgcggccaucaaagacagcaaggcuguucaugccgauaugggguauuggauugaaucugagaaaaaugaaaccuggaagcuggccagagcuuccuucaucgaggugaagacauguaccuggcccaaaagccacacacuguggucuaacggagugcucgaauccgagaugaucauuccgaagaucuacggcgggccuauuagccaacauaauuaucgccccggauacuucacccagacggccggcccuuggcaccuggggaaacuugagcuggacuuugaucucugcgaaggaaccacagucgugguugacgagcacugcggcaaccggggccccucucugagaaccacaaccgugacggggaagaucauucaugaaugguguugccggagcuguacacugccuccccuucgcuucagaggagaggauggcugcugguacgggauggagauccggccggucaaagaaaaggaggaaaaucucgugagauccaugguuagcgcgggaucuggcgagguggacuccuuuagccuggggauccugugugucuccauuaugaucgaagaggugaugcgcucucgguggagcagaaagaugcucaugaccggaacacuggcuguuuuccuucugcucauuaugggccagcugaccuggaacgaccugauccgccuuugcauuauggugggcgccaaugccuccgauagaauggggaugggaaccacauaucuggcucucauggccacguuuaaaaugcggccuauguucgcggucggccugcucuuucgcagacugaccucucgggaggugcuucugcucacaaucgggcugagccugguggcuuccgucgaacuucccaacucucuggaggaacucggagacggccuggccauggggauuaugaugcucaagcugcuuaccgaguuccaaccccaccagcuguggacaacccuccugagccugacguuuguuaaaacaacccuuucccuggauuacgccuggaagaccacagcuauggugcucagcaucgugucucuguucccucucugucuguccaccacaagccagaaaacgaccuggcuuccgguccugcugggaucuuuuggcugcaagccccucacaauguuccugaucaccgaaaacaagauuuggggccgcaaauccuggccucuuaaugaggggaucauggccauuggaaucgugagcauucugcucucuucccugcucaagaacgacguuccccuggcuggcccucuuaucgccgggggaaugcugaucgcguguuaugugauuagcggcuccagcgccgaucugucucucgagaaagcugccgaagucagcugggagcaggaagcugagcauuccggggccucucacaauauccugguggaaguucaagacgauggaacaaugaagauuaaagacgaggagagagaugacacccuuacgauccugcucaaggccacccugcucgcugugagcggcgucuaccccauguccauuccugcgacacuguuugugugguauuucuggcagaaaaagaagcagcggucuggcguccuuugggauacccccagcccgccugaaguggagcgcgccguucuggacgaugggaucuacagaauccugcagcggggacuccugggccgcucccaagugggggucggaguguuccaggacggcguuuuucauacaauguggcacgugaccagaggggcuguccuuauguaucagggaaaacggcuggaacccucuugggccagcgugaagaaagaccucauuuccuacggcggcggguggagauuccagggaagcuggaacacaggcgaggaggugcaaguuaucgccgucgaaccugggaagaaucccaaaaacgugcagacgaccccgggaacauuuaagaccccugagggcgaagugggggcuauugcccuggauuucaagcccggaaccucuggcuccccuaucgucaaucgcgagggcaaaauuguggggcucuacggaaacggcguugugacaacgagcgggaccuaugucucugcgaucgcucaggccaaggccucccaagaaggaccccugcccgagauugaggacgaaguguuuaaaaagcggaaucuuacaaucauggaucugcacccuggcagcgggaaaaccagacgcuaccugccggcuaucguucgggaggccauuaagagaaagcuccgcacacugauccuugcgcccacccggguggucgcuuccgaaauggccgaggcccugaaaggcaugccuauuagauaucagacgacagcugugaagucugaacauaccggacgcgagaucguugaccucaugugccacgccaccuucacaaugcggcugcugagccccgugagagucccuaacuacaauaugauuaucauggaugaggcucauuuuaccgaccccgccuccaucgcggcccggggcuauauuagcacacgcguggggaugggagaagcugccgcuaucuucaugaccgccacgccuccgggcucuguggaggccuuuccccaguccaacgcugucauucaggaugaagagagagacaucccugaacggagcuggaauucuggguacgauuggauuacagacuuccccggaaaaaccguuugguuugugccuagcaucaaguccggcaacgauaucgcgaauugucuccgcaaaaacgggaagagagugauucaacuuucucggaagacauucgacaccgaguaucagaaaacgaagaacaaugacugggauuacgucgugaccacagacaucagcgagaugggcgccaacuucagagcugaucgcguuauugacccccggagaugccugaaaccggugauccugaaggauggaccugaacgcgucauucucgccggccccaugcccgugaccguugccuccgcugcccagcggagagggcgcaucggacggaaucagaacaaagagggcgaccaauacguguauauggggcagccucugaauaacgaugaagaccacgcgcauuggacagaggcuaagaugcuucuggauaauauuaacacccccgagggaaucaucccugcccucuuugaaccggagagagaaaagucugccgcuauugacggcgaguaccgccugagaggggaagcccggaaaacauucgucgagcugaugcgcagaggcgaucuccccguguggcuuagcuauaaggucgcguccgagggauuucaguacagcgaccggcgcuggugcuucgauggcgaaagaaauaaccaggugcuggaggaaaauauggacguugagaucuggaccaaagaaggggagcggaagaaacugagaccucgcuggcucgacgcccggacguauucugauccccuggcucuuagagaguuuaaggaauucgccgcuggacgccgguccgugagcggcgaccugauucucgagaucgggaaacugccucaacaccugacacucagagcccagaacgcucuugauaaucuggccaugcugcacaacuccgaacagggaggcaaggcguaccggcaugccauggaggaacuccccgacaccauugagacccugaugcuucuggcucucaucgccgugcugacaggcggggucacccuguuuuuccucucuggaaagggccuugggaaaacaagcaucggacugcuguguguuacggcuuccucugcccuccuguggauggccagcguggagccgcacuggauugcugcguccaucauucuugaauuuuuccugauggugcuccugaucccugagcccgaucgccagagaaccccucaagacaaucagcuggccuaugucgugauuggccuccuuuuuaugauccugacaguugcugccaacgaaauggggcugcucgagaccacaaagaaagaucugggaaucggcuacguggccgcugagaaccaucagcacgccaccaugcuugacgucgaucugcggcccgcgagcgccuggacgcucuacgcuguggccaccacagucauuaccccuaugaugcgccacacaaucgaaaauaccacggcuaacauuucucugacagccaucgcgaaucaagccgcuauucugaugggccucgacaagggguggcccaucuccaaaauggauauuggagugccgcuucuggcccugggcugcuauagccagguuaacccucucacccugacagcugccgugcuuaugcuggucgcucauuacgccaucaucgggcccggacuccaggcgaaggccaccagagaggcucagaagcggaccgccgcuggcauuaugaaaaaucccacaguggacgggaucguugccauugaucuggacccuguggucuaugacgccaaguucgaaaaacaacugggacagaucaugcuccuuauucuguguacgucucagauccugcucaugcgcaccacaugggcgcugugcgaguccaucacccuugcuacaggcccgcugaccacgcucugggaaggcagccccgggaaguuuuggaacacaaccauugccgugucuauggcuaauaucuucagaggaagcuaccuggccggcgccgggcuggcuuucucccucaugaaaucucuuggaggcgggcggcgcggaaccggcgcccagggcgagacacugggggagaaguggaagagacaacugaaccagcucagcaaauccgaauuuaauaccuauaagcggagcggaauuauggagguggauagauccgaagcgaaagagggccugaagcgcggggaaacaacgaaacacgccguuucucggggaaccgcuaagcuuagaugguucgucgagcgcaaccuggugaagccugagggcaaagugaucgaccucggguguggacggggcggcuggagcuacuauugcgccgggcugaagaaagucacagaaguuaagggauacaccaaaggcgggcccggacaugaggaaccuauucccauggcuacauacggcuggaaucuggugaagcuccacuccgggaaagauguguuuuucaugccuccggagaagugugacacccuucugugcgauaucggagaaucuagccccaacccuacgaucgaggagggcagaacccugcgcguccucaagaugguggaacccuggcugaaaggcaaucaguuuuguauuaagauccuuaacccuuauaugcccuccguuguggagacacuggaacagaugcaacggaaacaugggggaaugcucgucagaaauccgcugucucgcaacagcacccacgagauguacuggguguccugcggcacagggaauauuguuagcgccgugaacaugaccucucggaugcugcucaacagauucacaauggcgcaccgcaagccuaccuaugagcgggacgucgaucugggagccggcacgagacauguggcuguggaacccgaggucgccaaucuugacaucauugggcagcgcaucgaaaacauuaaaaaugagcacaaguccacauggcauuacgaugaagacaaccccuauaagaccugggcuuaccacggaagcuaugagguuaaaccuucuggcuccgccagcucuauggugaauggcguggucagacugcucaccaagcccugggaugugaucccuaugguuacacagaucgcuaugacggacaccacaccguuugggcaacagcggguguucaaagagaaggucgacacccgcacacccagagccaaacggggaaccacacagauuauggaagugaccgcgaaguggcuguggggcuuucuuuccagaaacaagaaaccucggaucuguacgcgcgaggaauucaccagaaagguucggagcaaugccgcuauuggggccguguuugucgaugagaaccaguggaauuccgcuaaagaagccguggaggacgagcgcuucugggaucugguucacagagaacgggagcuccauaagcaaggaaaaugcgccacaugcguguacaacaugaugggcaagcgcgaaaagaaacugggggaguuuggcaaggcgaaaggaagcagagcuaucugguacauguggcugggcgcccgguuccucgaauucgaggcccugggguuuaugaaugaggaccacugguucucucgcgaaaacagccuuuccggagucgagggcgaagggcugcauaagcucggauauauucugagagauaucucuaaaauccccggcgggaauauguacgcugacgauaccgccggcugggacacacggauuaccgaggaugaccuucagaacgaggcuaagaucacggauauuauggaaccugagcacgcccugcucgcgacaagcaucuuuaaacugaccuaucagaauaaggugguccgcgugcagagacccgccaagaacggaacaguuauggacgugauuucccggcgcgaucaaagaggcucugggcaggucggaaccuacggccugaacacguucaccaauauggaagugcagcucauccggcagauggagagcgaagggaucuuucugccguccgagcuugagacaccuaaccuggcugaaagagugcucgacuggcuggagaaacauggagccgaacgccuuaagcggauggcuauuucuggcgacgauuguguugugaaacccaucgacgauagauucgccaccgcgcugacagcccucaaugacauggggaagguccgcaaagauauuccucaaugggagcccagcaagggcuggaacgacuggcagcaggugccuuuuugcucccaccacuuccaucagcugaucaugaaggauggacgggaaauuguugugcccuguagaaaucaagacgagcuggucggccgcgcucgggugagccagggggccggauggucucucagagagaccgcuugccugggcaaauccuaugcccagauguggcaacuuauguacuuucaccgccgggaucugagacucgcugccaacgcgaucuguagcgccgucccgguggacuggguuccuacaucucgcaccacgugguccauccaugcucaccaccaguggaugacaaccgaagauaugcugagcguguggaaucgggucuggauugaggaaaaccccuggauggaggacaagacccauguguccucuugggaagagguucccuaucuugggaaaagagaggaccaguggugcggaagccugaucggccucacagcccgggccaccugggcuacaaauauucagguggccaucaaccaagucagacgccugauugggaaugaaaacuaccuggauuacaugacguccaugaagcgguucaaaaaugagagcgacccugaaggcgcgcucugguga

SEQ ID NO: 18789 - RNA, 9879 nt, Artificial Sequence
  derived and/or modified CDS sequence (opt5) from DENV-1__FJ639821__SS-prME
agcgccaccaugcugcucaugcugcuucccacagcucuggccuuccaccucacgaccagaggcggggagccucauaugaucguguccaagcaggaacggggaaaaucucugcuuuuuaagacaagcgcgggcgucaacaugugcacccugauugcuauggaccucggggagcugugugaagauacaaugaccuacaaaugcccgcgcaucacagaggccgaacccgacgauguugacuguuggugcaaugccaccgauacgugggugaccuauggaacauguucccaaaccggcgagcacagacgggagaagcgcucuguggcucuggccccucaugucgggcucggacuggaaacaagaaccgagacguggaugagcuccgaaggcgcuuggaaacagauucagcggguggagacaugggcccuucgccaccccggcuucaccguuaucgcguuuuuccuggcccaugcuauugggacaucuaucacccagaagggaaucauuuuuauccuccugaugcuugugaccccuagcauggccaugagaugcgucggcauugggaaccgggacuucguggagggacuguccggcgcuacauggguugaugugguccucgaacacgggagcugugugacgaccauggccaagaauaaacccacacuggacaucgagcugcucaagaccgaagugacaaacccugcgguccugcgcaaacuuugcauugaggccaagaucucuaauaccacgacagauuccagauguccgacccaaggagaagcuacccugguugaggagcaggacgccaacuuugugugccggcgcacauucguggauagaggcuggggcaauggguguggacucuuuggcaaagggagccugcuuaccugcgcuaaguucaagugcgucacaaaacuggaaggaaagauugugcaguacgagaaccucaaauauucuguuaucgugacgguccacaccggcgaccagcaucaaguggggaaugaaacaaccgagcacggaacaaucgccaccauuacgccccaggccccuaccuccgaaauccagcugacagauuacggcgcucugacccucgacuguagcccccggacaggccuggacuuuaacgagaugguucuucugaccaugaaggagaaaucuuggcucgugcauaagcagugguuccuggaucuuccucugcccuggacguccggggcgagcacaucccaagaaaccuggaaucgccaggaccuccuggucacauuuaaaaccgcccacgcuaagaagcaggagguggucgugcugggaucucaagaaggcgccaugcacaccgcccucacaggggcuacggagauucagaccagcggaacaaccacaaucuucgccggccaucugaaaugcagacuuaagauggauaaacugacccucaaggggauguccuauguuauguguacgggcagcuucaaacuggaaaaggagguggcggagacacagcacggaaccguccuggugcagguucgguacgaaggcaccgacgcuccgugcaagauuccuuuuucuacacaagaugagaaaggggugacccagaacggaagacuuaucacagccaaucccaucgucacggacaaggaaaaaccugugaacauugagaccgagccccccuucggcgaauccuauaucgugguuggggccggagagaaggcucucaaacugagcugguuuaagcgcggcucuagcauugggaagauguucgaagccacagcucggggcgccagacgcauggcgauccugggagauaccgccugggacuuuggcuccauugggggagucuucacaucugugggcaaacucgugcaucaggucuuugggaccgcuuacggagugcuguucagcggcguuuccuggacgaugaagaucgggaucggcauucuucugaccuggcucggacugaauagccggucuacaucccugagcaugaccuguaucgccgugggcauggucacacuuuaccucggggugaugguucaggcugauucuggaugcgugauuaacuggaaaggcagagagcugaaguguggguccggaaucuuugucaccaacgaagugcacacauggaccgagcaauauaaauuccaggccgacagcccuaagcgccuguccgcggccauuggcaaggcuugggaggaagggguuugcggcauccggucugccacgagacucgagaauauuauguggaaacagaucagcaacgaacugaaucauauccuucuggagaacgauaugaaguuuacaguggucgugggagacgcuaauggcauucucgcccaggggaaaaagaugauccgcccgcaacccauggaacacaaauacuccuggaagucuuggggaaaagccaagauuaucggcgcugacauucagaacaccaccuucaucaucgaugggccugacacacccgaguguccugauggacagcgggcguggaauauuugggagguggaagacuauggcuuuggcaucuucaccacgaacauuuggcugaagcugagagauagcuacacacagaugugcgaccaccgccuuauguccgccgcuaucaaagauagcaaggccguccaugccgacaugggguauuggauugagucugaaaaaaaugagaccuggaagcucgcucgggccuccuucaucgaaguuaaaacauguaccuggcccaagagccacacacuguggucuaacggagugcuggaguccgagaugaucauuccgaagaucuacggcgggccuauuagccaacauaauuauagacccggauacuacacccagacggcgggcccuuggcaccucgggaaacuggaacuugauuuugaccugugcgagggaaccacaguggucguggaugaacacugcggcaaccggggccccucucuccgcaccacaaccguuacggggaagaucauucaugagugguguugcagaagcuguacacugccuccccugcgguucagaggagaggacggcugcugguaugggauggaaauccgcccggugaaagagaaggaagagaaucuuguccgguccauggugagcgcuggaucuggcgaaguugauaacuuuucccucgggauccugugugugagcauuaugaucgaggaggucaugagaucccgcuggucuagaaaaaugcugaugaccggaacacucgccguguuccugcuucugauuaugggccagcucaccuggaaugaccugauccggcugugcauuaugguuggcgccaacgcuagcgacgggaugggaaugggcaccacauaccuugcccugauggcgacguuuaagaugcgcccuauguucgcuguggggcuccuguuuagacggcucaccucccgcgaaguccugcuucugacaaucggacucucucugguggccagcguggagcugcccaacucccuugaagagcugggcgaugggcucgccaugggaauuaugaugcugaagcuccugaccgaauuccaaccccaccagcuuuggacaacccugcucucucugacguuugucaaaacaacccugagccuugacuaugcuuggaagaccacagccaugguucuguccaucgugagccucuucccucugugucucucuaccacaucccagaaaacgaccuggcugccggugcuucugggcagcuuuggcugcaagccccugacaauguuccucaucaccgagaauaaaauuugggggagaaagucuuggccucugaacgagggaaucauggcuauuggcaucgucuccauucuucugagcucucuccugaagaaugaugugccccucgccgggccucugaucgcgggaggcaugcuuaucgccuguuacguuauuuccgggagcuccgcugaccugagccuggauaaagccgcugaagugucuugggagcaggaagccgagcauagcggagccucccacaacaucucugucgaagugcaagacgauggcacaaugaagauuaaagacgaggagcgggaugacacccucacgauccugcuuaaggcuacccugcucgcgguuagcggcguguaucccauguccauuccugccacacuguuugucugguacuucuggcagaaaaagaaacagcgcucuggggugcucugggauacccccagcccgccugaagucgagagagcugugcuggacgauggaaucuaucggauccuucagcgcggccugcuggggagaucccaaguuggagugggcgucuuccaggacgggguguuucauacaauguggcacguuacccggggagccgugcucauguaccagggcaagagacuggaacccucuugggccugcgucaagaaagaccuuauuagcuacggcgggggauggcgcuuccagggcuccuggaauacaggggaggaggugcaagugaucgcuguugaaccuggaaagaaccccaaaaauguccagacgaccccgggcacauuuaagaccccugagggggaagugggagccauugcgcuggauuucaaacccggcaccagcggcucuccuaucgugaaccgggaggggaagauugucggacucuauggcaauggggugguuacaacguccggaaccuacgugagcgcuaucgcccaggccaaggcuucucaagaaggcccccugcccgagauugaggacgaagucuuuaaaaagagaaaccucacaaucauggaucugcacccuggguccggcaaaacccgccgguaucuuccggccaucgugagagaggcgauuaagcgcaaacugcggacacugauccucgcucccaccagaguuguggccagcgaaauggccgaggcucugaagggaaugccuauucgcuaccagacgacagccgucaaguccgaacauaccggccgggagaucguggaccuuaugugucacgcuaccuucacaaugagacugcucucucccguucgggugccuaauuauaacaugauuaucauggaugaggcccauuuuaccgaccccgcgagcaucgccgcucgcggguacauuuccacaagagucggaaugggcgaagccgcugccaucuucaugaccgccacgccuccggggagcguggaggcuuuuccccagucuaaugcggugauucaggaugaagagcgggacaucccugaacgcuccuggaacagcggauaugauuggauuacagacuuccccggcaaaaccgucugguuuguuccuucuaucaagagcgggaaugauaucgccaacugccugagaaaaaacggcaagcgggugauucaacuguccagaaaaacauucgacaccgaguaccagaagacgaagaauaacgacugggauuacguggucaccacagacaucucugagaugggagcuaauuuccgcgccgaucgggugauugaccccagacgcugccucaaaccgguuauccuuaaggauggcccugaacgggugauucuggccgggcccaugcccgucaccguggcuagcgccgcgcagagacgcggacggaucggcagaaaccagaauaaagagggggaccaauauguuuacaugggacagccucugaacaaugaugaagaccacgcucauuggacagaggccaagaugcuccuggauaacauuaauacccccgagggcaucaucccugcccuuuuugaaccggagcgcgaaaaauccgcugccauugacggggaguauagacugcggggcgaagcgcgcaagacauucguggagcucaugagacggggagaucugcccgucuggcugucuuacaagguggccagcgagggcuuucaguauuccgaccgcagaugguguuucgauggggaacggaacaaucagguccucgaggaaaacauggacguggagaucuggaccaaagaaggagagagaaagaaacuucgcccucgguggcuggacgcuagaacguacagcgauccccuggcccuccgcgaguuuaaggaauucgcugccggccggagaucuguuuccggggaccugauucuugagaucggaaaacugccucaacaccucacacugcgggcucagaaugcccuggauaaccucgugaugcuucacaauagcgaacagggcggcaaggcguaucgccaugccauggaggaacugcccgacaccauugagacccugaugcuccuggcucuuaucgccgugcugacagggggagucacccucuuuuuccuguccggcaaagggcugggaaagacaucuaucggccuccuuugcguuacggcuagcuccgcccugcuguggauggccucuguggagccgcacuggauugcugcgagcaucauucucgaauuuuuccugauggugcuucugaucccugagcccgauagacagcggaccccucaagacaaccagcucgccuacgucgugauugggcugcuguuuaugauccucacaguugcugccaacgaaaugggacuucuggagaccacaaagaaagaucugggcaucggcuacguggccgcugagaaucaucagcacgccaccaugcucgacgucgaucugcaccccgcguccgccuggacgcuuuaugcuguggccaccacagucauuaccccuaugaugcgccauacaaucgaaaacaccacggcuaauauuagccugacagccaucgcgaaccaagccgcuauucucauggggcuggacaagggauggcccaucucuaaaauggauauuggcgugccgcugcucgcccuuggguguuacucccagguuaauccucugacccugacagcugccgugcucaugcuggucgcucacuaugccaucaucggacccggccuucaggcgaaggccaccagagaggcucagaaacggaccgccgcugggauuaugaagaaccccacaguggacggaaucguugccauugaucuggacccuguggucuacgacgugaaguucgaaaaacaacucggccagaucaugcugcugauucucugcacgagccagauccuucugaugcgcaccacaugggcccugugugagucuaucacccucgcgacaggcccgcugaccacgcuuugggaagggucccccggaaaguuuuggaauacaaccauugcugugagcauggccaacaucuucagaggcucuuaucuggcuggggccggacucgccuucagccugaugaaaucccugggcgggggacggcgcggcaccggcgcucagggggagacacucggagagaaguggaaaagacaacuuaaucagcugucuaagagcgaauuuaacaccuacaagcgguccggcauuauggagguugauagaagcgaagccaaagaggggcugaagcgcggagaaacaacgaaucaugcggucucccggggcaccgccaaacucagaugguucguggagcgcaaccuggugaagccugaggggaaagucaucgaccuuggaugcggccggggcggguggucuuauuacugugcuggacugaagaagguuacagaagugaaaggcuacaccaaggggggacccggccacgaggaaccuauucccauggccacauauggguggaaucucgugaaacugcauagcggaaaggaugucuuuuucaugccuccggagaaaugcgacacccugcucugugauaucggcgaauccucucccaacccuacgaucgaggagggcagaacccuucgcgugcugaagaugguugaacccuggcugcgggggaaucaguuuugcauuaaaauccucaacccuuacaugcccagcguggucgagacacuggaacagaugcaaagaaagcacggaggcaugcuugugcgcaauccgcugucccggaacucuacccacgagauguauuggguuagcugugggacaggaaacauuguguccgcugucaauaugaccagcagaaugcuccugaaccgcuucacaauggcccaucggaagccuaccuacgagagagacguggaucugggcgcggggacgcgccacgugacagucgaacccgagguugccaaucucgacaucauuggacagagaaucgaaaacauuaaaaaugagcauaagucuaccuggcacuaugaugaagacaaccccuacaaaaccugggcuuaucacggcuccuacgaggugaagccuagcggcucugccuccagcauggugaauggggucgugcggcugcuuacaaaacccugggauguuaucccuauggugacgcagaucgcuaugaccgacacaaccccguuuggacaacagcgcgucuucaaggagaagguggacacaagaaccccccgggccaaaagaggcacaacccagauuauggaaguuacggcuaaguggcuguggggguuucucucucggaacaaaaagccucgcaucugcaccagagaggaauucacacggaaagugcgcuccaaugccgcgauuggagccgucuuuguggaugagaaccaguggaauagcgcuaaggaagccguugaggacgagagauucugggaucuggugcaucgggaacgcgagcuucacaagcaaggcaaaugcgcuaccugugucuacaacaugauggggaagagagaaaaaaagcugggcgaguuuggaaaagccaagggcucccgggccaucugguauauguggcucggggcgcgcuuccuggaauucgaggcucugggauuuaugaaugaggaccauugguucagcagagaaaacucucucagcggcguggagggggaaggacugcacaagcuuggcuacauucugcgggauaucuccaaaauccccgggggcaauauguaugccgacgauacagccggaugggacacccgcauuacggaggaugaccuccagaacgaggcuaagaucacagauauuauggaaccugagcaugcccugcuugcuaccucuaucuuuaaacugacauaccagaacaaggucgugagaguucagcggcccgccaaaaauggcaccgugauggacgucauuagccgcagagaucaacggggguccggacaggugggcacguaugggcucaacaccuucacaaauauggaagugcagcugaucagacagauggagucugaaggaaucuuucugccgagcgagcucgagaccccuaaccuggcggaacgcguucuugacuggcuggagaagcacggcgccgaacggcucaaaagaauggcuauuuccggggacgauugcguggucaagcccaucgacgaucgcuucgccacagcucugaccgcccuuaaugacaugggcaaggugcggaaagauauuccucaaugggagcccucuaagggauggaacgacuggcagcagguuccuuuuuguagccaccauuuccaccagcugaucaugaaagauggcagagaaauugugguccccugccgcaaucaagacgagcucguggggcgggcgagagucucccagggagccggcuggagccugcgcgagacagcuugucuggggaagucuuacgcccagauguggcaacucauguauuuucaucggagagaucugcgccuugcugccaacgcuaucugcuccgccgugccgguugacugggugccuaccagccggacgacauggucuauccacgcgcaccaucaguggaugaccaccgaagauaugcuguccgucuggaauagaguguggauugaggaaaaccccuggauggaggacaaaacacacguuagcuccugggaagaggugcccuaccucggaaagcgggaggaccagugguguggcucucugaucgggcuuaccgccagagcuacaugggccacgaauauucaggucgccaucaaccaagugcgccggcugauuggcaaugaaaacuaccucgauuauaugaccagcaugaagagauucaaaaaugaguccgacccugaaggagcucugugguga

SEQ ID NO: 18790 - RNA, 9879 nt, Artificial Sequence
  derived and/or modified CDS sequence (opt5) from DENV-1__FJ639824__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccccccuuuggcgaguccuauaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaucagguguucgggaccgccuacggaguucuuuuuagcggcguguccuggacgaugaagaucgggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuucgugaccaacgagguucacacauggaccgaacaauauaaguuucaggcugauagcccuaaacggcucuccgccgcgauuggcaaggccugggaggagggggugugcggcaucagaucugcuacgcgccuggaaaauauuauguggaaacagaucagcaacgagcuuaaucauauccugcucgaaaacgacaugaaguucacagucguggugggagacgccaauggcauucuggcucaggggaaaaagaugauccggccgcaacccauggagcacaaauacuccuggaagucuuggggaaaggccaaaauuaucggcgccgauauucagaacaccaccuuuaucaucgacgggccugauacacccgaauguccugacggacagagagcuuggaauauuugggaggucgaggauuauggcuucggcaucuuuaccacgaacauuuggcugaagcuucgcgacagcuacacacagaugugcgaucaccggcucauguccgcggccaucaaagacagcaaggcuguucaugccgauaugggguauuggauugaaucugagaaaaaugaaaccuggaagcuggccagagcuuccuucaucgaggugaagacauguaccuggcccaaaagccacacacuguggucuaacggagugcucgaauccgagaugaucauuccgaagaucuacggcgggccuauuagccaacauaauuaucgccccggauacuucacccagacggccggcccuuggcaccuggggaaacuugagcuggacuuugaucucugcgaaggaaccacagucgugguugacgagcacugcggcaaccggggccccucucugagaaccacaaccgugacggggaagaucauucaugaaugguguugccggagcuguacacugccuccccuucgcuucagaggagaggauggcugcugguacgggauggagauccggccggucaaagaaaaggaggaaaaucucgugagauccaugguuagcgcgggaucuggcgagguggacuccuuuagccuggggauccugugugucuccauuaugaucgaagaggugaugcgcucucgguggagcagaaagaugcucaugaccggaacacuggcuguuuuccuucugcucauuaugggccagcugaccuggaacgaccugauccgccuuugcauuauggugggcgccaaugccuccgauagaauggggaugggaaccacauaucuggcucucauggccacguuuaaaaugcggccuauguucgcggucggccugcucuuucgcagacugaccucucgggaggugcuucugcucacaaucgggcugagccugguggcuuccgucgaacuucccaacucucuggaggaacucggagacggccuggccauggggauuaugaugcucaagcugcuuaccgaguuccaaccccaccagcuguggacaacccuccugagccugacguuuguuaaaacaacccuuucccuggauuacgccuggaagaccacagcuauggugcucagcaucgugucucuguucccucucugucuguccaccacaagccagaaaacgaccuggcuuccgguccugcugggaucuuuuggcugcaagccccucacaauguuccugaucaccgaaaacaagauuuggggccgcaaauccuggccucuuaaugaggggaucauggccauuggaaucgugagcauucugcucucuucccugcucaagaacgacguuccccuggcuggcccucuuguggccgggggaaugcugaucgcguguuaugucaucagcggcuccagcgccgaucugucucucgagaaagcugccgaagugagcugggagcaggaagcugagcauuccggggccucucacaauauucugguugaagugcaagacgauggaacaaugaagaucaaagacgaggagagagaugacacccuuacgauucugcucaaggccacccugcucgcugucagcggcguguaccccauguccaucccugcgacacuguuugucugguauuucuggcagaaaaagaagcagcggucuggcgugcuuugggauacccccagcccgccugaaguugagcgcgccgugcuggacgaugggauuuacagaauccugcagcggggacuccugggccgcucccaagucggggugggaguuuuccaggacggcguguuucauacaauguggcacgucaccagaggggcugugcuuauguaucagggaaaacggcuggaacccucuugggccagcgugaagaaagaccucaucuccuacggcggcggguggagauuccagggaagcuggaacacaggcgaggagguucaagucauugccguggaaccugggaagaaucccaaaaacgugcagacgaccccgggaacauuuaagaccccugagggcgaagucggggcuaucgcccuggauuucaagcccggaaccucuggcuccccuauugugaaucgcgagggcaaaaucguugggcucuacggaaacggcguggucacaacgagcgggaccuaugugucugcgauugcucaggccaaggccucccaagaaggaccccugcccgagaucgaggacgaaguuuuuaaaaagcggaaucuuacaauuauggaucugcacccuggcagcgggaaaaccagacgcuaccugccggcuaucgugcgggaggccaucaagagaaagcuccgcacacugauucuugcgcccacccgggucguggcuuccgaaauggccgaggcccugaaaggcaugccuaucagauaucagacgacagcuguuaagucugaacauaccggacgcgagauuguggaccucaugugccacgccaccuucacaaugcggcugcugagccccgucagagugccuaacuacaauaugaucauuauggaugaggcucauuuuaccgaccccgccuccaucgcggcccggggcuauaucagcacacgcguggggaugggagaagcugccgcuauuuucaugaccgccacgccuccgggcucugucgaggccuuuccccaguccaacgcuguuauccaggaugaagagagagacauuccugaacggagcuggaauucuggguacgauuggaucacagacuuccccggaaaaaccgugugguuugugccuagcauuaaguccggcaacgauaucgcgaauugucuccgcaaaaacgggaagagagucauccaacuuucucggaagacauucgacaccgaguaucagaaaacgaagaacaaugacugggauuacgugguuaccacagacauuagcgagaugggcgccaacuucagagcugaucgcgugaucgacccccggagaugccugaaaccggucauucugaaggauggaccugaacgcgugauccucgccggccccaugcccguuaccguggccuccgcugcccagcggagagggcgcauuggacggaaucagaacaaagagggcgaccaauacgucuauauggggcagccucugaauaacgaugaagaccacgcgcauuggacagaggcuaagaugcuucuggauaauaucaacacccccgagggaauuaucccugcccucuuugaaccggagagagaaaagucugccgcuaucgacggcgaguaccgccugagaggggaagcccggaaaacauucguggagcugaugcgcagaggcgaucuccccgucuggcuuagcuauaagguggcguccgagggauuucaguacagcgaccggcgcuggugcuucgauggcgaaagaaauaaccagguucuggaggaaaauauggacguggagauuuggaccaaagaaggggagcggaagaaacugagaccucgcuggcucgacgcccggacguauucugauccccuggcucuuagagaguuuaaggaauucgccgcuggacgccgguccgugagcggcgaccugauccucgagauugggaaacugccucaacaccugacacucagagcccagaacgcucuugauaaucuggucaugcugcacaacuccgaacagggaggcaaggccuaccggcaugcgauggaggaacuccccgacaccaucgagacccugaugcuucuggcccucauugcuguucugacaggcggggugacccuguuuuuccucucuggaaagggccuugggaaaacaagcaucggacugcugugugugacggccuccucugcucuccuguggauggccagcgucgagccgcacuggaucgccgcuuccauuauccuugaauuuuuccugauggugcuccugauuccugagcccgaucgccagagaaccccucaagacaaucagcuggcguauguugugaucggccuccuuuuuaugauucugacagucgccgcuaacgaaauggggcugcucgagaccacaaagaaagaucugggaaucggcuacguggccgccgagaaccaucagcacgcuaccaugcuugacgucgaucugcggcccgccagcgcguggacgcucuacgccguggcuaccacaguuaucaccccuaugaugcgccacacaauugaaaauaccacggccaacaucucucugacagcuauugccaaucaagcggccauccugaugggccucgacaagggguggcccauuuccaaaauggauaucggagugccgcuucuggcucugggcugcuauagccaggucaacccucucacccugacagccgcugugcuuaugcugguugcccauuacgcuauuaucgggcccggacuccaggccaaggcgaccagagaggcccagaagcggaccgcugccggcaucaugaaaaaucccacaguggacgggauugucgcuaucgaucuggacccugugguguaugacgccaaguucgaaaaacaacugggacagauuaugcuccuuauccuguguacgucucagauucugcucaugcgcaccacaugggcccugugcgaguccaucacccuugcgacaggcccgcugaccacgcucugggaaggcagccccgggaaguuuuggaacacaaccaucgcuguuucuauggccaauauuuucagaggaagcuaccuggcuggcgccgggcuggccuucucccucaugaaaucucuuggaggcgggcggcgcggaaccggcgcucagggcgagacacugggggagaaguggaagagacaacugaaccagcucagcaaauccgaauuuaauaccuauaagcggagcggaaucauggaggucgauagauccgaagccaaagagggccugaagcgcggggaaacaacgaaacacgcggugucucggggaaccgccaagcuuagaugguucguggagcgcaaccuggucaagccugagggcaaaguuauugaccucggguguggacggggcggcuggagcuacuauugcgcugggcugaagaaagugacagaagugaagggauacaccaaaggcgggcccggacaugaggaaccuauccccauggccacauacggcuggaaucuggucaagcuccacuccgggaaagauguguuuuucaugccuccggagaagugugacacccuucugugcgauauuggagaaucuagccccaacccuacgaucgaggagggcagaacccugcgcguucucaagaugguggaacccuggcugaaaggcaaucaguuuuguaucaagauucuuaacccuuauaugcccuccgucguggagacacuggaacagaugcaacggaaacaugggggaaugcucguuagaaauccgcugucucgcaacagcacccacgagauguacuggguguccugcggcacagggaauaucgucagcgcugugaacaugaccucucggaugcugcucaacagauucacaauggcccaccgcaagccuaccuaugagcgggacguggaucugggagcgggcacgagacaugucgccguugaacccgagguggcuaaucuugacauuaucgggcagcgcauugaaaacaucaaaaaugagcacaaguccacauggcauuacgaugaagacaaccccuauaagaccugggccuaccacggaagcuaugaggugaaaccuucuggcuccgcuagcucuauggucaauggcgugguuagacugcucaccaagcccugggaugugauuccuauggucacacagaucgccaugacggacaccacaccguuugggcaacagcggguguucaaagagaagguugacacccgcacacccagagcuaaacggggaaccacacagaucauggaagugaccgccaaguggcuguggggcuuucuuuccagaaacaagaaaccucggauuuguacgcgcgaggaauucaccagaaagguccggagcaaugcggccaucggggcuguguuuguugaugagaaccaguggaauuccgccaaagaagcuguggaggacgagcgcuucugggaucugguccacagagaacgggagcuccauaagcaaggaaaaugcgccacaugcguguacaacaugaugggcaagcgcgaaaagaaacugggggaguuuggcaaggccaaaggaagcagagcgauuugguacauguggcugggcgcucgguuccucgaauucgaggcccugggguuuaugaaugaggaccacugguucucucgcgaaaacagccuuuccggagucgagggcgaagggcugcauaagcucggauauauccugagagauauuucuaaaauccccggcgggaauauguacgccgacgauaccgcuggcugggacacacggaucaccgaggaugaccuucagaacgaggccaagauuacggauaucauggaaccugagcacgcucugcucgccacaagcauuuuuaaacugaccuaucagaauaaggugguucgcgugcagagacccgcgaagaacggaacagucauggacgugaucucccggcgcgaucaaagaggcucugggcaggugggaaccuacggccugaacacguucaccaauauggaaguucagcucauucggcagauggagagcgaagggaucuuucugccguccgagcuugagacaccuaaccuggccgaaagagugcucgacuggcuggagaaacauggagcugaacgccuuaagcggauggccaucucuggcgacgauugugucgugaaacccauugacgauagauucgcuaccgcccugacagcgcucaaugacauggggaagguucgcaaagauaucccucaaugggagcccagcaagggcuggaacgacuggcagcaggugccuuuuugcucccaccacuuccaucagcugauuaugaaggauggacgggaaaucgucgugcccuguagaaaucaagacgagcuggucggccgcgcccgggugagccagggggcuggauggucucucagagagaccgccugccugggcaaauccuaugcucagauguggcaacuuauguacuuucaccgccgggaucugagacucgccgcuaacgccauuuguagcgcgguuccgguggacugggucccuacaucucgcaccacgugguccauccaugcccaccaccaguggaugacaaccgaagauaugcugagcguguggaaucggguuuggaucgaggaaaaccccuggauggaggacaagacccauguguccucuugggaagagguccccuaucuugggaaaagagaggaccaguggugcggaagccugauuggccucacagcucgggccaccugggccacaaauauccagguggcuauuaaccaagugagacgccugaucgggaaugaaaacuaccuggauuacaugacguccaugaagcgguucaaaaaugagagcgacccugaaggcgcccucugguga

SEQ ID NO: 18791 - RNA, 9879 nt, Artificial Sequence
  derived and/or modified CDS sequence (opt5) from DENV-1__JN819425__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccccccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagguguuugggaccgccuacggaguucuguucagcggcguguccuggacgaugaaaaucgggaucggcauucuucugaccuggcucggacugaauagccgcucuacaucccugagcaugaccuguaucgcugucggcauggugacacuuuaccucgggguuauggugcaggccgauucuggaugcgucauuaacuggaagggccgggagcugaaauguggguccggaaucuuugugaccaacgaaguucacacauggaccgagcaauauaaguuccaggcugacagcccuaagagacuguccgccgcgauuggcaaagccugggaggaaggggugugcggcauccgcucugcuacgcggcucgagaauauuauguggaagcagaucagcaacgaacugaaucauauccuucuggagaacgauaugaaauuuacagucguggugggagacgccaauggcauucucgcucaggggaagaaaaugaucagaccgcaacccauggaacacaaguacuccuggaaaucuuggggaaaggccaagauuaucggcgccgacauucagaacaccaccuucaucaucgaugggccugacacacccgaguguccugauggacagcgcgcuuggaauauuugggaggucgaagacuauggcuuuggcguuuucaccacgaacaucuggcugaaacugcgggauagcuacacacagaugugcgaccacagacuuauguccgcggccauuaaggauagcaaagcugugcaugccgacaugggguauuggaucgagucugaaaagaaugagaccuggaaacucgcccgcgcuuccuucauugaagugaagacauguaccuggcccaagagccacacacuguggucuaacggaguccuggaguccgagaugaucaucccgaaaauuuacggcgggccuaucagccaacauaauuaucggcccggauacuuuacccagacggccggcccuuggcaccucgggaagcuggaacuugauuucgaccugugcgagggaaccacagugguuguggaugaacacugcggcaacagaggccccucucuccggaccacaaccgucacggggaaaauuauccaugagugguguugccgcagcuguacacugccuccccugagauuucggggagaggacggcugcugguacgggauggaaauuagaccggugaaggagaaagaagagaaucuuguucgcuccauggugagcgcgggaucuggcgaagucgauuccuucagccucgggauccuguguguguccaucaugauugaggagguuaugcggucuagauggagccgcaagaugcugaugaccggaacacucgcuguguuucugcuucugaucaugggccagcucaccuggaacgaccugauuagacugugcaucauggucggcgccaaugccuccgaccggauggggaugggaaccacauaucuugcucugauggccacguucaagaugcgcccuauguuugcggugggccuccuguucagacggcucaccucucgcgaagugcugcuucugacaauugggcucagccuggucgcuuccguugagcugcccaacucucuugaagagcugggagauggccucgccauggggaucaugaugcugaaacuccugaccgaauuucaaccccaccagcuuuggacaacccugcucagccugacguucgugaagacaacccugucccuugacuacgccuggaaaaccacagcuauggugcugagcauugucucucucuuuccucugugucucuccaccacaagccagaagacgaccuggcugccggugcuucugggaucuuucggcugcaaaccccugacaauguuucucaucaccgagaacaagaucuggggcagaaaguccuggccucugaaugaggggauuauggccaucggaauuguuagcauccuucugucuucccuccugaaaaacgaugugccccucgcuggcccucugauugccgggggaaugcuuaucgcguguuaugucaucagcggcuccagcgccgaccugucucuggaaaaggcugugaaaauuagcugggagcaggaagccgagcauuccggggcuucucacaauauccucguugaagugcaagaugacggaacaaugaagauuaaagaugaggagcgggacgauacccugacgauccuucugaaggccacccuccuggccgucagcggcguguaccccauguccauuccugcuacacucuucgucugguauuucuggcagaaaaagaagcagcgcucuggcgugcugugggacacccccagcccgccugaaguugagagagcggugcuugaugacgggaucuaccggauccugcagcgcggacugcucggcagaucccaagucggggugggaguuuuucaggauggcguguuccauacaauguggcacgucacccggggggccgugcugauguaucagggaaaaagacuugaacccucuugggcuagcgugaagaaagaccugauuuccuacggcggcggguggcgcuuucagggaagcuggaacacaggcgaggagguucaagucaucgccguggaaccugggaagaaucccaaaaacgugcagacgaccccgggaacauucaagaccccugagggcgaagucggggccauugcucucgacuuuaagcccggaaccucuggcuccccuaucgugaaucgggagggcaaaauuguugggcuguacggaaacggcguggucacaacgagcgggaccuaugugucugccaucgcgcaggcuaaggccucccaagaaggaccccuccccgagauugaggaugaaguuuucaaaaagagaaaucugacaaucauggaccuucacccuggcagcgggaaaacccgccgguaccugccggccaucgugagagaggcuauuaagcgcaagcugcggacacucauccuggcccccaccagagucguggcguccgaaauggcugaggcccuuaaaggcaugccuauucgcuaucagacgacagccguuaagucugaacauaccggacgggagaucguggaucugaugugccacgcuaccuuuacaaugagacuccugagccccguccgggugccuaacuacaauaugauuaucauggacgaggcccauuucaccgaucccgcuuccaucgccgcgcgcggcuauauuagcacaagaguggggaugggagaagccgcugccaucuuuaugaccgcuacgccuccgggcucugucgaggccuucccccaguccaacgccguuauucaggacgaagagcgggauaucccugaacgcagcuggaauucuggguacgacuggauuacagauuuucccggaaaaaccgugugguucgugccuagcaucaaguccggcaacgacaucgcuaauugucugagaaaaaacgggaagcgggucauucaacucucuagaaagacauucgauaccgaguaucagaaaacgaagaacaaugacugggacuacgugguuaccacagauaucagcgagaugggcgcgaacuuucgcgccgaccgggugauugaucccagacgcugccuuaaaccggucauccugaaggacggaccugaacgggugauucuggcuggccccaugcccguuaccguggccuccgccgcucagagacgcgggcggaucggaagaaaucagaacaaagagggcgaucaauacgucuauauggggcagccucucaauaacgacgaagaucacgcccauuggacagaggcgaagaugcugcuugacaauauuaacacccccgagggaaucaucccugcucuguucgaaccggagcgcgaaaagucugccgccauugauggcgaguacagacuccggggggaagcucgcaaaacauuuguggagcugaugagacggggcgaccugcccgucuggcucagcuauaagguggccuccgagggauuccaguacagcgaucgcagauggugcuuugacggcgaacggaauaaccagguucuugaggaaaauauggauguggagaucuggaccaaagaaggggagagaaagaaacugcgcccucgguggcuggacgcgagaacguauucugacccccucgcccugcgcgaguucaaggaauuugcugccggacggagauccgugagcggcgaucuuauucuggagaucgggaaacucccucaacaccugacacugcgggcucagaacgcccucgacaaucuugucaugcugcacaacuccgaacagggaggcaaggcuuaccgccaugccauggaggaacugcccgauaccauugagacccucaugcugcuugcgcugaucgccguucucacaggcggggugacccuguucuuucugucuggaaagggccucgggaaaacaagcaucggacuucugugugugacggcuuccucugcccugcucuggauggcuagcgucgagccgcacuggauugccgccuccaucauucuggaauucuuucuuauggugcugcucaucccugagcccgacagacagcggaccccucaagauaaucagcuggcuuauguugugauuggccugcucuucaugauccuuacagucgcggccaacgaaauggggcugcuggagaccacaaagaaagaccucggaaucggcuacguggcugccgagaaccaucagcacgccaccaugcuggaugucgaccuucaccccgcuagcgccuggacgcuguacgcgguggccaccacaguuauuaccccuaugaugcgccauacaaucgaaaauaccacggcuaacauuucucucacagccaucgcuaaucaagccgcgauucugaugggccuggauaagggguggcccaucuccaaaauggacauuggagugccgcuccuugcccugggcugcuauagccaggucaacccucugacccucacagcugccgugcugaugcuuguugcucacuacgccaucaucgggcccggacugcaggcuaaggccaccagagaggcgcagaagcggaccgccgcuggcauuaugaaaaaucccacaguggaugggaucgucgccauugaccucgauccugugguguaugacgcuaaguuugaaaaacaacugggacagaucaugcugcucauucuuuguacgucucagauccugcugaugcgcaccacaugggcccucugcgaguccaucacccuggccacaggcccgcuuaccacgcugugggaaggcagccccgggaaguucuggaacacaaccauugcgguuucuauggcuaauaucuucagaggaagcuaccucgccggcgcugggcuggccuuuucccugaugaaaucucucggaggcgggcggcgcggaaccggcgcccagggcgagacacuuggggagaaguggaagagacaacugaaccagcugagcaaauccgaauucaauaccuauaagcggagcggaauuauggaggucgacagauccgaagcuaaagagggccucaagcgcggggaaacaacgaaacaugccgugucucggggaaccgcgaagcugagaugguuuguggagcgcaaccuugucaagccugagggcaaaguuaucgaucugggguguggacggggcggcuggagcuacuauugcgccgggcucaagaaagugacagaagugaagggauacaccaaaggcgggcccggacacgaggaaccuauucccauggcuacauacggcuggaaucuggucaagcugcauuccgggaaagacguguucuuuaugccuccggagaagugugauacccuccuuugcgacaucggagaaucuagccccaacccuacgaucgaggagggcagaacccugcgcguucugaagaugguggaacccuggcuccggggcaaucaguucuguauuaaaauccugaacccuuauaugcccuccgucguggagacacuugaacagaugcaaagaaagcacgggggaaugcugguucgcaauccgcucucucggaacagcacccacgagauguacuggguguccugcggcacagggaauauugucagcgccgugaacaugaccucuagaaugcugcugaaccgcuuuacaauggcucaucggaaaccuaccuaugagagagauguggaccucggagccggcacgcgccacgucgcgguugaacccgagguggccaaucuggauaucauugggcagagaaucgaaaacauuaagaaugagcauaaauccacauggcacuacgacgaagauaaccccuauaagaccugggcuuaccacggaagcuaugaggugaagccuucuggcuccgccagcucuauggucaauggcgugguucggcuucugaccaaacccugggacgugaucccuauggucacacagaucgcuaugacggauaccacaccguucgggcaacagcgcguguuuaaggagaaaguugacaccagaacaccccgggccaagagaggaaccacacagauuauggaagugaccgcuaaauggcucuggggcuuccugucccggaacaagaagccucgcaucuguacgagagaggaauuuacccggaaaguccgcagcaaugccgcgauuggggccguguucguugacgagaaccaguggaauuccgcuaaggaagccguggaggaugagagauuuugggaccuuguccaucgggaacgcgagcugcacaaacaaggaaagugcgcuacaugcguguacaacaugaugggcaaaagagaaaagaagcucggggaguucggcaaagccaagggaagccgggccaucugguacauguggcugggcgcgcgcuuccuggaauuugaggcucucggguucaugaaugaggaucauugguuuucuagagaaaacagccuguccggagucgagggcgaagggcuucacaaacugggauauauucuccgggacaucucuaagauccccggcgggaauauguacgccgaugacaccgccggcugggauacacgcauuaccgaggacgaucugcagaacgaggcuaaaaucacggacauuauggaaccugagcaugcccuucuggcuacaagcaucuucaagcucaccuaucagaauaaagugguuagagugcagcggcccgccaagaacggaacagucauggaugugauuucccgcagagaccaacggggcucugggcaggugggaaccuacggccugaacacguuuaccaauauggaaguucagcugaucagacagauggagagcgaagggaucuuccucccguccgagcuggagacaccuaaccuugcggaacgcgcccuggauuggcucgagaagcacggagcugaacggcugaaaagaauggccauuucuggcgacgacuguguggucaagcccaucgaugaccgcuuugcuaccgcccuuacagcgcugaaugauauggggaaagugcggaaggacauuccucaaugggagcccagcaaaggcuggaacgauuggcagcagguuccuuucugcucccaccauuuucaccagcucaucaugaaggacggaagagaaauugugguccccugucgcaaucaagaugagcuggugggccgggccagagucagccagggggcuggauggucucugcgcgagaccgccugccucggcaaguccuaugcucagauguggcaacugauguacuuccaucggagagaccuucgccuggccgcuaacgccaucuguagcgcggugccgguugauugggugccuacaucucggaccacgugguccauccacgcccaccaucaguggaugacaaccgaagacaugcucagcgucuggaauagaguguggauugaggaaaaccccuggauggaggauaaaacccacguuuccucuugggaagaggugcccuaucuggggaagcgggaggaccaguggugcggaagccuuaucggccugacagcuagagccaccugggccacaaauauucaggucgcuaucaaccaagugcgccggcucauugggaaugaaaacuaccuggacuacaugacguccaugaaaagauuuaagaaugagagcgauccugaaggcgcccugugguga

SEQ ID NO: 18792 - RNA, 9879 nt, Artificial Sequence
  derived and/or modified CDS sequence (opt5) from DENV-1__FJ850099__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccccccuuuggcgaguccuauaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaucagguguucgggaccgccuacggaguucuuuuuagcggcguguccuggacgaugaagaucgggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuucgugaccaacgagguucacacauggaccgaacaauauaaguuucaggcugauagcccuaaacggcucuccgccgcgauuggcaaggccugggaggagggggugugcggcaucagaucugcuacgcgccuggaaaauauuauguggaaacagaucagcaacgagcuuaaucauauccugcucgaaaacgacaugaaguucacagucguggugggagacgccaauggcauucuggcucaggggaaaaagaugauccggccgcaacccauggagcacaaauacuccuggaagucuuggggaaaggccaaaauuaucggcgccgauauucagaacaccaccuuuaucaucgacgggccugauacacccgaauguccugacggacagagagcuuggaauauuugggaggucgaggauuauggcuucggcaucuuuaccacgaacauuuggcugaagcuucgcgacagcuacacacagaugugcgaucaccggcucauguccgcggccaucaaagacagcaaggcuguucaugccgauaugggguauuggauugaaucugagaaaaaugaaaccuggaagcuggccagagcuuccuucaucgaggugaagacauguaccuggcccaaaagccacacacuguggucuaacggagugcucgaauccgagaugaucauuccgaagaucuacggcgggccuauuagccaacauaauuaucgccccggauacuucacccagacggccggcccuuggcaccuggggaaacuugagcuggacuuugaucucugcgaaggaaccacagucgugguugacgagcacugcggcaaccggggccccucucugagaaccacaaccgugacggggaagaucauucaugaaugguguugccggagcuguacacugccuccccuucgcuucagaggagaggauggcugcugguacgggauggagauccggccggucaaagaaaaggaggaaaaucucgugagauccaugguuagcgcgggaucuggcgagguggacuccuuuagccuggggauccugugugucuccauuaugaucgaagaggugaugcgcucucgguggagcagaaagaugcucaugaccggaacacuggcuguuuuccuucugcucauuaugggccagcugaccuggaacgaccugauccgccuuugcauuauggugggcgccaaugccuccgauagaauggggaugggaaccacauaucuggcucucauggccacguuuaaaaugcggccuauguucgcggucggccugcucuuucgcagacugaccucucgggaggugcuucugcucacaaucgggcugagccugguggcuuccgucgaacuucccaacucucuggaggaacucggagacggccuggccauggggauuaugaugcucaagcugcuuaccgaguuccaaccccaccagcuguggacaacccuccugagccugacguuuguuaaaacaacccuuucccuggauuacgccuggaagaccacagcuauggugcucagcaucgugucucuguucccucucugucuguccaccacaagccagaaaacgaccuggcuuccgguccugcugggaucuuuuggcugcaagccccucacaauguuccugaucaccgaaaacaagauuuggggccgcaaauccuggccucuuaaugaggggaucauggccauuggaaucgugagcauucugcucucuucccugcucaagaacgacguuccccuggcuggcccucuuaucgccgggggaaugcugaucgcguguuaugugauuagcggcuccagcgccgaucugucucucgagaaagcugccgaagucagcugggagcaggaagcugagcauuccggggccucucacaauauccugguggaaguucaagacgauggaacaaugaagauuaaagacgaggagagagaugacacccuuacgauccugcucaaggccacccugcucgcugugagcggcgucuaccccauguccauuccugcgacacuguuugugugguauuucuggcagaaaaagaagcagcggucuggcguccuuugggauacccccagcccgccugaaguggagcgcgccguucuggacgaugggaucuacagaauccugcagcggggacuccugggccgcucccaagugggggucggaguguuccaggacggcguuuuucauacaauguggcacgugaccagaggggcuguccuuauguaucagggaaaacggcuggaacccucuugggccagcgugaagaaagaccucauuuccuacggcggcggguggagauuccagggaagcuggaacacaggcgaggaggugcaaguuaucgccgucgaaccugggaagaaucccaaaaacgugcagacgaccccgggaacauuuaagaccccugagggcgaagugggggcuauugcccuggauuucaagcccggaaccucuggcuccccuaucgucaaucgcgagggcaaaauuguggggcucuacggaaacggcguugugacaacgagcgggaccuaugucucugcgaucgcucaggccaaggccucccaagaaggaccccugcccgagauugaggacgaaguguuuaaaaagcggaaucuuacaaucauggaucugcacccuggcagcgggaaaaccagacgcuaccugccggcuaucguucgggaggccauuaagagaaagcuccgcacacugauccuugcgcccacccggguggucgcuuccgaaauggccgaggcccugaaaggcaugccuauuagauaucagacgacagcugugaagucugaacauaccggacgcgagaucguugaccucaugugccacgccaccuucacaaugcggcugcugagccccgugagagucccuaacuacaauaugauuaucauggaugaggcucauuuuaccgaccccgccuccaucgcggcccggggcuauauuagcacacgcguggggaugggagaagcugccgcuaucuucaugaccgccacgccuccgggcucuguggaggccuuuccccaguccaacgcugucauucaggaugaagagagagacaucccugaacggagcuggaauucuggguacgauuggauuacagacuuccccggaaaaaccguuugguuugugccuagcaucaaguccggcaacgauaucgcgaauugucuccgcaaaaacgggaagagagugauucaacuuucucggaagacauucgacaccgaguaucagaaaacgaagaacaaugacugggauuacgucgugaccacagacaucagcgagaugggcgccaacuucagagcugaucgcguuauugacccccggagaugccugaaaccggugauccugaaggauggaccugaacgcgucauucucgccggccccaugcccgugaccguugccuccgcugcccagcggagagggcgcaucggacggaaucagaacaaagagggcgaccaauacguguauauggggcagccucugaauaacgaugaagaccacgcgcauuggacagaggcuaagaugcuucuggauaauauuaacacccccgagggaaucaucccugcccucuuugaaccggagagagaaaagucugccgcuauugacggcgaguaccgccugagaggggaagcccggaaaacauucgucgagcugaugcgcagaggcgaucuccccguguggcuuagcuauaaggucgcguccgagggauuucaguacagcgaccggcgcuggugcuucgauggcgaaagaaauaaccaggugcuggaggaaaauauggacguugagaucuggaccaaagaaggggagcggaagaaacugagaccucgcuggcucgacgcccggacguauucugauccccuggcucuuagagaguuuaaggaauucgccgcuggacgccgguccgugagcggcgaccugauucucgagaucgggaaacugccucaacaccugacacucagagcccagaacgcucuugauaaucuggugaugcugcacaacuccgaacagggaggcaaggccuaccggcaugcgauggaggaacuccccgacaccauugagacccugaugcuucuggcccucaucgcuguccugacaggcgggguuacccuguuuuuccucucuggaaagggccuugggaaaacaagcaucggacugcugugugugacggccuccucugcucuccuguggauggccagcguggagccgcacuggauugccgcuuccaucauucuugaauuuuuccugaugguccuccugaucccugagcccgaucgccagagaaccccucaagacaaucagcuggcguaugugguuauuggccuccuuuuuaugauccugacaguggccgcuaacgaaauggggcugcucgagaccacaaagaaagaucugggaaucggcuacgucgccgccgagaaccaucagcacgcuaccaugcuugacguggaucugcggcccgccagcgcguggacgcucuacgccgucgcuaccacagugauuaccccuaugaugcgccacacaaucgaaaauaccacggccaacauuucucugacagcuaucgccaaucaagcggccauucugaugggccucgacaagggguggcccaucuccaaaauggauauuggaguuccgcuucuggcucugggcugcuauagccaggugaacccucucacccugacagccgcuguccuuaugcugguggcccauuacgcuaucaucgggcccggacuccaggccaaggcgaccagagaggcccagaagcggaccgcugccggcauuaugaaaaaucccacaguugacgggaucguggcuauugaucuggacccugucguguaugacgccaaguucgaaaaacaacugggacagaucaugcuccuuauucuguguacgucucagauccugcucaugcgcaccacaugggcccugugcgaguccaucacccuugcgacaggcccgcugaccacgcucugggaaggcagccccgggaaguuuuggaacacaaccauugcugugucuauggccaauaucuucagaggaagcuaccuggcuggcgccgggcuggccuucucccucaugaaaucucuuggaggcgggcggcgcggaaccggcgcucagggcgagacacugggggagaaguggaagagacaacugaaccagcucagcaaauccgaauuuaauaccuauaagcggagcggaauuauggagguugauagauccgaagccaaagagggccugaagcgcggggaaacaacgaaacacgcggucucucggggaaccgccaagcuuagaugguucguggagcgcaaccuggugaagccugagggcaaagucaucgaccucggguguggacggggcggcuggagcuacuauugcgcugggcugaagaaaguuacagaagugaagggauacaccaaaggcgggcccggacaugaggaaccuauucccauggccacauacggcuggaaucuggugaagcuccacuccgggaaagaugucuuuuucaugccuccggagaagugugacacccuucugugcgauaucggagaaucuagccccaacccuacgaucgaggagggcagaacccugcgcgugcucaagaugguugaacccuggcugaaaggcaaucaguuuuguauuaagauccuuaacccuuauaugcccuccguggucgagacacuggaacagaugcaacggaaacaugggggaaugcucgugagaaauccgcugucucgcaacagcacccacgagauguacuggguuuccugcggcacagggaauauugugagcgcugucaacaugaccucucggaugcugcucaacagauucacaauggcccaccgcaagccuaccuaugagcgggacguggaucugggagcgggcacgagacauguggccgucgaacccgagguugcuaaucuugacaucauugggcagcgcaucgaaaacauuaaaaaugagcacaaguccacauggcauuacgaugaagacaaccccuauaagaccugggccuaccacggaagcuaugaggugaaaccuucuggcuccgcuagcucuauggugaauggcgucgugagacugcucaccaagcccugggauguuaucccuauggugacacagaucgccaugacggacaccacaccguuugggcaacagcgggucuucaaagagaagguggacacccgcacacccagagcuaaacggggaaccacacagauuauggaaguuaccgccaaguggcuguggggcuuucuuuccagaaacaagaaaccucggaucuguacgcgcgaggaauucaccagaaaggugcggagcaaugcggccauuggggcugucuuuguggaugagaaccaguggaauuccgccaaagaagcuguugaggacgagcgcuucugggaucuggugcacagagaacgggagcuccauaagcaaggaaaaugcgccacaugcgucuacaacaugaugggcaagcgcgaaaagaaacugggggaguuuggcaaggccaaaggaagcagagcgaucugguacauguggcugggcgcucgguuccucgaauucgaggcccugggguuuaugaaugaggaccacugguucucucgcgaaaacagccuuuccggaguggagggcgaagggcugcauaagcucggauauauucugagagauaucucuaaaauccccggcgggaauauguacgccgacgauaccgcuggcugggacacacggauuaccgaggaugaccuucagaacgaggccaagaucacggauauuauggaaccugagcacgcucugcucgccacaagcaucuuuaaacugaccuaucagaauaaggucgugcgcguucagagacccgcgaagaacggaacagugauggacgucauuucccggcgcgaucaaagaggcucugggcaggugggaaccuacggccugaacacguucaccaauauggaagugcagcucauccggcagauggagagcgaagggaucuuucuguccucugagcuugagacaccgaaccuggccgaaagaguucucgacuggcuggagaaacauggagcugaacgccuuaagcggauggccauuagcggcgacgauuguguggucaaaccuaucgacgauagauucgcuaccgcccugacagcgcucaaugacauggggaaggugcgcaaagauauuccccaaugggagccuuccaagggcuggaacgacuggcagcagguucccuuuugcagccaccacuuccaucagcugaucaugaaggauggacgggaaauuguggucccuuguagaaaucaagacgagcuggugggccgcgcccgggucucucagggggcuggauggucccucagagagaccgccugccugggcaaaagcuaugcucagauguggcaacuuauguacuuucaccgccgggaucugagacucgccgcuaacgccaucuguucugcggugcccguugacugggugccgacaucccgcaccacguggagcauccaugcccaccaccaguggaugacaaccgaagauaugcuguccgucuggaaucggguguggauugaggaaaacccuuggauggaggacaagacccauguuucuagcugggaagaggugcccuaucuugggaaaagagaggaccaguggugcggaucccugaucggccucacagcucgggccaccugggccacaaauauucaggucgcuaucaaccaagugagacgccugauugggaaugaaaacuaccuggauuacaugacgagcaugaagcgguucaaaaaugagucugaccccgaaggcgcccucugguga

SEQ ID NO: 18793 - RNA, 9879 nt, Artificial Sequence
  derived and/or modified CDS sequence (opt5) from DENV-1__FJ850100__SS-prME
agcgugaccaugcugcucaugcugcuucccacagcccuggcuuuccaccucacgaccagaggcggggaaccucauaugaucgucuccaagcaggaacggggaaagucucugcuuuuuaagacaagcgccggcguuaauaugugcacccugauugcgauggaccucggggaacugugugaagauacaaugaccuacaagugcccccgcaucacagaggcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggaaacagauucagcggguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaucgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccgcccuuuggcgaguccuauaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaucagguguucgggaccgccuacggaguucuuuuuagcggcguguccuggacgaugaagaucgggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuucgugaccaacgagguucacacauggaccgaacaauauaaguuucaggcugauagcccuaaacggcucuccgccgcgauuggcaaggccugggaggagggggugugcggcaucagaucugcuacgcgccuggaaaauauuauguggaaacagaucagcaacgagcuuaaucauauccugcucgaaaacgacaugaaguucacagucguggugggagacgccaauggcauucuggcucaggggaaaaagaugauccggccgcaacccauggagcacaaauacuccuggaagucuuggggaaaggccaaaauuaucggcgccgauauucagaacaccaccuuuaucaucgacgggccugauacacccgaauguccugacggacagagagcuuggaauauuugggaggucgaggauuauggcuucggcaucuuuaccacgaacauuuggcugaaacuucgcgacagcuacacacagaugugcgaucaccggcucauguccgcggccaucaaagacagcaaggcuguucaugccgauaugggguauuggauugaaucugagaaaaaugaaaccuggaagcuggccagagcuuccuucaucgaggugaagacauguaccuggcccaaaagccacacacuguggucuaacggagugcucgaauccgagaugaucauuccgaagaucuacggcgggccuauuagccaacauaauuaucgccccggauacuucacccagacggccggcccuuggcaccuggggaaacuugagcuggacuuugaucucugcgaaggaaccacagucgugguugacgagcacugcggcaaccggggccccucucugagaaccacaaccgugacggggaagaucauucaugaaugguguugccggagcuguacacugccuccccuucgcuucagaggagaggauggcugcugguacgggauggagauccggccggucaaagaaaaggaggaaaaucucgugagauccaugguuagcgcgggaucuggcgagguggacuccuuuagccuggggauccugugugucuccauuaugaucgaagaggugaugcgcucucgguggagcagaaagaugcucaugaccggaacacuggcuguuuuccuucugcucauuaugggccagcugaccuggaacgaccugauccgccuuugcauuauggugggcgccaaugccuccgauagaauggggaugggaaccacacaccuggcucucauggccacguuuaaaaugcggccuauguucgcggucggccugcucuuucgcagacugaccucucgggaggugcuucugcucacaaucgggcugagccugauggcuuccauggaacuucccaacucucuggaggaacucggagacggccuggccauggggauuaugaugcucaagcugcuuaccgaguuccaaccccaucagcuguggacaacccuccugagccugacguuugugaaaacaacccuuucccuggauuaugccuggaagaccacagcuaugauccucagcaucgucucucuguucccucucugucuguccaccacaagccagaaaacgaccuggcuuccgguucugcugggaucuuuuggcugcaagccccucacaauguuccugauuaccgaaaacaagaucuggggccgcaaauccuggccucuuaaugaggggauuauggccaucggaauugugagcauccugcucucuucccugcucaagaacgacgugccccuggcuggcccucuuaucgccgggggaaugcugauugcguguuacgucaucagcggcuccagcgccgaucugucucucgagaaagcugccgaagugagcugggagcaggaagcugagcacuccggggccucucauaauauucugguugaagugcaagacgauggaacaaugaagaucaaagacgaggagagagaugacacccuuacgauucugcucaaggccacccugcucgcugucagcggcguguaucccauguccaucccugcgacacuguuuguuugguacuucuggcagaaaaagaagcagcggucuggcgugcuuugggauacccccagcccgccugaagucgagcgcgccgugcuggacgaugggaucuaucgcauucugcagcggggacuccugggccgcucccaagucggggugggaguuuuccaggacggcguguuucacacaauguggcacgucaccagaggggcugugcuuauguaccagggaaaacggcuggaacccucuugggccagcguuaagaaagaccucaucuccuauggcggcggguggagauuccagggaagcuggaacacaggcgaggaggugcaagucauugccguggaaccugggaagaaucccaaaaacgugcagacgaccccgggaacauuuaagaccccugagggcgaaguuggggcuaucgcccuggauuucaagcccggaaccucuggcuccccuauugucaaucgcgagggcaaaaucguggggcucuacggaaacggcguggucacaacgagcgggaccuacgugucugcgauugcucaggccaaggccucccaagaaggaccccugcccgagaucgaggacgaaguuuuuaaaaagcggaaucuuacaaucauggaucugcauccuggcagcgggaaaaccagacgcuaucugccggcuauugugcgggaggccaucaagagaaagcuccgcacacugauucuugcgcccacccgggucguggcuuccgaaauggccgaggcccugaaaggcaugccuaucagauaccagacgacagcuguuaagucugaacacaccggacgcgagauuguggaccucaugugccaugccaccuucacaaugcggcugcugagccccgucagagugccuaacuauaauaugaucaucauggaugaggcucacuuuaccgaccccgccuccauugcggcccggggcuacaucagcacacgcguugggaugggagaagcugccgcuauuuucaugaccgccacgccuccgggcucuguggaggccuuuccccaguccaacgcugucauccaggaugaagagagagacauuccugaacggagcuggaacucuggguaugauuggaucacagacuuccccggaaaaaccgugugguuugugccuagcaucaaguccggcaacgauauugcgaauugucuccgcaaaaacgggaagagagucauccaacuuucucggaagacauucgacaccgaguaccagaaaacgaagaacaaugacugggauuauguugugaccacagacauuagcgagaugggcgccaacuucagagcugaucgcgugaucgacccccggagaugccugaaaccggucauucugaaggauggaccugaacgcgugauccucgccggccccaugcccguuaccguggccuccgcugcccagcggagagggcgcauuggacggaaucagaacaaagagggcgaccaauacgucuacauggggcagccucugaauaacgaugaagaccaugcgcacuggacagaggcuaagaugcuucuggauaauaucaacacccccgagggaaucauuccugcccucuuugaaccggagagagaaaagucugccgcuaucgacggcgaguaucgccugagaggggaagcccggaaaacauucguggagcugaugcgcagaggcgaucuccccguuuggcuuagcuacaagguggcguccgagggauuucaguauagcgaccggcgcuggugcuucgauggcgaaagaaauaaccagguccuggaggaaaauauggacguggagauuuggaccaaagaaggggagcggaagaaacugagaccucgcuggcucgacgcccggacguacucugauccccuggcucuuagagaguuuaaggaguucgccgcuggacgccgguccgucagcggcgaccugauccucgagauugggaaacugccucaacaccugacacucagagcccagaacgcucuugauaaucuggugaugcugcauaacuccgaacagggaggcaaggccuaucggcacgcgauggaggaacuccccgacaccaucgagacccugaugcuucuggcccucaucgcuguucugacaggcggggugacccuguuuuuccucucuggaaagggccuugggaaaacaagcauuggacugcugugugugacggccuccucuacccuccuguggauggcuagcgucgagccgcauuggaucgccgccuccauuauccuugaauuuuuccugaugguucuccugauuccugagcccgaucgccagagaacaccucaagacaaucagcuggcuuacguggugaucggccuccuuuuuaugauccugaccgucgcggccaacgaaauggggcugcucgagacaaccaagaaagaucugggaauuggcuauguggcugccgagaaccaccagcacgccacgaugcuugacguugaucugcggcccgcuagcgccuggacccucuacgcgguggccacaaccgucaucacaccuaugaugcgccauaccauugaaaauacgacagcuaacaucucucugaccgccauugcuaaucaagccgcgauccugaugggccucgacaagggguggcccauuuccaaaauggauaucggagugccgcuucuggcccugggcugcuacagccaggucaacccucucacacugaccgcugccgugcuuaugcugguugcucacuaugccaucauugggcccggacuccaggcuaaggccaccagagaggcgcagaagcggacagccgcuggcaucaugaaaaaucccacgguggacgggauugucgccaucgaucuggacccugugguuuacgacgcuaaguucgaaaaacaacugggacagauuaugcuccuuauccuguguaccucucagauccugcucaugcgcacaaccugggcccugugcgaguccauuacacuugccaccggcccgcugacgacacucugggaaggcagccccgggaaguuuuggaacaccaccaucgcggugucuauggcuaauauuuucagaggaagcuaucuggccggcgcugggcuggccuucucccucaugaaaucucuuggaggcgggcggcgcggaacaggcgcccagggcgagacccugggggagaaguggaagagacaacugaaccagcucagcaaauccgaauuuaauacauacaagcggagcggaaucauggaggucgauagauccgaagcuaaagagggccugaagcgcggggaaacgaccaaacaugccgugucucggggaacagcgaaacuuagaugguucguggagcgcaaccugguuaagccugagggcaaagucauugaccucggguguggacggggcggcuggagcuauuacugcgccgggcugaagaaagugaccgaagugaagggauauacaaaaggcgggcccggacacgaggaaccuauccccauggcuaccuacggcuggaaucuggucaagcuccauuccgggaaagauguguuuuucaugccuccggagaagugugacacgcuucugugcgauaucggagaaucuagccccaacccuaccauugaggagggcagaacacugcgcguucucaagaugguggaacccuggcugaaaggcaaucaguuuuguaucaagauucuuaacccuuacaugcccuccgucguggagacccuggaacagaugcaacggaaacacgggggaaugcucguuagaaauccgcugucucgcaacagcacacacgagauguauuggguguccugcggcaccgggaauaucgucagcgccgugaacaugacaucucggaugcugcucaacagauucaccauggcucaucgcaagccuacguacgagcgggacguugaucugggagccggcacaagacacguggcggucgaacccgagguggccaaucuugacauuaucgggcagcgcauugaaaacaucaaaaaugagcauaaguccaccuggcacuaugaugaagacaaccccuacaagaccugggcuuaucacggaagcuacgaggugaaaccuucuggcuccgccagcucuauggucaauggcguugugagacugcucacaaagcccugggaugugaucccuauggucacgcagauugcuaugaccgacacaaccccguuugggcaacagcggguguucaaagagaagguugacacacgcacccccagagccaaacggggaacaacccagaucauggaagugacggcuaaguggcuguggggcuuucuuuccagaaacaagaaaccucggauuuguacccgcgaggaguucacaagaaagguccggagcaaugccgcgaucggggccguguuuguugaugagaaccaguggaacuccgcuaaagaagccguggaggacgagcgcuucugggaucugguccauagagaacgggagcuccacaagcaaggaaaaugcgcuaccugcguguauaacaugaugggcaagcgcgaaaagaaacugggggaguuuggcaaggccaaaggaagcagagccauuugguacauguggcugggcgcgcgguuccucgaguucgaggcucugggguuuaugaaugaggaccauugguucucucgcgaaaacagccuuuccggaguugagggcgaagggcugcacaagcucggauacauccugagagauaucucuaaaauucccggcgggaauauguaugccgacgauacagccggcugggacacccggaucacggaggaugaccuucagaacgaggcuaagauuacagauaucauggaaccugagcaugcccugcucgcuaccagcauuuuuaaacugacauaccagaauaaggugguccgcgugcagagacccgccaagaacggaaccgucauggacgugaucucccggcgcgaucaaagaggcucugggcagguuggaacguauggccugaacaccuucacaaauauggaagugcagcucauccggcagauggagagcgaagggauuuuucugccguccgagcuugagaccccuaaccuggcggaaagaguccucgacuggcuggagaaacacggagccgaacgccuuaagcggauggcuaucucuggcgacgauuguguggugaaacccauugacgauagauucgccacagcucugaccgcccucaaugacauggggaagguucgcaaagauaucccucaaugggagcccagcaagggcuggaacgacuggcaacaggugccuuuuugcucccaccauuuccaccagcugauuaugaaggauggacgggaaaucgucgugcccuguagaaaucaagacgagcugguuggccgcgcgcgggugagccagggggccggauggucucucagagagacagcuugccugggcaaauccuacgcccagauguggcaacuuauguauuuucaucgccgggaucugagacucgcugccaacgcuaucuguagcgccgucccgguggacugggucccuaccucucgcacgacaugguccauucacgcgcaccaucaguggaugaccaccgaagauaugcugagcguguggaaucggguuuggaucgaggaaaaccccuggauggaggacaagacacacguguccucuugggaagagguccccuaccuugggaaaagagaggaccaguggugcggaagccugauuggccucaccgcccgggcuacaugggccacgaauauccagguggccauuaaccaaguuagacgccugaucgggaaugaaaacuaucuggauuacaugaccuccaugaagcgguucaaaaaugagagcgacccugaaggcgcucucugguga

SEQ ID NO: 18794 - RNA, 9879 nt, Artificial Sequence
  derived and/or modified CDS sequence (opt5) from DENV-1__FJ882579__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggauuucguugagggacuguccggcgccacauggguggacgucgugcucgagcacgggagcugugugacgaccauggcuaagaauaaacccacacuggauaucgaacugcucaagaccgaggucacaaacccugccguucugcgcaaacuuugcauugaagcgaagaucucuaauaccacgacagacuccagauguccgacccaaggagaggccacccugguggaagagcaggaugcuaacuuugugugccggcgcacauucgucgacagaggcuggggcaauggguguggacucuuuggcaaagggagccugcuuaccugcgccaaguucaagugcgugacaaaacuggagggaaagauuguucaguacgaaaaccucaaauauucugugaucgucacggugcacaccggcgaucagcaucaaguugggaaugagacaaccgaacacggaacaaucgcuaccauuacgccccaggccccuaccuccgagauccagcugacagacuacggcgcccugacccucgacuguagcccccggacaggccuggauuuuaacgaaauggugcuucugaccaugaaggagaaaucuuggcucguccauaagcagugguuccuggaccuuccucugcccuggacguccggggcuagcacaucccaagagaccuggaaucgccaggaucuccuggugacauuuaaaaccgcgcacgccaagaagcaggaagucgugguucugggaucucaagagggcgcuaugcacaccgcccucacaggggccacggaaauucagaccagcggaacaaccacaaucuucgcuggccaucugaaaugcagacuuaagauggacaaacugacccucaaggggauguccuaugugauguguacgggcagcuucaaacuggagaaggaagucgccgagacacagcacggaaccgugcugguucaggugaaguacgagggcaccgaugcgccgugcaaaauuccuuuuucuacacaagacgaaaagggggucacccagaacggacggcuuaucacagcuaaucccaucgugacggauaaagagaagccugugaacauugaaaccgagccccccuucggcgaguccuauaucguugucggggccggagaaaaagcccucaagcugagcugguuuaagaaaggcucuagcauugggaagauguucgaggcuacagccagaggcgcucgccggauggccauccugggagacaccgcgugggauuuuggcuccauugggggaguguucacaucugugggcaaacucguccaucagguguuugggaccgccuacggaguucuguucagcggcguguccuggacgaugaagaucgggaucggcauucuucugaccuggcucggacugaauagcagaucuacaucccugagcaugaccuguaucgcugucggcauggugacacuuuaccucgggguuauggugcaggccgacucuggaugcgucauuaacuggaaaggccgcgaacugaaguguggguccggaaucuuugugaccaacgagguucacacauggaccgaacaauauaaguuccaggcugauagcccuaaacggcuguccgccgcgauuggcaaggccugggaggagggggugugcggcaucagaucugcuacgcgccucgaaaauauuauguggaaacagaucagcaacgagcugaaucauauccuucuggaaaacgacaugaaguuuacagucguggugggagacgccaauggcauucucacccaggggaaaaagaugauccggccgcaacccauggagcacaaauacuccuggaagucuuggggaaaggcuaaaauuaucggcgccgauauucagaacaccacauucaucaucgacgggccugauacccccgaauguccugacggacagagagccuggaauauuugggaggucgaggauuauggcuuuggcaucuucacgacaaacauuuggcugaagcugcgcgacagcuacacccagaugugcgaucaccggcuuauguccgcugcgaucaaagacagcaaggccguucaugcugauaugggguauuggauugaaucugagaaaaaugaaacauggaagcucgccagagccuccuucaucgaggugaagaccuguacauggcccaaaagccacacccuguggucuaacggagugcuggaauccgagaugaucauuccgaagaucuacggcgggccuauuagccaacauaauuaucgccccggauacuuuacgcagaccgcuggcccuuggcaccucgggaaacuggagcuugacuucgaucugugcgaaggaacaaccgucgugguugacgagcacugcggcaaccggggccccucucucagaacaaccacggugacagggaagaucauucaugaaugguguugccggagcuguacccugccuccccugcgcuuuagaggagaggauggcugcugguacgggauggagauccggccggucaaagaaaaggaggaaaaucuugugagauccaugguuagcgccggaucuggcgagguggacuccuucagccucgggauccugugugucuccauuaugaucgaagaggugaugcgcucucgguggagcagaaagaugcugaugacaggaacccucgcgguuuuucugcuucugauuaugggccagcucaccuggaacgaccugauccgccugugcauuauggugggcgcuaaugccuccgauagaauggggaugggaacaacguaucuugcccugauggcuaccuucaaaaugcggccuauguuugccgucggccuccuguuccgcagacucacaucucgggaggugcugcuucugaccaucgggcucagccugguggcguccgucgaacugcccaacucucuugaggaacugggagacggccucgcuauggggauuaugaugcugaagcuccugacagaguuucaaccccaccagcuuuggaccacgcugcucagccugacauucguuaaaaccacccugucccuugauuacgccuggaagacaaccgccauggugcugagcaucgugucucucuuuccucugugucucuccacaacgagccagaaaaccacauggcugccgguccuucugggaucuuucggcugcaagccccugaccauguuucucaucacagaaaacaagauuuggggccgcaaauccuggccucugaaugaggggaucauggcuauuggaaucgugagcauucuucugucuucccuccugaagaacgacguuccccucgccggcccucugaucgcugggggaaugcuuaucgccuguuaugugauuagcggcuccagcgcggaucugcugcucgagaaagccgcugaagucucuugggagcaggaagccgagcauagcggggcuucccacaauauccugguggaaguucaagacgauggaaccaugaagauuaaagacgaggagagagaugacacgcuuaccauccugcucaaggccacacugcucgccgugucuggcgucuaccccaugagcauuccugcuacccuguucgugugguauuucuggcagaaaaagaagcagcgguccggcguccuuugggauacacccucuccgccugaaguggagcgcgcgguucuggacgaugggaucuacagaauccugcagcggggacuccugggccgcagccaagugggggucggaguguuucaggacggcguuuuccauaccauguggcacgugacaagaggggccguccuuauguaucagggaaaacggcuggaacccuccugggcuucugugaagaaagaccucauuagcuacggcggcggguggagauuucagggauccuggaacacgggcgaggaggugcaaguuaucgccgucgaaccugggaagaaucccaaaaacgugcagaccacaccgggaaccuucaagaccccugagggcgaagugggggccauugcucuggauuuuaagcccggaacaagcggcucuccuaucgucaaucgcgagggcaaaauuguggggcucuacggaaacggcguugugacgaccuccgggacauaugucagcgccaucgcgcaggcuaaggccucucaagaaggaccccugcccgagauugaggacgaaguguucaaaaagcggaaucuuaccaucauggaucugcacccuggcuccgggaaaacaagacgcuaccugccggccaucguucgggaggcuauuaagagaaagcuccgcacccugauccuugcccccacgcggguggucgcgagcgaaauggcugaggcccugaaaggcaugccuauuagauaucagacaaccgccgugaaguccgaacauaccggacgcgagaucguugaccucaugugccacgcuacauuuaccaugcggcugcugucucccgugagagucccuaacuacaauaugauuaucauggaugaggcccauuucacagaccccgcuagcaucgccgcgcggggcuauauuuccacccgcguggggaugggagaagccgcugccaucuuuaugacggcuacaccuccgggcagcguggaggccuucccccagucuaacgccgucauucaggaugaagagagagacaucccugaacgguccuggaauagcggguacgauuggauuaccgacuuucccggaaaaacaguuugguucgugccuucuaucaagagcggcaacgauaucgcuaauugucuccgcaaaaacgggaagagagugauucaacuuucccggaagaccuucgacacggaguaucagaaaaccaagaacaaugacugggauuacgucgugacaaccgacaucucugagaugggcgcgaacuuuagagccgaucgcguuauugacccccggagaugccugaaaccggugauccugaaggauggaccugaacgcgucauucucgcuggccccaugcccgugacaguugccagcgccgcucagcggagagggcgcaucggacggaaucagaacaaagagggcgaccaauacguguauauggggcagccucugaauaacgaugaagaccacgcccauuggaccgaggcgaagaugcuucuggauaauauuaacacacccgagggaaucaucccugcucucuucgaaccggagagagaaaaguccgccgccauugacggcgaguaccgccugagaggggaagcucggaaaaccuuugucgagcugaugcgcagaggcgaucuccccguguggcuuucuuauaaggucgccagcgagggauuccaguacuccgaccggcgcuggugcuuugauggcgaaagaaauaaccaggugcuggaggaaaauauggacguugagaucuggacgaaagaaggggagcggaagaaacugagaccucgcuggcucgacgcgcggacauauagcgauccccuggcccuuagagaguucaaggaauuugcugccggacgccggucuguguccggcgaccugauucucgagaucgggaaacugccucaacaccugacccucagagcucagaacgcccuugauaaucuggugaugcugcacaacagcgaacagggaggcaaggcuuaccggcaugccauggaggaacuccccgacaccauugagacacugaugcuucuggcgcucaucgccguccugaccggcgggguuacacuguucuuucucuccggaaagggccuugggaaaacgucuaucggacugcugugugugaccgcuagcuccgcccuccuguggauggcuucuguggagccgcacuggauugccgccagcaucauucuugaauucuuucugaugguccuccugaucccugagcccgaucgccagagaacaccucaagacaaucagcuggcuuaugugguuauuggccuccuuuucaugauccugaccguggcggccaacgaaauggggcugcucgagacaaccaagaaagaucugggaaucggcuacgucgcugccgagaaccaucagcacgccacgaugcuugacguggaucugcggcccgcuuccgccuggacccucuacgcggucgccacaaccgugauuacaccuaugaugcgccacaccaucgaaaauacgacagcuaacauuagccugaccgccaucgcuaaucaagccgcgauucugaugggccucgacaagggguggcccaucucuaaaauggauauuggaguuccgcuucuggcccugggcugcuauucccaggugaacccucucacacugaccgcugccguccuuaugcugguggcucauuacgccaucaucgggcccggacuccaggcuaaggccaccagagaggcgcagaagcggacagccgcuggcauuaugaaaaaucccacgguugacgggaucguggccauugaucuggacccugucguguaugacgcuaaguuugaaaaacaacugggacagaucaugcuccuuauucuguguaccagccagauccugcucaugcgcacaaccugggcccugugcgagucuaucacacuugccaccggcccgcugacgacacucugggaaggcucccccgggaaguucuggaacaccaccauugcggugagcauggcuaauaucuucagaggaucuuaccuggccggcgcugggcuggccuuuagccucaugaaaucccuuggaggcgggcggcgcggaacaggcgcccagggcgagacccugggggagaaguggaagagacaacugaaccagcucucuaaaagcgaauucaauacauauaagcgguccggaauuauggagguugauagaagcgaagcuaaagagggccugaagcgcggggaaacgaccaaacacgccgucucccggggaacagcgaagcuuagaugguuuguggagcgcaaccuggugaagccugagggcaaagucaucgaccucggguguggacggggcggcuggucuuacuauugcgccgggcugaagaaaguuaccgaagugaagggauacacaaaaggcgggcccggacaugaggaaccuauucccauggcuaccuacggcuggaaucuggugaagcuccacagcgggaaagaugucuucuuuaugccuccggagaagugugacacgcuucugugcgauaucggagaauccucucccaacccuaccaucgaggagggcagaacacugcgcgugcucaagaugguugaacccuggcugaaaggcaaucaguucuguauuaagauccuuaacccuuauaugcccagcguggucgagacccuggaacagaugcaacggaaacaugggggaaugcucgugagaaauccgcugucccgcaacucuacacacgagauguacuggguuagcugcggcaccgggaauauuguguccgccgucaacaugacaagccggaugcugcucaacagauuuaccauggcucaccgcaagccuacguaugagcgggacguggaucugggagccggcacaagacauguggcggucgaacccgagguugccaaucuugacaucauugggcagcgcaucgaaaacauuaaaaaugagcacaagucuaccuggcauuacgaugaagacaaccccuauaagaccugggcuuaccacggauccuaugaggugaaaccuagcggcucugccuccagcauggugaauggcgucgugagacugcucacaaagcccugggauguuaucccuauggugacgcagaucgcuaugaccgacacaaccccguucgggcaacagcgggucuuuaaagagaagguggacacacgcacccccagagccaaacggggaacaacccagauuauggaaguuacggcuaaguggcuguggggcuuccuuucuagaaacaagaaaccucggaucuguacccgcgaggaauuuacaagaaaggugcgguccaaugccgcgauuggggccgucuucguggaugagaaccaguggaauagcgcuaaagaagccguugaggacgagcgcuuuugggaucuggugcacagagaacgggagcuccauaagcaaggaaaaugcgcuaccugcgucuacaacaugaugggcaagcgcgaaaagaaacugggggaguucggcaaggccaaaggauccagagccaucugguacauguggcugggcgcgcgguuccucgaauuugaggcucugggguucaugaaugaggaccacugguuuagccgcgaaaacucucuuagcggaguggagggcgaagggcugcauaagcucggauauauucugagagauaucuccaaaauccccggcgggaauauguacgccgacgauacagccggcugggacacccggauuacggaggaugaccuucagaacgaggcuaagaucacagauauuauggaaccugagcacgcccugcucgcuaccucuaucuucaaacugacauaucagaauaaggucgugcgcguucagagacccgccaagaacggaaccgugauggacgucauuagccggcgcgaucaaagaggcuccgggcaggugggaacguacggccugaacaccuuuacaaauauggaagugcagcucauccggcagauggagucugaagggaucuuccugccgagcgagcuugagaccccuaaccuggcggaaagaguucucgacuggcuggagaaacauggagccgaacgccuuaagcggauggcuauuuccggcgacgauuguguggucaaacccaucgacgauagauuugccacagcucugaccgcccucaaugacauggggaaggugcgcaaagauauuccucaaugggagcccucuaagggcuggaacgacuggcagcagguuccuuucugcagccaccacuuucaucagcugaucaugaaggauggacgggaaauugugguccccuguagaaaucaagacgagcuggugggccgcgcgcgggucucccagggggccggauggagccucagagagacagcuugccugggcaaaucuuaugcccagauguggcaacuuauguacuuccaccgccgggaucugagacucgcugccaacgcuaucuguuccgccgugccgguugacugggugccuaccagccgcacgacauggucuauccaugcgcaccaccaguggaugaccaccgaagauaugcuguccgucuggaaucggguguggauugaggaaaaccccuggauggaggacaagacacauguuagcuccugggaagaggugcccuaucuugggaaaagagaggaccaguggugcggaucucugaucggccucaccgcccgggcuacaugggccacgaauauucaggucgccaucaaccaagugagacgccugauugggaaugaaaacuaccuggauuacaugaccagcaugaagcgguuuaaaaaugaguccgacccugaaggcgcucucugguga

SEQ ID NO: 18795 - RNA, 9879 nt, Artificial Sequence
  derived and/or modified CDS sequence (opt5) from DENV-1__JN819414__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcguacgccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcaugggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagauuguucaguaugaaaaccugaaauacucugugaucgucacggugcacaccggcgaucagcaccaaguugggaaugagacaaccgaacauggaacaaucgcuaccauuacgccccaggccccuaccuccgagauccagcugacagacuauggcgcccucacccuggacuguagcccccggacaggccuugauuucaacgaaauggugcugcucaccaugaaggagaaaucuuggcugguccacaagcagugguuucuugaccugccucuccccuggacguccggggcuagcacaucccaagagaccuggaaucgccaggaucugcuggugacauucaaaaccgcgcaugccaagaagcaggaagucgugguucucggaucucaagagggcgcuaugcacaccgcccugacaggggccacggaaauucagaccagcggaacaaccacaaucuuugcuggccaccuuaaaugcagacugaagauggacaaacucacccugaaggggauguccuacgugauguguacgggcagcuucaaacuggagaaggaagucgccgagacacagcauggaaccgugcuuguucaggugaaguaugagggcaccgaugcgccgugcaaaauuccuuucucuacacaagacgaaaagggggucacccagaacggacggcucaucacagcuaaucccaucgugacggauaaagagaagccugugaacauugaaaccgagccccccuuuggcgaguccuacaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaccagguguucgggaccgccuacggaguucuuuuuagcggcguguccuggacgaugaagaucgggaucggcauucugcucaccuggcugggacugaauagcagaucuacaucccuuagcaugaccuguaucgcugucggcauggugacacucuaucuggggguuauggugcaggccgacucuggaugcgucauuaacuggaaaggccgcgaacugaaguguggguccggaaucuucgugaccaacgagguucauacauggaccgaacaauacaaguuucaggcugauagcccuaaacggcucuccgccgcgauuggcaaggccugggaggagggggugugcggcaucagaucugcuacgcgccuggaaaauauuauguggaaacagaucagcaacgagcuuaaucacauccugcucgaaaacgacaugaaguucacagucguggugggagacgccaauggcauucuggcucaggggaaaaagaugauccggccgcaacccauggagcauaaauauuccuggaagucuuggggaaaggccaaaauuaucggcgccgauauucagaacaccaccuuuaucaucgacgggccugauacacccgaauguccugacggacagagagcuuggaauauuugggaggucgaggauuacggcuucggcaucuuuaccacgaacauuuggcugaagcuucgcgacagcuauacacagaugugcgaucaccggcucauguccgcggccaucaaagacagcaaggcuguucacgccgauaugggguacuggauugaaucugagaaaaaugaaaccuggaagcuggccagagcuuccuucaucgaggugaagacauguaccuggcccaaaagccauacacuguggucuaacggagugcucgaauccgagaugaucauuccgaagaucuauggcgggccuauuagccaacacaauuaccgccccggauacuucacccagacggccggcccuuggcaucuggggaaacuugagcuggacuuugaucucugcgaaggaaccacagucgugguugacgagcacugcggcaaccggggccccucucugagaaccacaaccgugacggggaagaucauucacgaaugguguugccggagcuguacacugccuccccuucgcuucagaggagaggauggcugcugguaugggauggagauccggccggucaaagaaaaggaggaaaaucucgugagauccaugguuagcgcgggaucuggcgagguggacuccuuuagccuggggauccugugugucuccauuaugaucgaagaggugaugcgcucucgguggagcagaaagaugcucaugaccggaacacuggcuguuuuccuucugcucauuaugggccagcugaccuggaacgaccugauccgccuuugcauuauggugggcgccaaugccuccgauagaauggggaugggaaccacauaccuggcucucauggccacguuuaaaaugcggccuauguucgcggucggccugcucuuucgcagacugaccucucgggaggugcuucugcucacaaucgggcugagccugguggcuuccgucgaacuucccaacucucuggaggaacucggagacggccuggccauggggauuaugaugcucaagcugcuuaccgaguuccaaccccaucagcuguggacaacccuccugagccugacguuuguuaaaacaacccuuucccuggauuaugccuggaagaccacagcuauggugcucagcaucgugucucuguucccucucugucuguccaccacaagccagaaaacgaccuggcuuccgguccugcugggaucuuuuggcugcaagccccucacaauguuccugaucaccgaaaacaagauuuggggccgcaaauccuggccucuuaaugaggggaucauggccauuggaaucgugagcauucugcucucuucccugcucaagaacgacguuccccuggcuggcccucuuaucgccgggggaaugcugaucgcguguuacgugauuagcggcuccagcgccgaucugcuccuggagaaagcugccgaagucucuugggagcaggaagcugagcacagcggggccucccauaauauccuuguggaaguucaagacgauggaacaaugaagauuaaagacgaggagagagaugacacccugacgauccuccugaaggccacccuccuggcugugucuggcgucuaucccaugagcauuccugcgacacuuuuugugugguacuucuggcagaaaaagaagcagcgguccggcguccugugggauacccccucuccgccugaaguggagcgcgccguucuggacgaugggaucuauagaauccuccagcggggacugcuuggccgcagccaagugggggucggaguguuccaggacggcguuuuucacacaauguggcaugugaccagaggggcuguccugauguaccagggaaaacggcucgaacccuccugggccucugugaagaaagaccugauuagcuacggcggcggguggagauuccagggauccuggaacacaggcgaggaggugcaaguuaucgccgucgaaccugggaagaaucccaaaaacgugcagacgaccccgggaacauuuaagaccccugagggcgaagugggggcuauugcccucgauuucaagcccggaaccagcggcucuccuaucgucaaucgcgagggcaaaauuguggggcuguauggaaacggcguugugacaacggggggaaccuacgucuccgcgaucgcucaggccaaggccagccaagaaggcccccuucccgagauugaggacgaaguguuuaaaaagcggaaucugacaaucauggaucugcacccugggucuggcaaaaccagacgcuaucucccggcuaucguucgggaggccauuaagagaaagcugcgcacacuuauccuggcgcccacccggguggucgcuuccgaaauggccgaggcccucaaaggaaugccuauuagauaccagacgacagcugugaagagcgaacacaccggccgcgagaucguugaccugaugugccaugccaccuucacaaugcggcugcucucccccgugagagucccuaacuauaauaugauuaucauggaugaggcucacuuuaccgaccccgccucuaucgcggcccggggguacauuagcacacgcgugggaaugggcgaagcugccgcuaucuucaugaccgccacgccuccgggguccguggaggccuuuccccagagcaacgcugucauucaggaugaagagagagacaucccugaacggucuuggaauuccggauaugauuggauuacagacuuccccggcaaaaccguuugguuugugccuagcaucaagucugggaacgauaucgcgaauugucuucgcaaaaacggcaagagagugauucaacugagccggaagacauucgacaccgaguaccagaaaacgaagaacaaugacugggauuacgucgugaccacagacaucuccgagaugggagccaacuucagagcugaucgcguuauugacccccggagaugccugaaaccggugauccucaaggauggcccugaacgcgucauucuggccgggcccaugcccgugaccguugccucugcugcccagcggagaggacgcaucggccggaaucagaacaaagagggggaccaauauguguacaugggacagccucuuaauaacgaugaagaccaugcgcacuggacagaggcuaagaugcugcucgauaauauuaacacccccgagggcaucaucccugcccuguuugaaccggagagagaaaagagcgccgcuauugacggggaguaucgccugagaggcgaagcccggaaaacauucgucgagcucaugcgcagaggagaucuucccguguggcuguccuacaaggucgcgucugagggcuuucaguauagcgaccggcgcuggugcuucgauggggaaagaaauaaccaggugcuggaggaaaauauggacguugagaucuggaccaaagaaggagagcggaagaaacucagaccucgcuggcuggacgcccggacguacuccgauccccuugcucugagagaguuuaaggaauucgccgcuggccgccggagcgugucuggggaccucauucuggagaucggaaaacugccucaacaucucacacuuagagcccagaacgcucuggauaaucuggugaugcuccacaacuccgaacagggcggcaaggccuaucggcacgcgauggaggaacugcccgacaccauugagacccuuaugcugcucgcccugaucgcuguccugacagggggaguuacccucuuuuuccuuagcggcaaggggcugggaaaaacauccaucggccugcucugugugacggccucuagcgcucugcuuuggauggccuccguggagccgcauuggauugccgcuucuaucauucuggaauuuuuccucaugguccugcugaucccugagcccgaucgccagagaaccccucaagacaaucagcucgcguacgugguuauugggcuucuguuuaugauccugacaguggccgcuaacgaaaugggacuccuggagaccacaaagaaagaucuuggcaucggcuacgucgccgccgagaaccaccagcaugcuaccaugcuggacguggaucuccggcccgccagcgcguggacgcuguaugccgucgcuaccacagugauuaccccuaugaugcgccacacaaucgaaaauaccacggccaacauuucccugacagcuaucgccaaucaagcggccauucucauggggcuugacaagggauggcccaucagcaaaauggauauuggcguuccgcugcuggcucucgggugcuacucucaggugaacccucugacccuuacagccgcuguccugaugcucguggcccacuaugcuaucaucggacccggccugcaggccaaggcgaccagagaggcccagaagcggaccgcugccgggauuaugaaaaaucccacaguugacggaaucguggcuauugaucuggacccugucguguacgacgccaaguucgaaaaacaacucggccagaucaugcuucugauucuguguacgucccagauccuccugaugcgcaccacaugggcccuuugcgagagcaucacccuggcgacaggcccgcucaccacgcugugggaagggucucccggaaaguuuuggaacacaaccauugcuguguccauggccaauaucuucagaggcagcuaucuggcuggggccggacucgccuucucucuuaugaaaagccugggcgggggacggcgcggcaccggcgcucagggggagacacugggagagaaguggaagagacaacucaaccagcuguccaaaucugaauuuaauaccuacaagcggagcggcauuauggagguugauagauccgaagccaaagaggggcuuaagcgcggagaaacaacgaaacaugcggucagccggggcaccgccaagcugagaugguucguggagcgcaaccucgugaagccugaggggaaagucaucgaccugggauguggccggggcgggugguccuauuacugcgcuggacugaagaaaguuacagaagugaagggcuacaccaaagggggacccggccacgaggaaccuauucccauggccacauauggguggaaucucgugaagcuucauucuggaaaagaugucuuuuucaugccuccggagaagugugacacccugcugugcgauaucggcgaaagcucccccaacccuacgaucgaggagggcagaacccuccgcgugcugaagaugguugaacccuggcuuaaagggaaucaguuuuguauuaagauccugaacccuuacaugcccucuguggucgagacacucgaacagaugcaacggaaacacggaggcaugcuggugagaaauccgcugagccgcaacuccacccaugagauguauuggguuucuugcgggacaggaaauauugugagcgcugucaacaugaccucccggaugcuccugaacagauucacaauggcccaccgcaagccuaccuacgagcgggacguggaucuuggcgcggggacgagacacguggccgucgaacccgagguugcuaaucuggacaucauuggacagcgcaucgaaaacauuaaaaaugagcauaagagcacauggcacuaugaugaagacaaccccuacaagaccugggccuaucauggcucuuacgaggugaaaccuuccggcagcgcuucuuccauggugaauggggucgugagacuccugaccaagcccugggauguuaucccuauggugacacagaucgccaugacggacaccacaccguuuggacaacagcgggucuucaaagagaagguggacacccgcacacccagagcuaaacggggcaccacacagauuauggaaguuaccgccaaguggcuuuggggguuucugagcagaaacaagaaaccucggaucuguacgcgcgaggaauucaccagaaaggugcggucuaaugcggccauuggagcugucuuuguggaugagaaccaguggaauacagccaaagaagcuguugaggacgagcgcuucugggaucucgugcacagagaacgggagcugcacaagcaaggcaaaugcgccaccugcgucuacaacaugauggggaagcgcgaaaagaaacugggcgaguuuggaaaggccaaaggcuccagagcgaucugguauauguggcucggggcucgguuccuggaauucgaggcccuuggauuuaugaaugaggaccauugguucagccgcgaaaacucccugagcggcguggagggggaaggacuccacaagcugggcuacauucuuagagauaucucuaaaauccccgggggcaauauguaugccgacgauacagcuggaugggacacccggauuacggaggaugaccugcagaacgaggccaagaucacagauauuauggaaccugagcaugcucuccuggccaccagcaucuuuaaacugacauaccagaauaaggucgugcgcguucagagacccgcgaagaacggcaccgugauggacgucauuucccggcgcgaucaaagagggucuggacaggugggcacguaugggcucaacaccuucacaaauauggaagugcagcugauccggcagauggagagcgaaggaaucuuucuuccguccgagcuggagaccccuaaccucgccgaaagagcucuggacuggcuugagaaacacggcgccgaacgccugaagcggauggcuauuucuggggacgauuguguugugaaacccaucgacgauagauucgccacagcgcucaccgcccugaaugacaugggcaagguccgcaaagauauuccucaaugggagcccagcaagggauggaacgacuggcagcaggugccuuuuugcucccaucacuuccaccagcugaucaugaaggauggccgggaaauuguugugcccuguagaaaucaagacgagcucgucgggcgcgcucgggugucucagggagccggcuggagccugagagagacagcuugccuugggaaauccuacgcccagauguggcaacugauguauuuucaucgccgggaucucagacuggcugccaacgcgaucuguagcgccgucccgguggacuggguuccuaccucucgcacgacaugguccauccacgcucaucaccaguggaugaccaccgaagauaugcuuagcguguggaaucgggucuggauugaggaaaaccccuggauggaggacaagacacacgugucuuccugggaagagguucccuaccugggaaaaagagaggaccaguggugcggcagccucaucgggcugaccgcccgggccacaugggcuacgaauauucagguggccaucaaccaagucagacgccugauuggcaaugaaaacuaccucgauuauaugaccuccaugaagcgguucaaaaaugagucugacccugaaggagcgcugugguga

SEQ ID NO: 18796 - RNA, 9879 nt, Artificial Sequence
  derived and/or modified CDS sequence (opt5) from DENV-1__FJ873810__SS-prME
agcgugacaaugcugcucaugcugcuucccacagcccuggcuuuccaccucacgacccggggcggggagccucauaugaucgucuccaagcaggaacggggaaaaucucugcuuuuuaagacaagcguuggcgugaauaugugcacccugauugccauggaccucggggagcugugugaagauacaaugaccuacaaaugccccagaaucacagaggcggaacccgacgauguggacuguuggugcaaugcuaccgauacgugggucaccuauggaacauguucccagaccggcgagcaccggcgggagaagcgcucuguggcccuggccccucauguugggcucggacuggaaacaagaaccgagacguggaugagcuccgaaggcgcuuggaaacagauucagcggguggagacaugggcccuucgccaccccggcuucaccgucaucgccuuuuuccuggcccaugcgauugggacaucuaucacccagaagggaaucauuuuuauccuccugaugcuugugaccccuagcauggccaugagaugcguuggcauugggaaucgggacuucguggagggacuguccggcgcuacaugggucgauguggugcucgaacacgggagcugugucacgaccauggccaagaauaaacccacacuggacaucgagcugcucaagaccgaaguuacaaacccugcugugcugcgcaaacuuugcauugaggccaagaucucuaauaccacgacagauuccagauguccgacccaaggagaagcgacccugguggaggagcaggacgccaacuuugucugccggcgcacauucguggauagaggcuggggcaauggguguggacucuuuggcaaagggagccugcuuaccugcgcuaaguucaagugcguuacaaaacuggaaggaaagauugugcaguacgagaaccucaaauauucugucaucgugacgguucacaccggcgaccagcaucaaguggggaaugaaacaaccgagcacggaacaaucgccaccauuacgccccaggcuccuaccuccgaaauccagcugacagauuacggcgcccugacccucgacuguagcccccggacaggccuggacuuuaacgagaugguccuucugaccaugaaggagaaaucuuggcucgugcauaagcagugguuccuggaucuuccucugcccuggacguccggggccagcacaucccaagaaaccuggaaucgccaggaccuccuggucacauuuaaaaccgcucacgcgaagaagcaggaggugguugugcugggaucucaagaaggcgccaugcacaccgcucucacaggggccacggagauucagaccagcggaacaaccacaaucuucgccggccaucugaaaugcagacuuaagauggauaaacugacccucaaggggauguccuaugucauguguacgggcagcuucaaacuggaaaaggagguggcugagacacagcacggaaccguucuggugcaggucaaguacgaaggcaccgacgccccgugcaaaauuccuuuuucuacacaagaugagaagggggugacccagaacggacggcuuaucacagcgaaucccaucgugacggacaaagaaaagccuguuaacauugagaccgagccgcccuucggcgaauccuauaucgucgugggggcuggagagaaagcccucaagcugagcugguuuaagagaggcucuagcauugggaaaauguucgaagccacagcucgcggcgcccggagaauggcuauccugggagauaccgccugggacuuuggcuccauugggggaguguucacaucugucggcaagcucgugcaucagguuuuugggaccgcguacggagugcuguucagcggcgucuccuggacgaugaaaaucgggaucggcauucuucugaccuggcucggacugaauagccgcucuacaucccugagcaugaccuguaucgccgugggcaugguuacacuuuaccucggggugaugguccaggcugauucuggaugcgugauuaacuggaagggccgggagcugaaauguggguccggaaucuuuguuaccaacgaagugcacacauggaccgagcaauauaaguuccaggccgacagcccuaagagacuguccgcugccauuggcaaagcgugggaggaaggggucugcggcauccgcucugccacgcggcucgagaauauuauguggaagcagaucagcaacgaacugaaucauauccuucuggagaacgauaugaaauuuacagugguggucggagacgcuaauggcauucucgcccaggggaagaaaaugaucagaccgcaacccauggaacacaaguacuccuggaaaucuuggggaaaggcuaagauuaucggcgccgacauucagaacaccaccuucaucaucgaugggccugacacacccgaguguccugauggacagcgcgccuggaauauuugggagguugaagacuauggcuuuggcguguucaccacgaacaucuggcugaaacugcgggauagcuacacacagaugugcgaccacagacuuauguccgcugcgauuaaggauagcaaagccgugcaugcugacaugggguauuggaucgagucugaaaagaaugagaccuggaaacucgcccgcgccuccuucauugaagucaagacauguaccuggcccaagagccacacacuguggucuaacggagugcuggaguccgagaugaucaucccgaaaauuuacggcgggccuaucagccaacauaauuaucggcccggauacuuuacccagacggcuggcccuuggcaccucgggaagcuggaacuugauuucgaccugugcgagggaaccacaguuguggucgaugaacacugcggcaacagaggccccucucuccggaccacaaccgugacggggaaaauuauccaugagugguguugccgcagcuguacacugccuccccugagauuucggggagaggacggcugcugguacgggauggaaauuagaccgguuaaggagaaagaagagaaucuugugcgcuccauggucagcgccggaucuggcgaaguggauuccuucagccucgggauccuguguguuuccaucaugauugaggaggugaugcggucuagauggagccgcaagaugcugaugaccggaacacucgcggucuuucugcuucugaucaugggccagcucaccuggaacgaccugauuagacugugcaucauggugggcgcuaaugccuccgaccggauggggaugggaaccacauaucuugcccugauggcuacguucaagaugcgcccuauguuugccgugggccuccuguucagacggcucaccucucgcgaaguccugcuucugacaauugggcucagccugguugcguccguggagcugcccaacucucuugaagaacugggagauggccucgcuauggggaucaugaugcugaaacuccugaccgaauuucaaccccaccagcuuuggacaacccugcucagccugacguucgugaagacaacccugucccuugacuacgccuggaaaaccacagccaugguccugagcauugugucucucuuuccucugugucucuccaccacaagccagaagacgaccuggcugccgguucuucugggaucuuucggcugcaaaccccugacaauguuucucaucaccgagaacaagaucuggggcagaaaguccuggccucugaaugaggggauuauggcuaucggaauugugagcauccuucugucuucccuccugaaaaacgaugucccccucgccggcccucugauugcugggggaaugcuuaucgccuguuaugugaucagcggcuccagcgcggaccugucucuggaaaaggccgcugagguuagcugggaacaggaggccgaacauuccggggcuucucacaauauucucguggagguccaagaugacggaacaaugaaaaucaaggaugaggaacgggacgauacccugacgauucuucugaaagccacccuccuggccgugagcggcgucuaccccauguccaucccugcuacacucuucgugugguauuucuggcagaagaaaaagcagcgcucuggcguucugugggacacccccagcccgccugagguggaaagagcgguccuugaugacgggauuuaccggauccugcagcgcggacugcucggcagaucccaaguggggguuggaguguuucaggauggcgucuuccauacaauguggcacgugaccagaggggcugugcugauguaucagggaaagagacuugagcccucuugggcuagcguuaaaaaggaccugaucuccuacggcggcggguggcgcuuucagggaagcuggaacacaggcgaggaaguccaagugauugccguggagccugggaaaaaucccaagaacguccagacgaccccgggaacauucaaaaccccugaaggcgaggugggggccaucgcucucgacuuuaagcccggaaccucuggcuccccuauuguuaaucgggaaggcaagaucguggggcuguacggaaacggcgucgugacaacgagcgggaccuauguuucugccauugcgcaggcuaaagccucccaagagggaccccuccccgagaucgaagaugagguguucaagaaaagaaaucugacaauuauggaccuucacccuggcagcgggaagacccgccgguaccugccggccaucgucagagaagcuaucaaacgcaagcugcggacacucauucuggcccccaccagagugguugcguccgagauggcugaagcccuuaagggcaugccuauccgcuaucagacgacagccgugaaaucugagcauaccggacgggagauugucgaucugaugugccacgcuaccuuuacaaugagacuccugagccccgugcgggugccuaacuacaauaugaucauuauggacgaagcccauuucaccgaucccgcuuccaucgccgcgcgcggcuauaucagcacaagagucgggaugggagaggccgcugccauuuuuaugaccgcuacgccuccgggcucuguugaagccuucccccaguccaacgccgugauccaggacgaggaacgggauauuccugagcgcagcuggaacucuggguacgacuggaucacagauuuucccggaaagaccgugugguucgucccuagcauuaaauccggcaacgacaucgcuaauugucugagaaagaacgggaaacgggugauccaacucucuagaaagacauucgauaccgaguaucagaagacgaaaaacaaugacugggacuacguugugaccacagauauuagcgaaaugggcgcgaacuuucgcgccgaccgggucaucgaucccagacgcugccuuaagccggugauucugaaagacggaccugagcggguuauccuggcuggccccaugcccgugaccgucgccuccgccgcucagagacgcgggcggauuggaagaaaucagaacaaggaaggcgaucaauacguguauauggggcagccucucaauaacgacgaggaucacgcccauuggacagaggcgaaaaugcugcuugacaauaucaacacccccgaaggaauuaucccugcucuguucgagccggaacgcgagaagucugccgccaucgauggcgaauacagacucagaggggaagcucgcaagacauuugucgagcugaugagacggggcgaccugcccguguggcucagcuauaaaguugccuccgaaggauuccaguacagcgaucgcagauggugcuuugacggcgagcggaauaaccaggugcuugaagagaauauggauguggaaauuuggaccaaggagggggagcgcaagaaacugcgcccucgguggcuggacgcgagaacguauucugacccccucgcccugcgcgaguucaaagaguuugcugccggacggagauccgucagcggcgaucuuauccuggaaauugggaaacucccucaacaccugacacugcgggcucagaacgcccucgacaaucuuguuaugcugcacaacuccgagcagggaggcaaggcuuaccgccaugccauggaggaacugcccgauaccaucgagacccucaugcugcuugcgcugauugccgugcucacaggcggggugacccuguucuuucugucuggaaagggccucgggaagacaagcaucggacuucugugugucacggcuuccucugcccugcucuggauggcuagcguggaaccgcacuggaucgccgccuccauuauccuggaguucuuucuuaugguucugcucauuccugaacccgacagacagcggaccccucaagauaaucagcuggcuuauguggucaucggccuccuguucaugauucuuacaguggcggccaacgagauggggcugcuggagaccaccaaaaaggaccucggaaucggcuacgucgcugccgaaaaccaucagcacgccaccaugcuggauguggaccuucaccccgcuagcgccuggacgcuguacgcgguugccaccacagugaucaccccuaugaugcgccauacaauugagaauaccacggcuaacaucucucucacagccauugcuaaucaagccgcgauccugaugggccuggauaaaggguggcccauuuccaagauggacaucggagucccgcuccuugcccugggcugcuauagccaggugaacccucugacccucacagcugccguucugaugcuuguggcucacuacgccauuaucgggcccggacugcaggcuaaagccaccagagaagcgcagaagcggaccgccgcuggcaucaugaagaaucccacagucgaugggauuguggccaucgaccucgauccugugguuuaugacgcuaaauuugagaagcaacugggacagauuaugcugcucauccuuuguacgucucagauucugcugaugcgcaccacaugggcccucugcgaauccaucacccuggccacaggcccgcuuaccacgcugugggagggcagccccgggaaauucuggaacacaaccaucgcggucucuauggcuaauauuuucagaggaagcuaccucgccggcgcugggcuggccuuuucccugaugaagucucucggaggcgggcggcgcggaaccggcgcccagggcgagacacuuggggaaaaauggaagagacaacugaaccagcugagcaaguccgaguucaauaccuauaaacggagcggaaucauggaaguggacagauccgaggcuaaggaaggccucaaacgcggggagacaacgaagcaugccgugucucggggaaccgcgaaacugagaugguuugucgagcgcaaccuuguuaagccugaaggcaaggugauugaucugggguguggacggggcggcuggagcuacuauugcgccgggcucaaaaaggugacagaggucaaaggauacaccaagggcgggcccggacacgaggaaccuauccccauggcuacauacggcuggaaucuggugaaacugcauuccgggaaggacguuuucuuuaugccuccggaaaaaugugauacccuccuuugcgacauuggagagucuagccccaacccuacgaucgaggaaggcagaacccugcgcgugcugaagauggucgagcccuggcuccggggcaaucaguucuguaucaagauucugaacccuuauaugcccuccgugguugaaacacuugagcagaugcaaagaaaacacgggggaaugcuggugcgcaauccgcucucucggaacagcacccacgagauguacugggucuccugcggcacagggaauaucgugagcgccgugaacaugaccucuagaaugcugcugaaccgcuuuacaauggcucaucggaagccuaccuaugaaagagaugucgaccucggagccggcacgcgccacguugcgguggagcccgaaguggccaaucuggauauuaucgggcagagaauugagaacaucaaaaaugaacauaaguccacauggcacuacgacgaggauaaccccuauaaaaccugggcuuaccacggaagcuaugaggucaagccuucuggcuccgccagcucuauggugaauggcguugugcggcuucugaccaagcccugggacgucauuccuauggugacacagaucgcuaugacggauaccacaccguucgggcaacagcgcguuuuuaaagaaaagguggacaccagaacaccccgggccaaaagaggaaccacacagaucauggaggucaccgcuaaguggcucuggggcuuccugucccggaacaaaaagccucgcauuuguacgagagaagaguuuacccggaaggugcgcagcaaugccgcgaucggggccguuuucguggacgaaaaccaguggaacuccgcuaaagaggccgucgaggaugaaagauuuugggaccuugugcaucgggagcgcgaacugcacaagcaaggaaaaugcgcuacaugcgucuacaacaugaugggcaagagagagaaaaagcucggggaguucggcaaggccaaaggaagccgggccauuugguacauguggcugggcgcgcgcuuccuggaguuugaggcucucggguucaugaaugaagaucauugguuuucuagagagaacagccuguccggaguggaaggcgaggggcuucacaagcugggauauauccuccgggacauuucuaaaauccccggcgggaauauguacgccgaugacaccgccggcugggauacacgcaucaccgaggacgaucugcagaacgaagcuaagauuacggacaucauggagccugaacaugcccuucuggcuacaagcauuuucaaacucaccuaucagaauaagguugugagaguccagcggcccgccaaaaacggaacagugauggaugugaucucccgcagagaccaacggggcucugggcagguuggaaccuacggccugaacacguuuaccaauauggaggugcagcugauuagacagauggaaagcgaggggaucuuccucccguccgagcuggaaacaccuaaccuugcggagcgcgcccuggauuggcucgaaaagcacggagcugagcggcugaagagaauggccaucucuggcgacgacugugucgugaaacccauugaugaccgcuuugcuaccgcccuuacagcgcugaaugauauggggaagguucggaaagacaucccucaaugggaacccagcaagggcuggaacgauuggcaacaggugccuuucugcucccaccauuuucaccagcucauuaugaaagacggaagagagaucgucgugcccugucgcaaucaagaugagcuggucggccgggccagagugagccagggggcuggauggucucugcgcgaaaccgccugccucggcaaguccuaugcucagauguggcaacugauguacuuccaucggagagaccuucgccuggccgcuaacgccauuuguagcgcgguuccgguggauugggucccuacaucucggaccacgugguccauccacgcccaccaucaguggaugacaaccgaggacaugcucagcguguggaauagaguuuggaucgaagagaaccccuggauggaagauaagacccacguguccucuugggaggagguccccuaucuggggaaacgggaagaccaguggugcggaagccuuauuggccugacagcuagagccaccugggccacaaauauccagguggcuauuaaccaagugcgccggcucaucgggaaugagaacuaccuggacuacaugacguccaugaagagauuuaaaaaugaaagcgauccugagggcgcccugugguga

SEQ ID NO: 18797 - RNA, 9879 nt, Artificial Sequence
  derived and/or modified CDS sequence (opt5) from DENV-1__FJ850103__SS-prME
agcgugaccaugcugcucaugcugcuucccacagcccuggcuuuccaccucacgacccggggcggggagccucauaugaucgucuccaagcaggaacgggggaagucucugcuuuuuaagacaagcgccggcguuaacaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccaaaccggcgagcaccggcgggagaagcgcucugucgcccuggcuccucauguggggcucggacuggaaacaagaaccgagacguggaugagcuccgaaggcgccuggaaacagauucagcggguugagacaugggcucuuagacaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccgcccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagguguuugggaccgccuacggaguucuguucagcggcguguccuggacgaugaaaaucgggaucggcauucuucugaccuggcucggacugaauagccgcucuacaucccugagcaugaccuguaucgcugucggcauggugacacuuuaccucgggguuauggugcaggccgauucuggaugcgucauuaacuggaagggccgggagcugaaauguggguccggaaucuuugugaccaacgaaguucacacauggaccgagcaauauaaguuccaggcugacagcccuaagagacuguccgccgcgauuggcaaagccugggaggaaggggugugcggcauccgcucugcuacgcggcucgagaauauuauguggaagcagaucagcaacgaacugaaucauauccuucuggagaacgauaugaaauuuacagucguggugggagacgccaauggcauucucgcucaggggaagaaaaugaucagaccgcaacccauggaacacaaguacuccuggaaaucuuggggaaaggccaagauuaucggcgccgacauucagaacaccaccuucaucaucgaugggccugacacacccgaguguccugauggacagcgcgcuuggaauauuugggaggucgaagacuauggcuuuggcguuuucaccacgaacaucuggcugaaacugcgggauagcuacacacagaugugcgaccacagacuuauguccgcggccauuaaggauagcaaagcugugcaugccgacaugggguauuggaucgagucugaaaagaaugagaccuggaaacucgcccgcgcuuccuucauugaagugaagacauguaucuggcccaagagccacacccuguggucuaacggaguccuggaguccgagaugaucauuccgaaaaucuacggcgggccuauuagccaacauaauuaucggcccggauacuuuacacagaccgccggcccuuggcaccucgggaagcuggaacuugauuucgaccugugcgagggaacgaccgugguuguggaugaacacugcggcaacagaggccccucucuccggacaaccacagucaccgggaaaaucauucaugagugguguugccgcagcuguacgcugccuccccugagauuucggggagaggacggcugcugguacgggauggaaaucagaccggugaaggagaaagaagagaaucuuguucgcuccauggugagcgcgggaucuggcgaagucgauuccuucagccucgggauccuguguguguccauuaugaucgaggagguuaugcggucuagauggagccgcaagaugcugaugacaggaacccucgcuguguuucugcuucugauuaugggccagcucacauggaacgaccugaucagacugugcauuauggucggcgccaaugccuccgaccggauggggaugggaaccaccuaucuugcucugauggccacauucaagaugcgcccuauguuugcggugggccuccuguucagacggcucacgucucgcgaagugcugcuucugaccaucgggcucagccuggucgcuuccguugagcugcccaacucucuugaagaacugggagauggccucgccauggggauuaugaugcugaaacuccugacagaauuucaaccccaccagcuuuggaccacacugcucagccugaccuucgugaagacgacacugucccuugacuacgccuggaaaaccaccgcuauggugcugagcaucgucucucucuuuccucugugucucuccacaaccagccagaagacaacguggcugccggugcuucugggaucuuucggcugcaaaccccugaccauguuucucaucacagagaacaagauuuggggcagaaaguccuggccucugaaugaggggaucauggccauuggaaucguuagcauucuucugucuucccuccugaaaaacgaugugccccucgcuggcccucugaucgccgggggaaugcuuaucgcguguuaugucauuagcggcuccagcgccgaccugucucuggaaaaggcugccgaggugagcugggaacaggaggcugaacauuccggggccucucacaauauccucguugaggugcaagaugacggaaccaugaaaauuaaggaugaggaacgggacgauacacugaccauccuucugaaagccacgcuccuggcugucagcggcguguaccccauguccauuccugcgacccucuucgucugguauuucuggcagaagaaaaagcagcgcucuggcgugcugugggacacacccagcccgccugagguugaaagagccgugcuugaugacgggaucuaccggauccugcagcgcggacugcucggcagaucccaagucggggugggaguuuuucaggauggcguguuccauaccauguggcacgucacaagaggggcugugcugauguaucagggaaagagacuugagcccucuugggccagcgugaaaaaggaccugauuuccuacggcggcggguggcgcuuucagggaagcuggaacaccggcgaggaaguucaagucaucgccguggagccugggaaaaaucccaagaacgugcagacaacgccgggaaccuucaaaacaccugaaggcgaggucggggcuauugcccucgacuuuaagcccggaaccucuggcuccccuaucgugaaucgggaaggcaagauuguugggcuguacggaaacggcguggucaccacaagcgggacguaugugucugcgaucgcucaggccaaagccucccaagagggaccccuccccgagauugaagaugagguuuucaagaaaagaaaucugaccaucauggaccuucacccuggcagcgggaagacacgccgguaccugccggcuaucgugagagaauccauuaaacgcaagcugcggacccucauccuggcccccacaagagucguggcgucugagauggcugaagcccuuaagggcaugccuauucgcuaucagaccacggccguuaaaagcgagcauacaggacgggagaucguggaucugaugugccacgcuaccuuuaccaugagacuccugucccccguccgggugccuaacuacaauaugauuaucauggacgaagcccauuucacagaucccgcuagcaucgccgcgcgcggcuauauuucuaccagaguggggaugggagaggccgcugccaucuuuaugacagcuaccccuccgggcuccgucgaagccuucccccagagcaacgccguuauucaggacgaggaacgggauaucccugagcgcucuuggaauagcggguacgacuggauuacggauuuucccggaaagacagugugguucgugccuuccaucaaaucuggcaacgacaucgcuaauugucugagaaagaacgggaaacgggucauucaacucagcagaaagaccuucgauacagaguaucagaagaccaaaaacaaugacugggacuacgugguuacgaccgauaucuccgaaaugggcgcgaacuuucgcgccgaccgggugauugaucccagacgcugccuuaagccggucauccugaaagacggaccugagcgggugauucuggcuggccccaugcccguuacaguggccucugccgcucagagacgcgggcggaucggaagaaaucagaacaaggaaggcgaucaauacgucuauauggggcagccucucaauaacgacgaggaucacgcccauuggaccgaggcgaaaaugcugcuugacaauauuaacacacccgaaggaaucaucccugcucuguucgagccggaacgcgagaaaagcgccgccauugauggcgaauacagacucagaggggaagcucgcaagaccuuuguggaacugaugagacggggcgaccugcccgucuggcucuccuauaaaguggccagcgaaggauuccaguacucugaucgcagauggugcuuugacggcgagcggaauaaccagguucuugaagagaauauggauguggaaaucuggacaaaggagggggagcgcaagaagcugcgcccucgguggcuggacgcgagaaccuauuccgacccccucgcccugcgcgaguucaaagaguuugcugccggacggagaagcguguccggcgaucuuauucuggaaaucgggaagcucccucaacaccugacgcugcgggcucagaacgcccucgacaaucuugucaugcugcacaacucugagcagggaggcaaggcuuaccgccaugccauggaggaacugcccgauacaauugagacccucaugcugcuugcgcugaucgccguucucaccggcggggugacacuguucuuucugagcggaaagggccucgggaagaccuccaucggacuucugugugugacagcuucuagcgcccugcucuggauggcuuccgucgaaccgcacuggauugccgccagcaucauucuggaguucuuucuuauggugcugcucaucccugaacccgacagacagcggacgccucaagauaaucagcuggcuuauguugugauuggccuccuguucaugauccuuaccgucgcggccaacgagauggggcugcuggagacaaccaaaaaggaccucggaaucggcuacguggcugccgaaaaccaucagcacgccacaaugcuggaugucgaccuucaccccgcuucugccuggacccuguacgcgguggccacgaccguuauuacaccuaugaugcgccauaccaucgagaauacaaccgcuaacauuucccucacggccaucgcuaaucaagccgcgauucugaugggccuggauaaaggguggcccaucagcaagauggacauuggagugccgcuccuugcccugggcugcuauucucaggucaacccucugacacucaccgcugccgugcugaugcuuguugcucacuacgccaucaucgggcccggacugcaggcuaaagccacaagagaagcgcagaagcggaccgccgcuggcauuaugaagaaucccaccguggaugggaucgucgccauugaccucgauccugugguguaugacgcuaaauuugagaagcaacugggacagaucaugcugcucauucuuuguacaucccagauccugcugaugcgcacgaccugggcccucugcgaaagcaucacacuggccaccggcccgcuuacaacccugugggagggcucucccgggaaauucuggaacacgacaauugcgguuagcauggcuaauaucuucagaggauccuaccucgccggcgcugggcuggccuuuucucugaugaaaagccucggaggcgggcggcgcggaaccggcgcccagggcgagacccuuggggaaaaauggaagagacaacugaaccagcuguccaagagcgaguucaauacauauaaacgguccggaauuauggaagucgacagaucugaggcuaaggaaggccucaaacgcggggagaccacaaagcaugccgugagccggggaacggcgaaacugagaugguuuguggagcgcaaccuugucaagccugaaggcaagguuaucgaucugggguguggacggggcggcugguccuacuauugcgccgggcucaaaaaggugaccgaggugaaaggauacacaaagggcgggcccggacacgaggagccuauucccauggcuaccuacggcuggaaucuggucaaacugcauucugggaaggacguguucuuuaugccuccggaaaaaugugauacacuccuuugcgacaucggagagagcucccccaacccuaccaucgaggaaggcagaacgcugcgcguucugaagaugguggagcccuggcuccggggcaaucaguucuguauuaagauccugaacccuuauaugcccucugucguggaaacccuugagcagaugcaaagaaaacacgggggaaugcugguucgcaauccgcucagccggaacuccacacacgagauguacugggugagcugcggcaccgggaauauugucucugccgugaacaugacauccagaaugcugcugaaccgcuuuaccauggcucaucggaagccuacauaugaaagagauguggaccucggagccggcacccgccacgucgcgguugagcccgaaguggccaaucuggauaucauugggcagagaaucgagaacauuaaaaaugaacauaagagcacguggcacuacgacgaggauaaccccuauaaaacaugggcuuaccacggaucuuaugaggugaagccuuccggcagcgccucuuccauggucaauggcgugguuaaacuucugaccaaacccugggacgugaucccuauggucacccagaucgcuaugacagauacgaccccguucgggcaacagcggguguuuaaggaaaaaguugacacacgcacccccagagccaagcggggaacaacccagauuauggaggugacagcuaaauggcucuggggcuuccugagcagaaacaagaagccucggaucuguacccgcgaagaguuuacgagaaaaguccgguccaaugccgcgauuggggccguguucguugacgaaaaccaguggaauagcgcuaaggaggccguggaggaugaacgcuuuugggaccuuguccauagagagcgggaacugcacaaacaaggaaagugcgcuaccugcguguacaacaugaugggcaaacgcgagaagaagcucggggaguucggcaaagccaagggaucuagagccaucugguacauguggcugggcgcgcgguuccuggaguuugaggcucucggguucaugaaugaagaucauugguuuagccgcgagaacucccugucuggagucgaaggcgaggggcuucacaaacugggauauauucucagagacaucagcaagauccccggcgggaauauguacgccgaugacacagccggcugggauacccggauuacagaggacgaucugcagaacgaagcuaaaaucaccgacauuauggagccugaacaugcccuucuggcuacguccaucuucaagcucacauaucagaauaaagugguucgcgugcagagacccgccaagaacggaaccgucauggaugugauuucucggcgcgaccaaagaggcagcggacaggugggaacauacggccugaacaccuuuacgaauauggagguucagcugauccggcagauggaauccgaggggaucuuccucccgucugagcuggaaaccccuaaccuugcggagagagcccuggauuggcucgaaaagcacggagcugagcgccugaaacggauggccauuagcggcgacgacuguguggucaagcccaucgaugacagauuugcuacagcccuuaccgcgcugaaugauauggggaaagugcgcaaggacauuccucaaugggaacccuccaaaggcuggaacgauuggcagcagguuccuuucugcagccaccauuuucaccagcucaucaugaaggacggacgggagauugugguccccuguagaaaucaagaugagcuggugggccgcgcccgggucucucagggggcuggauggucccugagagaaacagccugccucggcaagagcuaugcucagauguggcaacugauguacuuccaucgccgggaccuuagacuggccgcuaacgccaucuguucugcggugccgguugauugggugccuaccucccgcacaaccuggagcauccacgcccaccaucaguggaugacgacagaggacaugcucuccgucuggaaucggguguggauugaagagaaccccuggauggaagauaaaacccacguuucuagcugggaggaggugcccuaucuggggaagagagaagaccaguggugcggaucccuuaucggccugaccgcucgggccacaugggccaccaauauucaggucgcuaucaaccaagugagacgccucauugggaaugagaacuaccuggacuacaugacaagcaugaaacgguuuaagaaugaaucugauccugagggcgcccugugguga

SEQ ID NO: 18798 - RNA, 9879 nt, Artificial Sequence
  derived and/or modified CDS sequence (opt5) from DENV-1__FJ850104__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugugaccgauacgugggucaccuauggaacauguucccaaaccggcgagcacagacgggacaagcgcucuguggcccuggccccucauguugggcucggacuggagacaagaaccgaaacguggaugagcuccgagggcgcuuggaaacagauucagcggguggaaacaugggcccuucgccaccccggcuucaccgucaucgcucuguuucucgcccaugcgauugggacaucuaucacccagaagggaaucauuuucauccugcuuaugcuggugaccccuagcauggccaugagaugcguuggcauugggaaccgggauuuuguggagggacucuccggcgcuacaugggucgacguggugcuggagcacgggagcugugucacgaccauggccaagaauaaacccacacuggauaucgaacuccugaagaccgagguuacaaacccugcugugcuucgcaaacugugcauugaagccaagaucucuaauaccacgacagacuccagauguccgacccaaggagaggcgacccucguggaagagcaggaugccaacuucgucugccggcgcacauuuguggacagaggcuggggcaauggguguggacuguucggcaaagggagccuucugaccugcgcuaaguuuaagugcguuacaaaacucgagggaaagauugugcaguacgaaaaccugaaauauucugucaucgugacgguucacaccggcgaucagcaucaaguggggaaugagacaaccgaacacggaacaaucgccaccauuacgccccaggcuccuaccuccgagauccagcugacagacuacggcgcccucacccuggacuguagcccccggacaggccuugauuucaacgaaaugguccugcucaccaugaaggagaaaucuuggcuggugcauaagcagugguuucuugaccugccucuccccuggacguccggggccagcacaucccaagagaccuggaaucgccaggaucugcuggucacauucaaaaccgcucacgcgaagaagcaggaagugguugugcucggaucucaagagggcgccaugcacaccgcucugacaggggccacggaaauucagaccagcggaacaaccacaaucuuugccggccaucuuaaaugcagacugaagauggacaaacucacccugaaggggauguccuaugucauguguacgggcagcuucaaacuggagaaggaaguggcugagacacagcacggaaccguucuugugcaggucaaguacgagggcaccgaugccccgugcaaaauuccuuucucuacacaagacgaaaagggggugacccagaacggacggcucaucacagcgaaucccaucgugacggauaaagagaagccuguuaacauugaaaccgagccccccuuuggcgaguccuauaucgucgugggggcuggagaaaaagcccugaagcugagcugguucaagaaaggcucuagcauugggaagauguuugaggccacagcuagaggcgcccgccggauggcuauccucggagacaccgccugggauuucggcuccauugggggaguguuuacaucugucggcaaacuggugcaucagguuuucgggaccgcguacggagugcuuuuuagcggcgucuccuggacgaugaagaucgggaucggcauucugcucaccuggcugggacugaauagcagaucuacaucccuuagcaugaccuguaucgccgugggcaugguuacacucuaccugggggugaugguccaggcugacucuggaugcgugauuaacuggaaaggccgcgaacugaaguguggguccggaaucuucguuaccaacgaggugcacacauggaccgaacaauauaaguuucaggccgauagcccuaaacggcucuccgcugccauuggcaaggcgugggaggagggggucugcggcaucagaucugccacgcgccuggaaaauauuauguggaaacagaucagcaacgagcuuaaucauauccugcucgaaaacgacaugaaguucacagugguggucggagacgcuaauggcauucuggcccaggggaaaaagaugauccggccgcaacccauggagcacaaauacuccuggaagucuuggggaaaggcuaaaauuaucggcgccgauauucagaacaccaccuuuaucaucgacgggccugauacacccgaauguccugacggacagagagccuggaauauuugggagguugaggauuauggcuucggcaucuuuaccacgaacauuuggcugaagcuucgcgacagcuacacacagaugugcgaucaccggcucauguccgcugcgaucaaagacagcaaggccgugcaugcugauaugggguauuggauugaaucugagaaaaaugaaaccuggaagcuggccagagccuccuucaucgaggugaagacauguaccuggcccaaaagccacacacuguggucuaacggaguccucgaauccgagaugaucauuccgaagaucuacggcgggccuauuagccaacauaaucaccgccccggauauuucacccagacggcuggcccuuggcaccuggggaaacuugagcuggacuuugaucucugcgaaggaaccacagugguuguggacgagcauugcggcaaccggggccccucucugagaaccacaaccgucacggggaagaucauucacgaaugguguugccggagcuguacacugccuccccuucgcuucagaggagaggauggcugcugguacgggauggagauccggccggugaaagaaaaggaggaaaaucucguuagauccauggugagcgccggaucuggcgaggucgacuccuuuagccuggggauccuguguguguccauuaugaucgaagagguuaugcgcucucgguggagcagaaagaugcucaugaccggaacacuggcgguguuccuucugcucauuaugggccagcugaccuggaacgaccugauccgccuuugcauuauggucggcgcuaaugccuccgauagaauggggaugggaaccacauaccuggcccucauggcuacguuuaaaaugcggccuauguucgccgugggccugcucuuucgcagacugaccucucgggaggugcuucugcucacaaucgggcugagccuggucgcguccguugaacuucccaacucucuggaggaacucggagacggccuggcuauggggauuaugaugcucaagcugcuuaccgaguuccaaccccaucagcuguggacaacccuccugagccugacguuugugaaaacaacccuuucccuggauuaugccuggaagaccacagccauggugcucagcaucgucucucuguucccucucugucuguccaccacaagccagaaaacgaccuggcuuccggugcugcugggaucuuuuggcugcaagccccucacaauguuccugaucaccgaaaacaagauuuggggccgcaaauccuggccucuuaaugaggggaucauggcuauuggaaucguuagcauucugcucucuucccugcucaagaacgacgugccccuggccggcccucuuaucgcugggggaaugcugaucgccuguuacgucauuagcggcuccagcgcggaucugucucucgagaaagccgcugaagugagcugggagcaggaagccgagcacuccggggcuucucauaauauccugguugaagugcaagacgauggaacaaugaagauuaaagacgaggagagagaugacacccuuacgauccugcucaaggccacccugcucgccgucagcggcguguaucccauguccauuccugcuacacuguuugucugguacuucuggcagaaaaagaagcagcggucuggcgugcuuugggauacccccagcccgccugaaguugagcgcgcggugcuggacgaugggaucuauagaauccugcagcggggacuccugggccgcucccaagucggggugggaguuuuccaggacggcguguuucacacaauguggcacgucaccagaggggccgugcuuauguaccagggaaaacggcuggaacccucuugggcuagcgugaagaaagaccucauuuccuauggcggcggguggagauuccagggaagcuggaacacaggcgaggagguucaagucaucgccguggaaccugggaagaaucccaaaaacgugcagacgaccccgggaacauuuaagaccccugagggcgaagucggggccauugcucuggauuucaagcccggaaccucuggcuccccuaucgugaaucgcgagggcaaaauuguugggcucuacggaaacggcguggucacaacgagcgggaccuacgugucugccaucgcgcaggcuaaggccucccaagaaggaccccugcccgagauugaggacgaaguuuuuaaaaagcggaaucuuacaaucauggaucugcauccuggcagcgggaaaaccagacgcuaucugccggccaucgugcgggaggcuauuaagagaaagcuccgcacacugauccuugcccccacccgggucguggcguccgaaauggcugaggcccugaaaggcaugccuauuagauaccagacgacagccguuaagucugaacacaccggacgcgagaucguggaccucaugugccaugcuaccuucacaaugcggcugcugagccccgucagagugccuaacuauaauaugauuaucauggaugaggcccacuuuaccgaccccgcuuccaucgccgcgcggggcuacauuagcacacgcguggggaugggagaagccgcugccaucuucaugaccgcuacgccuccgggcucugucgaggccuuuccccaguccaacgccguuauucaggaugaagagagagacaucccugaacggagcuggaauucuggguaugauuggauuacagacuuccccggaaaaaccgugugguuugugccuagcaucaaguccggcaacgauaucgcuaauugucuccgcaaaaacgggaagagagucauucaacuuucucggaagacauucgacaccgaguaccagaaaacgaagaacaaugacugggauuaugugguuaccacagacaucagcgagaugggcgcgaacuucagagccgaucgcgugauugacccccggagaugccugaaaccggucauccugaaggauggaccugaacgcgugauucucgcuggccccaugcccguuaccguggccuccgccgcucagcggagagggcgcaucggacggaaucagaacaaagagggcgaccaauacgucuacauggggcagccucugaauaacgaugaagaccaugcccacuggacagaggcgaagaugcuucuggauaauauuaacacccccgagggaaucaucccugcucucuuugaaccggagagagaaaagucugccgccauugacggcgaguaucgccugagaggggaagcucggaaaacauucguggagcugaugcgcagaggcgaucuccccgucuggcuuagcuacaagguggccuccgagggauuucaguauagcgaccggcgcuggugcuucgauggcgaaagaaauaaccagguucuggaggaaaauauggacguggagaucuggaccaaagaaggggagcggaagaaacugagaccucgcuggcucgacgcgcggacguacucugauccccuggcccuuagagaguuuaaggaauucgcugccggacgccgguccgugagcggcgaccugauucucgagaucgggaaacugccucaacaccugacacucagagcucagaacgcccuugauaaucuggucaugcugcauaacuccgaacagggaggcaaggcuuaucggcacgccauggaggaacuccccgacaccauugagacccugaugcuucuggcgcucaucgccguucugacaggcggggugacccuguuuuuccucucuggaaagggccuugggaaaacaagcaucggacugcugugugugacggcuuccucugcccuccuguggauggcuagcgucgagccgcauuggauugccgccuccaucauucuugaauuuuuccugauggugcuccugaucccugagcccgaucgccagagaaccccucaagacaaucagcuggcuuacguugugauuggccuccuuuuuaugauccugacagucgcggccaacgaaauggggcugcucgagaccacaaagaaagaucugggaaucggcuauguggcugccgagaaccaccagcacgccaccaugcuugacgucgaucugcggcccgcuagcgccuggacgcucuacgcgguggccaccacaguuauuaccccuaugaugcgccauacaaucgaaaauaccacggcuaacauuucucugacagccaucgcuaaucaagccgcgauucugaugggccucgacaagggguggcccaucuccaaaauggauauuggagugccgcuucuggcccugggcugcuacagccaggucaacccucucacccugacagcugccgugcuuaugcugguugcucacuaugccaucaucgggcccggacuccaggcuaaggccaccagagaggcgcagaagcggaccgccgcuggcauuaugaaaaaucccacaguggacgggaucgucgccauugaucuggacccugugguguacgacgcuaaguucgaaaaacaacugggacagaucaugcuccuuauucuguguacgucucagauccugcucaugcgcaccacaugggcccugugcgaguccaucacccuugccacaggcccgcugaccacgcucugggaaggcagccccgggaaguuuuggaacacaaccauugcgguuucuauggcuaauaucuucagaggaagcuaucuggccggcgcugggcuggccuucucccucaugaaaucucuuggaggcgggcggcgcggaaccggcgcccagggcgagacacugggggagaaguggaagagacaacugaaccagcucagcaaauccgaauuuaauaccuacaagcggagcggaauuauggaggucgauagauccgaagcuaaagagggccugaagcgcggggaaacaacgaaacaugccgugucucggggaaccgcgaagcuuagaugguucguggagcgcaaccuggucaagccugagggcaaaguuaucgaccucggguguggacggggcggcuggagcuauuacugcgccgggcugaagaaagugacagaagugaagggauauaccaaaggcgggcccggacacgaggaaccuauucccauggcuacauacggcuggaaucuggucaagcuccauuccgggaaagauguguuuuucaugccuccggagaagugugacacccuucugugcgauaucggagaaucuagccccaacccuacgaucgaggagggcagaacccugcgcguucucaagaugguggaacccuggcugcggggcaaucaguuuuguauuaaaauccuuaacccuuacaugcccuccgucguggagacacuggaacagaugcaaagaaagcacgggggaaugcucguucgcaauccgcugucucggaacagcacccacgagauguauuggguguccugcggcacagggaauauugucagcgccgugaacaugaccucuagaaugcugcucaaccgcuucacaauggcucaucggaaaccuaccuacgagagagacguggaucugggagccggcacgcgccacgucgcgguugaacccgaggaagccaaucuugacaucauugggcagagaaucgagaacauuaagaaugaacauaaauccacauggcacuaugaugaggacaaccccuacaagaccugggcuuaucacggaagcuacgaggugaagccuucuggcuccgccagcucuauggugaauggcgucgugcggcugcucaccaaacccugggauguuaucccuauggugacacagaucgcuaugacggacaccacaccguuugggcaacagcgcgucuucaaggaaaaaguggacaccagaacaccccgggccaagagaggaaccacacagauuauggagguuaccgcuaaauggcuguggggcuuucuuucccggaacaagaagccucgcaucuguacgagagaagaguucacccggaaagugcgcagcaaugccgcgauuggggccgucuuuguggaugaaaaccaguggaauuccgcuaaggaggccguugaggacgaaagauucugggaucuggugcaucgggagcgcgaacuccacaaacaaggaaagugcgcuacaugcgucuauaacaugaugggcaaaagagagaagaagcugggggaauuuggcaaagccaagggaagccgggccaucugguacauguggcugggcgcgcgcuuccucgaguucgaggcucugggguuuaugaaugaagaccauugguucucuagagagaacagccuuuccggaguggaaggcgaggggcugcacaaacucggauacauucugcgggauaucucuaagauccccggcgggaauauguaugccgacgauaccgccggcugggacacacgcauuaccgaggaugaccuucagaacgaagcuaaaaucacggauauuauggagccugaacaugcccugcucgcuacaagcaucuuuaagcugaccuaccagaauaaagucgugagaguucagcggcccgccaagaacggaacagugauggacgucauuucccgcagagaucaacggggcucugggcaggugggaaccuauggccugaacacguucaccaauauggaggugcagcucaucagacagauggaaagcgaggggaucuuucugccguccgagcuugaaacaccuaaccuggcggagcgcguucucgacuggcuggaaaagcacggagccgagcggcuuaaaagaauggcuauuucuggcgacgauuguguggucaagcccaucgacgaucgcuucgccaccgcucugacagcccucaaugacauggggaaagugcggaaggauauuccucaaugggaacccagcaaaggcuggaacgacuggcagcagguuccuuuuugcucccaccauuuccaccagcugaucaugaaggauggaagagagauugugguccccugucgcaaucaagacgagcuggugggccgggcgagagucagccagggggccggauggucucuccgcgaaaccgcuugccugggcaaguccuacgcccagauguggcaacuuauguauuuucaucggagagaucugcgccucgcugccaacgcuaucuguagcgccgugccgguugacugggugccuacaucucggaccacgugguccauccacgcgcaccaucaguggaugacaaccgaggauaugcugagcgucuggaauagaguguggauugaagagaaccccuggauggaagacaaaacccacguuuccucuugggaggaggugcccuaccuugggaagcgggaagaccaguggugcggaagccugaucggccucacagccagagcuaccugggccacaaauauucaggucgccaucaaccaagugcgccggcugauugggaaugagaacuaucuggauuacaugacguccaugaaaagauucaagaaugaaagcgacccugagggcgcucucugguga

SEQ ID NO: 18799 - RNA, 9879 nt, Artificial Sequence
  derived and/or modified CDS sequence (opt5) from DENV-1__JN819405__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccccccuuuggcgaguccuauaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaucagguguucgggaccgccuacggaguucuuuuuagcggcguguccuggacgaugaagaucgggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuucgugaccaacgagguucacacauggaccgaacaauauaaguuucaggcugauagcccuaaacggcucuccgccgcgauuggcaaggccugggaggagggggugugcggcaucagaucugcuacgcgccuggaaaauauuauguggaaacagaucagcaacgagcuuaaucauauccugcucgaaaacgacaugaaguucacagucguggugggagacgccaauggcauucuggcucaggggaaaaagaugauccggccgcaacccauggagcacaaauacuccuggaagucuuggggaaaggccaaaauuaucggcgccgauauucagaacaccaccuuuaucaucgacgggccugauacacccgaauguccugacggacagagagcuuggaauauuugggaggucgaggauuauggcuucggcaucuuuaccacgaacauuuggcugaagcuucgcgacagcuacacacagaugugcgaucaccggcucauguccgcggccaucaaagacagcaaggcuguucaugccgauaugggguauuggauugaaucugagaaaaaugaaaccuggaagcuggccagagcuuccuucaucgaggugaagacauguaccuggcccaaaagccacacacuguggucuaacggagugcucgaauccgagaugaucauuccgaagaucuacggcgggccuauuagccaacauaauuaucgccccggauacuucacccagacggccggcccuuggcaccuggggaaacuugagcuggacuuugaucucugcgaaggaaccacagucgugguugacgagcacugcggcaaccggggccccucucugagaaccacaaccgugacggggaagaucauucaugaaugguguugccggagcuguacacugccuccccuucgcuucagaggagaggauggcugcugguacgggauggagauccggccggucaaagaaaaggaggaaaaucucgugagauccaugguuagcgcgggaucuggcgagguggacuccuuuagccuggggauccugugugucuccauuaugaucgaagaggugaugcgcucucgguggagcagaaagaugcucaugaccggaacacuggcuguuuuccuucugcucauuaugggccagcugaccuggaacgaccugauccgccuuugcauuauggugggcgccaaugccuccgauagaauggggaugggaaccacacaccuggcucucauggccacguuuaaaaugcggccuauguucgcggucggccugcucuuucgcagacugaccucucgggaggugcuucugcucacaaucgggcugagccugauggcuuccauggaacuucccaacucucuggaggaacucggagacggccuggccauggggauuaugaugcucaagcugcuuaccgaguuccaaccccaucagcuguggacaacccuccugagccugacguuugugaaaacaacccuuucccuggauuaugccuggaagaccacagcuaugauccucagcaucgucucucuguucccucucugucuguccaccacaagccagaaaacgaccuggcuuccgguucugcugggaucuuuuggcugcaagccccucacaauguuccugauuaccgaaaacaagaucuggggccgcaaauccuggccucuuaaugaggggauuauggccaucggaauugugagcauccugcucucuucccugcucaagaacgacgugccccuggcuggcccucuuaucgccgggggaaugcugauugcguguuacgucaucagcggcuccagcgccgaucugucucucgagaaagcugccgaagugagcugggagcaggaagcugagcacuccggggccucucauaauauucugguugaagugcaagacgauggaacaaugaagaucaaagacgaggagagagaugacacccuuacgauucugcucaaggccacccugcucgcugucagcggcguguaucccauguccaucccugcgacacuguuuguuugguacuucuggcagaaaaagaagcagcggucuggcgugcuuugggauacccccagcccgccugaagucgagcgcgccgugcuggacgaugggaucuauagaauucugcagcggggacuccugggccgcucccaagucggggugggaguuuuccaggacggcguguuucacacaauguggcacgucaccagaggggcugugcuuauguaccagggaaaacggcuggaacccucuugggccagcguuaagaaagaccucaucuccuauggcggcggguggagauuccagggaagcuggaacacaggcgaggaggugcaagucauugccguggaaccugggaagaaucccaaaaacgugcagacgaccccgggaacauuuaagaccccugagggcgaaguuggggcuaucgcccuggauuucaagcccggaaccucuggcuccccuauugucaaucgcgagggcaaaaucguggggcucuacggaaacggcguggucacaacgagcgggaccuacgugucugcgauugcucaggccaaggccucccaagaaggaccccugcccgagaucgaggacgaaguuuuuaaaaagcggaaucuuacaaucauggaucugcauccuggcagcgggaaaaccagacgcuaucugccggcuauugugcgggaggccaucaagagaaagcuccgcacacugauucuugcgcccacccgggucguggcuuccgaaauggccgaggcccugaaaggcaugccuaucagauaccagacgacagcuguuaagucugaaaccaccggacgcgagauuguggaccucaugugccacgccacauucaccaugcggcugcugagccccgucagagugccuaacuauaauaugaucaucauggaugaggcucauuuuacagaccccgccuccauugcggcccggggcuacaucagcacccgcguugggaugggagaagcugccgcuauuuucaugacggccacaccuccgggcucuguggaggccuuuccccaguccaacgcugucauccaggaugaagagagagacauuccugaacggagcuggaauucuggguaugauuggaucaccgacuuccccggaaaaacagugugguuugugccuagcaucaaguccggcaacgauauugcgaauugucuccgcaaaaacgggaagagagucauccaacuuucucggaagaccuucgacacggaguaccagaaaaccaagaacaaugacugggauuauguugugacaaccgacauuagcgagaugggcgccaacuucagagcugaucgcgugaucgacccccggagaugccugaaaccggucauucugaaggauggaccugaacgcgugauccucgccggccccaugcccguuacaguggccuccgcugcccagcggagagggcgcauuggacggaaucagaacaaagagggcgaccaauacgucuacauggggcagccucugaauaacgaugaagaccacgcgcauuggaccgaggcuaagaugcuucuggauaauaucaacacacccgagggaaucauuccugcccucuuugaaccggagagagaaaagucugccgcuaucgacggcgaguaucgccugagaggggaagcccggaaaaccuucguggagcugaugcgcagaggcgaucuccccguuuggcuuagcuacaagguggcguccgagggauuucaguauagcgaccggcgcuggugcuucgauggcgaaagaaauaaccagguccuggaggaaaauauggacguggagauuuggacgaaagaaggggagcggaagaaacugagaccucgcuggcucgacgcccggacauacucugauccccuggcucuuagagaguuuaaggaauucgccgcuggacgccgguccgucagcggcgaccugauccucgagauugggaaacugccucaacaccugacccucagagcccagaacgcucuugauaaucuggugaugcugcacaacuccgaacagggaggcaaggccuaucggcaugcgauggaggaacuccccgacaccaucgagacacugaugcuucuggcccucaucgcuguucugaccggcggggugacacuguuuuuccucucuggaaagggccuugggaaaacgagcauuggacugcugugugugaccgccuccucugcucuccuguggauggccagcgucgagccgcacuggaucgccgcuuccauuauccuugaauuuuuccugaugguucuccugauuccugagcccgaucgccagagaacaccucaagacaaucagcuggcguacguggugaucggccuccuuuuuaugauccugaccgucgccgcuaacgaaauggggcugcucgagacaaccaagaaagaucugggaauuggcuauguggccgccgagaaccaucagcacgcuacgaugcuugacguugaucugcggcccgccagcgcguggacccucuacgccguggcuacaaccgucaucacaccuaugaugcgccacaccauugaaaauacgacagccaacaucucucugaccgcuauugccaaucaagcggccauccugaugggccucgacaagggguggcccauuuccaaaauggauaucggagugccgcuucuggcucugggcugcuacagccaggucaacccucucacacugaccgccgcugugcuuaugcugguugcccauuaugcuaucauugggcccggacuccaggccaaggcgaccagagaggcccagaagcggacagcugccggcaucaugaaaaaucccacgguggacgggauugucgcuaucgaucuggacccugugguuuacgacgccaaguucgaaaaacaacugggacagauuaugcuccuuauccuguguaccucucagauccugcucaugcgcacaaccugggcccugugcgaguccauuacacuugcgaccggcccgcugacgacacucugggaaggcagccccgggaaguuuuggaacaccaccaucgcugugucuauggccaauauuuucagaggaagcuaucuggcuggcgccgggcuggccuucucccucaugaaaucucuuggaggcgggcggcgcggaacaggcgcucagggcgagacccugggggagaaguggaagagacaacugaaccagcucagcaaauccgaauuuaauacauacaagcggagcggaaucauggaggucgauagauccgaagccaaagagggccugaagcgcggggaaacgaccaaacacgcggugucucggggaacagccaagcuuagaugguucguggagcgcaaccugguuaagccugagggcaaagucauugaccucggguguggacggggcggcuggagcuauuacugcgcugggcugaagaauuuuaccgaagugaaaggauauacauccggcgggcccggacaugaggaaccuauccccauggccaccuacggcuggaaccuggugaagcuccacucugggaaagaugucuucuuuaugccuccggagaagugugacacgcuucugugcgauaucggagaaagcucccccaauccuaccauugaggagggcagaacacugcgcguucucaaaaugguggaacccuggcugaagggcaaccaguucuguaucaagauucuuaauccuuacaugcccucuguggucgagacccuggaacagaugcaacggaaacaugggggaaugcucgugagaaacccgcugagccgcaauuccacacacgagauguauuggguuagcugcggcaccgggaacaucgugucugcugucaacaugacaucccggaugcugcucaauagauuuaccauggcccaccgcaagccuacguacgagcgggacguggaucugggagcgggcacaagacauguugccguggaacccgaggucgcuaaccuugacauuaucgggcagcgcauugaaaauaucaaaaacgagcacaagagcaccuggcauuaugaugaagacaaucccuacaaaaccugggccuaucacggaucuuacgaggugaagccuuccggcagcgcuucuuccauggugaacggcgucguuagacugcucacaaagcccugggaugugaucccuauggugacgcagauugccaugaccgacacaaccccguucgggcaacagcgggucuuuaaagagaagguggacacacgcacccccagagcuaaacggggaacaacccagaucauggaaguuacggccaaguggcuguggggcuuccuuagcagaaauaaaaagccucggauuuguacccgcgaggaauuuacaagaaaggugcgguccaacgcggccaucggggcugucuucguggaugagaaucaguggaacagcgccaaagaagcuguugaggacgagcgcuuuugggaucuggugcacagagaacgggagcuccauaagcaaggaaaaugcgccaccugcgucuauaauaugaugggcaagcgcgaaaaaaagcugggggaguucggcaaggccaaaggaucuagagcgauuugguacauguggcugggcgcucgguuccucgaauuugaggcccugggguucaugaacgaggaccacugguuuagccgcgaaaauucccuuucuggaguggagggcgaagggcugcauaagcucggauacauccugagagauaucagcaaaauucccggcgggaacauguaugccgacgauacagcuggcugggacacccggaucacggaggaugaccuucagaaugaggccaagauuacagauaucauggaaccugagcacgcucugcucgccaccuccauuuucaaacugacauaccagaacaagguugugcgcguccagagacccgcgaaaaacggaaccgugauggacgucaucucucggcgcgaucaaagaggcagcgggcaggugggaacguauggccugaauaccuuuacaaacauggaaguucagcucauccggcagauggaguccgaagggauuuuccugccgucugagcuugagaccccuaaucuggccgaaagagugcucgacuggcuggagaagcauggagcugaacgccuuaagcggauggccaucagcggcgacgauugugucgugaaacccauugacgauagauuugcuacagcccugaccgcgcucaacgacauggggaaggugcgcaaagauaucccucaaugggagcccuccaagggcuggaaugacuggcagcagguuccuuucugcagccaccacuuucaucagcugauuaugaaagauggacgggaaaucgugguccccuguagaaaccaagacgagcuggugggccgcgcccggguuucucagggggcuggauggucccucagagagacagccugccugggcaagagcuacgcucagauguggcaacuuauguauuuccaccgccgggaucugagacucgccgcuaaugccaucuguucugcggugccggucgacugggugccuaccucccgcacgacauggagcauucaugcccaccaccaguggaugaccaccgaagauaugcuguccgucuggaaccggguguggaucgaggaaaaucccuggauggaggacaagacacauguuucuagcugggaagaggugcccuaccuugggaaaagagaggaccaguggugcggaucccugauuggccucaccgcucgggccacaugggccacgaacauccaggucgcuauuaaucaagugagacgccugaucgggaacgaaaauuaucuggauuacaugaccagcaugaagcgguuuaaaaacgagucugacccugaaggcgcccucugguga

SEQ ID NO: 18800 - RNA, 9879 nt, Artificial Sequence
  derived and/or modified CDS sequence (opt5) from DENV-1__GQ199877__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccccccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagguguuugggaccgccuacggaguucuguucagcggcguguccuggacgaugaaaaucgggaucggcauucuucugaccuggcucggacugaauagccgcucuacaucccugagcaugaccuguaucgcugucggcauggugacacuuuaccucgggguuauggugcaggccgauucuggaugcgucauuaacuggaagggccgggagcugaaauguggguccggaaucuuugugaccaacgaaguucacacauggaccgagcaauauaaguuccaggcugacagcccuaagagacuguccgccgcgauuggcaaagccugggaggaaggggugugcggcauccgcucugcuacgcggcucgagaauauuauguggaagcagaucagcaacgaacugaaucauauccuucuggagaacgauaugaaauuuacagucguggugggagacgccaauggcauucucgcucaggggaagaaaaugaucagaccgcaacccauggaacacaaguacuccuggaaaucuuggggaaaggccaagauuaucggcgccgacauucagaacaccaccuucaucaucgaugggccugacacacccgaguguccugauggacagcgcgcuuggaauauuugggaggucgaagacuauggcuuuggcguuuucaccacgaacaucuggcugaaacugcgggauagcuacacacagaugugcgaccacagacuuauguccgcggccauuaaggauagcaaagcugugcaugccgacaugggguauuggaucgagucugaaaagaaugagaccuggaaacucgcccgcgcuuccuucauugaagugaagacauguaccuggcccaagagccacacacuguggucuaacggaguccuggaguccgagaugaucaucccgaaaauuuacggcgggccuaucagccaacauaauuaucggcccggauacuuuacccagacggccggcccuuggcaccucgggaagcuggaacuugauuucgaccugugcgagggaaccacagugguuguggaugaacacugcggcaacagaggccccucucuccggaccacaaccgucacggggaaaauuauccaugagugguguugccgcagcuguacacugccuccccugagauuucggggagaggacggcugcugguacgggauggaaauuagaccggugaaggagaaagaagagaaucuuguucgcuccauggugagcgcgggaucuggcgaagucgauuccuucagccucgggauccuguguguguccaucaugauugaggagguuaugcggucuagauggagccgcaagaugcugaugaccggaacacucgcuguguuucugcuucugaucaugggccagcucaccuggaacgaccugauuagacugugcaucauggucggcgccaaugccuccgaccggauggggaugggaaccacauaucuugcucugauggccacguucaagaugcgcccuauguuugcggugggccuccuguucagacggcucaccucucgcgaagugcugcuucugacaauugggcucagccuggucgcuuccguugagcugcccucuagccuugaagagcugggagauggccucgccauggggaucaugaugcugaaacuccugaccgaauuucaaccccaccagcuuuggacaacccugcucucccugacguucgugaagacaacccugagccuugacuacgccuggaaaaccacagcuauggugcugucuauugucucccucuuuccucugugucucagcaccacaucucagaagacgaccuggcugccggugcuucugggauccuucggcugcaaaccccugacaauguuucucaucaccgagaacaagaucuggggcagaaagagcuggccucugaacgaggggauuauggccaucggaauuguuucuauccuucuguccagccuccugaaaaaugaugugccccucgcuggcccucugauugccgggggaaugcuuaucgcguguuaugucaucuccggcagcucugccgaccugagccuggaaaaggcugccgagguguccugggaacaggaggcugaacauucuggggccagccacaacauucucguugaggugcaagaugacggaacaaugaaaaucaaggaugaggaacgggacgauacccugacgauucuucugaaagccacccuccuggcugucuccggcguguaccccaugucuaucccugcgacacucuucgucugguauuucuggcagaagaaaaagcagcgcagcggcgugcugugggacacccccuccccgccugagguugaaagagccgugcuugaugacgggauuuaccggauccugcagcgcggacugcucggcagaucucaagucggggugggaguuuuucaggauggcguguuccauacaauguggcacgucacccggggggcugugcugauguaucagggaaagagacuugagcccagcugggccuccgugaaaaaggaccugaucagcuacggcggcggguggcgcuuucagggaucuuggaauacaggcgaggaaguucaagucauugccguggagccugggaaaaaccccaagaaugugcagacgaccccgggaacauucaaaaccccugaaggcgaggucggggcuaucgcccucgacuuuaagcccggaaccuccggcagcccuauugugaaccgggaaggcaagaucguugggcuguacggaaauggcguggucacaacgucugggaccuauguguccgcgauugcucaggccaaagccagccaagagggaccccuccccgagaucgaagaugagguuuucaagaaaagaaaccugacaauuauggaccuucacccuggcuccgggaagacccgccgguaccugccggcuaucgugagagaagccaucaaacgcaagcugcggacacucauucuggcgcccaccagagucguggcuucugagauggccgaagcccuuaagggcaugccuauccgcuaucagacgacagcuguuaaaagcgagcauaccggacgggagauuguggaucugaugugccacgccaccuuuacaaugagacuccugucccccguccgggugccuaauuacaacaugaucauuauggacgaagcucauuucaccgaucccgccagcaucgcggcccgcggcuauaucucuacaagaguggggaugggagaggcugccgcuauuuuuaugaccgccacgccuccgggcuccgucgaagccuucccccagagcaaugcuguuauccaggacgaggaacgggauauuccugagcgcucuuggaacagcggguacgacuggaucacagauuuucccggaaagaccgugugguucgugccuuccauuaaaucuggcaaugacaucgcgaacugucugagaaagaaugggaaacgggucauccaacucagcagaaagacauucgauaccgaguaucagaagacgaaaaacaacgacugggacuacgugguuaccacagauauuuccgaaaugggcgccaauuuucgcgcugaccgggugaucgaucccagacgcugccuuaagccggucauucugaaagacggaccugagcgggugauccuggccggccccaugcccguuaccguggccucugcugcccagagacgcgggcggauuggaagaaaccagaauaaggaaggcgaucaauacgucuauauggggcagccucucaacaaugacgaggaucacgcgcauuggacagaggcuaaaaugcugcuugacaacaucaauacccccgaaggaauuaucccugcccuguucgagccggaacgcgagaagagcgccgcuaucgauggcgaauacagacuccggggggaggcccgcaagacauuuguggagcugaugagacggggcgaccugcccgucuggcucuccuauaaaguggcgagcgaaggauuccaguacucugaucgcagauggugcuuugacggcgagcggaacaaucagguucuugaagagaacauggauguggaaauuuggaccaaggagggggagagaaaaaagcugcgcccucgguggcuggacgccagaacguauuccgacccccucgcucugcgcgaauucaaagaguuugccgcuggacggagaagcguguccggcgaucuuauccuggaaauugggaagcucccucaacaccugacacugcgggcccagaaugcucucgacaaccuugucaugcugcacaauucugagcagggaggcaaagccuaccgccaugcgauggaagagcugcccgauaccaucgagacccucaugcugcuugcccugauugcuguucucacaggcggggugacccuguucuuucugagcggaaagggccucgggaagacauccaucggacuucugugugugacggccucuagcgcucugcucuggauggccuccgucgaaccgcacuggaucgccgcuagcauuauccuggaguucuuucuuauggugcugcucauuccugaacccgacagacagcggaccccucaagauaaccagcuggcguauguugugaucggccugcucuucaugauucuuacagucgccgcuaaugagauggggcugcuggagaccacaaaaaaggaccucggaaucggcuacguggccgccgaaaaccaucagcacgcuaccaugcuggaugucgaccuucaccccgccucugcguggacgcuguacgccguggcuaccacaguuaucaccccuaugaugcgccauacaauugagaacaccacggccaauaucucccucacagcuauugccaaccaagcggccauccugaugggccuggauaaaggguggcccauuagcaagauggacaucggagugccgcuccuugcucugggcugcuauucucaggucaauccucugacccucacagccgcugugcugaugcuuguugcccacuacgcuauuaucgggcccggacugcaggccaaagcgaccagagaagcccagaagcggaccgcugccggcaucaugaagaaccccacaguggaugggauugucgcuaucgaccucgauccugugguguaugacgccaaauuugagaagcaacugggacagauuaugcugcucauccuuuguacgucccagauucugcugaugcgcaccacaugggcccucugcgaaagcaucacccuggcgacaggcccgcuuaccacgcugugggagggcucucccgggaaauucuggaauacaaccaucgcuguuagcauggccaacauuuucagaggauccuaccucgcuggcgccgggcuggccuuuucucugaugaagagccucggaggcgggcggcgcggaaccggcgcucagggcgagacacuuggggaaaaauggaagagacaacugaaucagcuguccaagagcgaguucaacaccuauaaaaaguccggaaucauggaagucgaccggucugaggccaaagaaggccucaagagaggggagacaacgaaacaugcggugagccgcggaaccgccaagcugcggugguuuguggagagaaaucuugucaagccugaaggcaaaguuauugaucugggguguggacgcggcggcugguccuacuauugcgcugggcucaagaaagugacagaggugaagggauacaccaaaggcgggcccggacacgaagagccuauccccauggccacauacggcuggaaccuggucaagcugcauucugggaaagacguguucuuuaugccuccggaaaagugugauacccuccuuugcgacauuggagagagcucccccaauccuacgaucgaggaaggccggacccugagaguucugaagaugguggagcccuggcuccgcggcaaccaguucuguaucaaaauucugaauccuuauaugcccucugucguggaaacacuugagcagaugcaacggaagcacgggggaaugcugguuagaaacccgcucagccgcaauuccacccacgagauguacugggugagcugcggcacagggaacaucgucucugcugugaauaugaccucccggaugcugcugaacagauuuacaauggcccaucgcaaaccuaccuaugaacgggauguggaccucggagcgggcacgagacacgucgccguugagcccgaaguggcuaaccuggauauuaucgggcagcgcauugagaauaucaagaacgaacauaaaagcacauggcacuacgacgaggauaaucccuauaagaccugggccuaccacggaucuuaugaggugaagccuuccggcagcgcuucuuccauggucaacggcgugguuagacuucugaccaaacccugggacgugauuccuauggucacacagaucgccaugacggauaccacaccguucgggcaacagcggguguuuaaggaaaaaguugacacccgcacacccagagcuaagcggggaaccacacagaucauggaggugaccgccaaauggcucuggggcuuccugagcagaaauaagaagccucggauuuguacgcgcgaagaguuuaccagaaaaguccgguccaacgcggccaucggggcuguguucguugacgaaaaucaguggaacagcgccaaggaggcuguggaggaugaacgcuuuugggaccuuguccauagagagcgggaacugcacaaacaaggaaagugcgccacaugcguguacaauaugaugggcaaacgcgagaagaagcucggggaauucggcaaagccaagggaucuagagcgauuugguacauguggcugggcgcucgguuccuggaguuugaggcccucggguucaugaacgaagaucauugguuuagccgcgagaauucccugucuggagucgaaggcgaggggcuucacaaacugggauauauccucagagacauuagcaagauccccggcgggaacauguacgccgaugacaccgcuggcugggauacacggaucaccgaggacgaucugcagaaugaagccaaaauuacggacaucauggagccugaacaugcucuucuggccacauccauuuucaagcucaccuaucagaacaaagugguucgcgugcagagacccgcgaagaauggaacagucauggaugugaucucucggcgcgaccaaagaggcagcgggcaggugggaaccuacggccugaacacguuuaccaacauggagguucagcugauucggcagauggaauccgaggggaucuuccucccgucugagcuggaaacaccuaaucuugccgagagagcucuggauuggcucgaaaagcacggagccgagcgccugaaacggauggcuaucagcggcgacgacuguguggucaagcccauugaugacagauuugccaccgcgcuuacagcccugaacgauauggggaaagugcgcaaggacaucccucaaugggaacccuccaaaggcuggaaugauuggcagcagguuccuuucugcagccaccauuuucaccagcucauuaugaaggacggacgggagaucgugguccccuguagaaaccaagaugagcuggugggccgcgcucgggucucucagggggccggauggucccugagagaaaccgcuugccucggcaagagcuaugcccagauguggcaacugauguacuuccaucgccgggaccuuagacuggcugccaaugcgauuuguucugccgugccgguugauugggugccuacaucccgcaccacguggagcauccacgcucaccaucaguggaugacaaccgaggacaugcucuccgucuggaaccggguguggaucgaagagaaucccuggauggaagauaaaacccacguuucuagcugggaggaggugcccuaucuggggaagagagaagaccaguggugcggaucccuuauuggccugacagcccgggccaccugggcuacaaacauccaggucgccauuaaucaagugagacgccucaucgggaacgagaauuaccuggacuacaugacgagcaugaaacgguuuaagaacgaaucugauccugagggcgcgcugugguga

SEQ ID NO: 18801 - RNA, 9879 nt, Artificial Sequence
  derived and/or modified CDS sequence (opt5) from DENV-1__GU056029__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccccccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagguguuugggaccgccuacggaguucuguucagcggcguguccuggacgaugaaaaucgggaucggcauucuucugaccuggcucggacugaauagccgcucuacaucccugagcaugaccuguaucgcugucggcauggugacacuuuaccucgggguuauggugcaggccgauucuggaugcgucauuaacuggaagggccgggagcugaaauguggguccggaaucuuugugaccaacgaaguucacacauggaccgagcaauauaaguuccaggcugacagcccuaagagacuguccgccgcgauuggcaaagccugggaggaaggggugugcggcauccgcucugcuacgcggcucgagaauauuauguggaagcagaucagcaacgaacugaaucauauccuucuggagaacgauaugaaauuuacagucguggugggagacgccaauggcauucucguccaggggaagaaaaugaucagaccgcaacccauggaacacaaguacuccuggaaaucuuggggaaaggcuaagauuaucggcgccgacauucagaacaccaccuucaucaucgaugggccugacacacccgaguguccugauggacagcgcgccuggaauauuugggagguugaagacuauggcuuuggcguguucaccacgaacaucuggcugaaacugcgggauagcuacacacagaugugcgaccacagacuuauguccgcugcgauuaaggauagcaaagccgugcaugcugacaugggguauuggaucgagucugaaaagaaugagaccuggaaacucgcccgcgccuccuucauugaagucaagacauguaccuggcccaagagccacacacuguggucuaacggagugcuggaguccgagaugaucaucccgaaaauuuacggcgggccuaucagccaacauaauuaucggcccggauacuuuacccagacggcuggcccuuggcaccucgggaagcuggaacuugauuucgaccugugcgagggaaccacaguuguggucgaugaacacugcggcaacagaggccccucucuccggaccacaaccgugacggggaaaauuauccaugagugguguugccgcagcuguacacugccuccccugagauuucggggagaggacggcugcugguacgggauggaaauuagaccgguuaaggagaaagaagagaaucuugugcgcuccauggucagcgccggaucuggcgaaguggauuccuucagccucgggauccuguguguuuccaucaugauugaggaggugaugcggucuagauggagccgcaagaugcugaugaccggaacacucgcggucuuucugcuucugaucaugggccagcucaccuggaacgaccugauuagacugugcaucauggugggcgcuaaugccuccgaccggauggggaugggaaccacauaucuugcccugauggcuacguucaagaugcgcccuauguuugccgugggccuccuguucagacggcucaccucucgcgaaguccugcuucugacaauugggcucagccugguugcguccguggagcugcccaacucucuugaagagcugggagauggccucgcuauggggaucaugaugcugaaacuccugaccgaauuucaaccccaccagcuuuggacaacccugcucagccugacguucgugaagacagcccugucccuugacuacgccuggaaaaccaccgcuaugguccugagcauugugucucucuuuccucugugucucuccacaaccagccagaagacaacguggcugccgguucuucugggaucuuucggcugcaaaccccugaccauguuucucaucacagagaacaagaucuggggcagaaaguccuggccucugaaugaggggauuauggccaucggaauugugagcauccuucugucuucccuccugaaaaacgaugucccccucgcuggcccucugauugccgggggaaugcuuaucgcguguuaugugaucagcggcuccagcgccgaccugucucuggaaaaggcugccgagguuagcugggaacaggaggcugaacauuccggggccucucacaauauucucguggagguccaagaugacggaaccaugaaaaucaaggaugaggaacgggacgauacacugaccauucuucugaaagccacgcuccuggcugugagcggcgucuaccccauguccaucccugcgacccucuucgugugguauuucuggcagaagaaaaagcagcgcucuggcguucugugggacacacccagcccgccugagguggaaagagccguccuugauaacgggauuuaccggauccugcagcgcggacugcucggcagaucccaaguggggguuggaguguuucaggacggcgucuuccauaccauguggcacgugacacggggggcugugcugauguaucagggaaagagacuugagcccucuugggccagcguuaaaaaggaucugaucuccuacggcggcggguggcgcuuucagggaagcuggaauaccggcgaggaaguccaagugauugccguggagccugggaaaaaccccaagaauguccagacaacgccgggaaccuucaaaacaccugaaggcgaggugggggcuaucgcccucgacuuuaagcccggaaccucuggcuccccuauuguuaaccgggaaggcaagaucguggggcuguacggaaauggcgucgugaccacaagcgggacguauguuucugcgauugcucaggccaaagccucccaagagggaccccuccccgagaucgaagacgagguguucaagaaaagaaaccugaccauuauggaucuucacccuggcagcgggaagacacgccgguaccugccggcuaucgucagagaagccaucaaacgcaagcugcggacccucauucuggcgcccacaagagugguugcuuccgagauggccgaagcccuuaagggcaugccuauccgcuaucagaccacggcugugaaaucugagcauacaggacgggagauugucgaccugaugugccacgccaccuuuaccaugagacuccugagccccgugcgggugccuaauuacaacaugaucauuauggaugaagcucauuucacagaccccgccuccaucgcggcccgcggcuauaucagcaccagagucgggaugggagaggcugccgcuauuuuuaugacagccaccccuccgggcucuguugaagccuucccccaguccaaugcugugauccaggaugaggaacgggacauuccugagcgcagcuggaacucuggguacgauuggaucacggacuuucccggaaagacagugugguucgucccuagcauuaaauccggcaaugauaucgcgaacugucugagaaagaacgggaaacgggugauccaacucucuagaaagaccuucgacacagaguaucagaagaccaaaaauaacgauugggacuacguugugacgaccgacauuagcgaaaugggcgccaauuuucgcgcugaucgggucaucgaccccagacgcugccuuaagccggugauucugaaagauggaccugagcggguuauccuggccggccccaugcccgugacagucgccuccgcugcccagagacgcgggcggauuggaagaaaccagaauaaggaaggcgaccaauacguguauauggggcagccucucaacaaugaugaggaccacgcgcauuggaccgaggcuaaaaugcugcuugauaacaucaauacacccgaaggaauuaucccugcccuguucgagccggaacgcgagaagucugccgcuaucgacggcgaauacagacuccggggggaggcccgcaagaccuuugucgagcugaugagacggggcgaucugcccguguggcucagcuauaaaguugcguccgaaggauuccaguacagcgaccgcagauggugcuuugauggcgagcggaacaaucaggugcuugaagagaacauggacguggaaauuuggacaaaggagggggagagaaaaaagcugcgcccucgguggcuggaugccagaaccuauucugacccccucgcucugcgcgaauucaaagaguuugccgcuggacggagauccgucagcggcgaccuuauccuggaaauugggaagcucccucaacaccugacgcugcgggcccagaaugcucucgauaaccuuguuaugcugcacaauuccgagcagggaggcaaagccuaccgccaugcgauggaagagcugcccgacacaaucgagacccucaugcugcuugcccugauugcugugcucaccggcggggugacacuguucuuucugucuggaaagggccucgggaagaccagcaucggacuucugugugucacagccuccucugcucugcucuggauggccagcguggaaccgcacuggaucgccgcuuccauuauccuggaguucuuucuuaugguucugcucauuccugaacccgauagacagcggacgccucaagacaaccagcuggcguauguggucaucggccugcucuucaugauucuuaccguggccgcuaacgagauggggcugcuggagacaaccaaaaaggaucucggaaucggcuacgucgccgccgaaaaucaucagcacgcuacaaugcuggacguggaucuucaccccgccagcgcguggacccuguacgccguugcuacgaccgugaucacaccuaugaugcgccauaccauugagaacacaaccgccaauaucucucucacggcuauugccaaccaagcggccauccugaugggccuggacaaaggguggcccauuuccaagauggauaucggagucccgcuccuugcucugggcugcuauagccaggugaauccucugacacucaccgccgcuguucugaugcuuguggcccacuacgcuauuaucgggcccggacugcaggccaaagcgacaagagaagcccagaagcggaccgcugccggcaucaugaagaaccccaccgucgacgggauuguggcuaucgaucucgacccugugguuuaugaugccaaauuugagaagcaacugggacagauuaugcugcucauccuuuguacaucucagauucugcugaugcgcacgaccugggcccucugcgaauccaucacacuggcgaccggcccgcuuacaacccugugggagggcagccccgggaaauucuggaauacgacaaucgcugucucuauggccaacauuuucagaggaagcuaccucgcuggcgccgggcuggccuuuucccugaugaagucucucggaggcgggcggcgcggaaccggcgcucagggcgagacccuuggggaaaaauggaagagacaacugaaucagcugagcaaguccgaguucaacacauauaaacggagcggaaucauggaaguggacagauccgaggccaaggaaggccucaaacgcggggagaccacaaagcaugcggugucucggggaacggccaaacugagaugguuugucgagcgcaaucuuguuaagccugaaggcaaggugauugaccugggguguggacggggcggcuggagcuacuauugcgcugggcucaaaaaggugaccgaggucaaaggauacacaaagggcgggcccggacacgaagagccuauccccauggccaccuacggcuggaaccuggugaaacugcauuccgggaaggauguuuucuuuaugccuccggaaaaaugugacacacuccuuugcgauauuggagagucuagccccaauccuaccaucgaggaaggcagaacgcugcgcgugcugaagauggucgagcccuggcuccggggcaaccaguucuguaucaagauucugaauccuuauaugcccuccgugguugaaacccuugagcagaugcaaagaaaacacgggggaaugcuggugcgcaacccgcucucucggaauagcacacacgagauguacugggucuccugcggcaccgggaacaucgugagcgcugugaacaugacaucuagaaugcugcugaaucgcuuuaccauggcccaucggaagccuacauaugaaagagacgucgaucucggagcgggcacccgccacguugccguggagcccgaaguggcuaaccuggacauuaucgggcagagaauugagaauaucaaaaacgaacauaaguccacguggcacuacgaugaggacaaucccuauaaaacaugggccuaccacggaagcuaugaggucaagccuucuggcuccgcuagcucuauggugaacggcguugugcggcuucugaccaagcccugggaugucauuccuauggugacccagaucgccaugacagacacgaccccguucgggcaacagcgcguuuuuaaagaaaagguggauacaagaaccccccgggcuaaaagaggaacaacccagaucauggaggucacagccaaguggcucuggggcuuccugucccggaauaaaaagccucgcauuuguaccagagaagaguuuacgcggaaggugcgcagcaacgcggccaucggggcuguuuucguggacgaaaaucaguggaacuccgccaaagaggcugucgaggacgaaagauuuugggaucuugugcaucgggagcgcgaacugcacaagcaaggaaaaugcgccaccugcgucuacaauaugaugggcaagagagagaaaaagcucggggaauucggcaaggccaaaggaagccgggcgauuugguacauguggcugggcgcucgcuuccuggaguuugaggcccucggguucaugaacgaagaccauugguuuucuagagagaauagccuguccggaguggaaggcgaggggcuucacaagcugggauauauccuccgggauauuucuaaaauccccggcgggaacauguacgccgacgauacagcuggcugggacacccgcaucacagaggaugaccugcagaaugaagccaagauuaccgauaucauggagccugaacaugcucuucuggccacgagcauuuucaaacucacauaucagaacaagguugugagaguccagcggcccgcgaaaaacggaaccgugauggacgugaucucccgcagagaucaacggggcucugggcagguuggaacauacggccugaauaccuuuacgaacauggaggugcagcugauuagacagauggaaagcgaggggaucuuccucccguccgagcuggaaaccccuaaucuugccgagcgcgcucuggacuggcucgaaaagcacggagccgagcggcugaagagaauggcuaucucuggcgaugacugugucgugaaacccauugacgaucgcuuugccacagcgcuuaccgcccugaacgacauggggaagguucggaaagauaucccucaaugggaacccagcaagggcuggaaugacuggcagcaggugccuuucugcucccaccauuuucaccagcucauuaugaaagauggaagagagaucgucgugcccugucgcaaccaagacgagcuggucggccgggcuagagugagccagggggccggauggucucugcgcgaaacagcuugccucggcaaguccuaugcccagauguggcaacugauguacuuccaucggagagaucuucgccuggcugccaaugcgauuuguagcgccguuccgguggacugggucccuaccucucggacaaccugguccauccacgcucaccaucaguggaugacgacagaggauaugcucagcguguggaacagaguuuggaucgaagagaaucccuggauggaagacaagacccacguguccucuugggaggagguccccuaucuggggaaacgggaagaucaguggugcggaagccuuauuggccugaccgccagagccacaugggcuaccaacauccagguggccauuaaucaagugcgccggcucaucgggaacgagaauuaccuggacuacaugacauccaugaagagauuuaaaaacgaaagcgacucugagggcgcgcugugguga

SEQ ID NO: 18802 - RNA, 9879 nt, Artificial Sequence
  derived and/or modified CDS sequence (opt5) from DENV-1__GU056030__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugcgguacgaaggcaccgacgcgccgugcaagauuccuuuuucuacacaagaugagaaaggggucacccagaacggaagacuuaucacagcuaaucccaucgugacggacaaggaaaaaccugugaacauugagaccgagccccccuucggcgaauccuauaucguugucggggccggagagaaggcccucaaacugagcugguuuaagcgcggcucuagcauugggaagauguucgaagcuacagcccggggcgcuagacgcauggccauccugggagauaccgcgugggacuuuggcuccauugggggaguguucacaucugugggcaaacucguccaucagguguuugggaccgccuacggaguucuguucagcggcguguccuggacgaugaagaucgggaucggcauucuucugaccuggcucggacugaauagccggucuacaucccugagcaugaccuguaucgcugucggcauggugacacuuuaccucgggguuauggugcaggccgauucuggaugcgucauuaacuggaaaggcagagagcugaaguguggguccggaaucuuugugaccaacgaaguucacacauggaccgagcaauauaaauuccaggcugacagcccuaagcgccuguccgccgcgauuggcaaggccugggaggaaggggugugcggcauccggucugcuacgagacucgagaauauuauguggaaacagaucagcaacgaacugaaucauauccuucuggagaacgauaugaaguuuacagucguggugggagacgccaauggcauucucgcucaggggaaaaagaugauccgcccgcaacccauggaacacaaauacuccuggaagucuuggggaaaagccaagauuaucggcgccgacauucagaacaccaccuucaucaucgaugggccugacacacccgaguguccugauggacagcgggcuuggaauauuugggaggucgaagacuauggcuuuggcaucuucaccacgaacauuuggcugaagcugagagauagcuacacacagaugugcgaccaccgccuuauguccgcggccaucaaagauagcaaggcuguucaugccgacaugggguauuggauugagucugaaaaaaaugagaccuggaagcucgcccgggcuuccuucaucgaagugaaaacauguaccuggcccaagagccacacacuguggucuaacggagugcuggaguccgagaugaucauuccgaagaucuacggcgggccuauuagccaacauaauuauagacccggauacuacacccagacggccggcccuuggcaccucgggaaacuggaacuugauuuugaccugugcgagggaaccacagucgugguugaugaacacugcggcaaccggggccccucucuccgcaccacaaccgugacggggaagaucauucaugagugguguugcagaagcuguacacugccuccccugcgguucagaggagaggacggcugcugguaugggauggaaauccgcccggucaaagagaaggaagagaaucuugugcgguccaugguuagcgcgggaucuggcgaaguggauaacuuuucccucgggauccugugugucagcauuaugaucgaggaggugaugagaucccgcuggucuagaaaaaugcugaugaccggaacacucgcuguuuuccugcuucugauuaugggccagcucaccuggaaugaccugauccggcugugcauuauggugggcgccaacgccagcgacgggaugggaaugggcaccacauaccuugcucugauggccacguuuaagaugcgcccuauguucgcggucgggcuccuguuuagacggcucaccucccgcgaagugcugcuucugacaaucggacucucucugguggcuagcgucgagcugcccaacucccuugaagagcugggcgaugggcucgccaugggaauuaugaugcugaagcuccugaccgaauuccaaccccaccagcuuuggacaacccugcucucucugacguuuguuaaaacaacccugagccuugacuaugccuggaagaccacagcuauggugcuguccaucgugagccucuucccucugugucucucuaccacaucccagaaaacgaccuggcugccgguccuucugggcagcuuuggcugcaagccccugacaauguuccucaucaccgagaauaaaauuugggggagaaagucuuggccucugaacgagggaaucauggccauuggcaucguguccauucuucugagcucucuccugaagaaugauguuccccucgcugggccucugaucgccggaggcaugcuuaucgcguguuacgugauuuccgggagcuccgccgaccugagccuggauaaagcugccgaagucucuugggagcaggaagcugagcauagcggagccucccacaacaucucuguggaaguucaagacgauggcacaaugaagauuaaagacgaggagcgggaugacacccucacgauccugcuuaaggccacccugcucgcugugagcggcgucuaucccauguccauuccugcgacacuguuugugugguacuucuggcagaaaaagaaacagcgcucugggguccucugggauacccccagcccgccugaaguggagagagccguucuggacgauggaaucuaucggauccuucagcgcggccugcuggggagaucccaagugggagucggcguguuccaggacgggguuuuucauacaauguggcacgugacccggggagcuguccucauguaccagggcaagagacuggaacccucuugggccugcgugaagaaagaccuuauuagcuacggcgggggauggcgcuuccagggcuccuggaauacaggggaggaggugcaaguuaucgccgucgaaccuggaaagaaccccaaaaaugugcagacgaccccgggcacauuuaagaccccugagggggaagugggagcuauugcccuggauuucaaacccggcaccagcggcucuccuaucgucaaccgggaggggaagauugugggacucuauggcaaugggguugugacaacguccggaaccuacgucagcgcgaucgcucaggccaaggccucucaagaaggcccccugcccgagauugaggacgaaguguuuaaaaagagaaaccucacaaucauggaucugcacccuggguccggcaaaacccgccgguaucuuccggcuaucguuagagaggccauuaagcgcaaacugcggacacugauccucgcgcccaccagaguggucgcuagcgaaauggccgaggcccugaagggaaugccuauucgcuaccagacgacagcugugaaguccgaacauaccggccgggagaucguugaccuuaugugucacgccaccuucacaaugagacugcucucucccgugcgggucccuaauuauaacaugauuaucauggaugaggcucauuuuaccgaccccgccagcaucgcggcccgcggguacauuuccacaagagugggaaugggcgaagcugccgcuaucuucaugaccgccacgccuccggggagcguggaggccuuuccccagucuaaugcugucauucaggaugaagagcgggacaucccugaacgcuccuggaacagcggauaugauuggauuacagacuuccccggcaaaaccguuugguuugugccuucuaucaagagcgggaaugauaucgcgaacugccugagaaaaaacggcaagcgggugauucaacuguccagaaaaacauucgacaccgaguaccagaagacgaagaauaacgacugggauuacgucgugaccacagacaucucugagaugggagccaauuuccgcgcugaucggguuauugaccccagacgcugccucaaaccggugauccuuaaggauggcccugaacgggucauucuggccgggcccaugcccgugaccguugccagcgcugcccagagacgcggacggaucggcagaaaccagaauaaagagggggaccaauauguguacaugggacagccucugaacaaugaugaagaccacgcgcauuggacagaggcuaagaugcuccuggauaacauuaauacccccgagggcaucaucccugcccuuuuugaaccggagcgcgaaaaauccgccgcuauugacggggaguauagacugcggggcgaagcccgcaagacauucgucgagcucaugagacggggagaucugcccguguggcugucuuacaaggucgcgagcgagggcuuucaguauuccgaccgcagaugguguuucgauggggaacggaacaaucaggugcucgaggaaaacauggacguugagaucuggaccaaagaaggagagagaaagaaacuucgcccucgguggcuggacgccagaacguacagcgauccccuggcucuccgcgaguuuaaggaauucgccgcuggccggagaucuguguccggggaccugauucuugagaucggaaaacugccucaacaccucacacugcgggcccagaaugcucuggauaaccucgugaugcuucacaauagcgaacagggcggcaaggccuaucgccaugcgauggaggaacugcccgacaccauugagacccugaugcuccuggcccuuaucgcuguccugacagggggaguuacccucuuuuuccuguccggcaaagggcugggaaagacaucuaucggccuccuuugcgugacggccagcuccgcucugcuguggauggccucuguggagccgcacuggauugccgcuagcaucauucucgaauuuuuccugaugguccuucugaucccugagcccgauagacagcggaccccucaagacaaccagcucgcguacgugguuauugggcugcuguuuaugauccucacaguggccgcuaacgaaaugggacuucuggagaccacaaagaaagaucugggcaucggcuacgucgccgccgagaaucaucagcacgcuaccaugcucgacguggaucugcaccccgccuccgcguggacgcuuuaugccgucgcuaccacagugauuaccccuaugaugcgccauacaaucgaaaacaccacggccaauauuagccugacagcuaucgccaaccaagcggccauucucauggggcuggacaagggauggcccaucucuaaaauggauauuggcguuccgcugcucgcucuuggguguuacucccaggugaauccucugacccugacagccgcuguccucaugcugguggcccacuaugcuaucaucggacccggccuucaggccaaggcgaccagagaggcccagaaacggaccgcugccgggauuaugaagaaccccacaguugacggaaucguggcuauugaucuggacccugucguguacgacgugaaguucgaaaaacaacucggccagaucaugcugcugauucucugcacgagccagauccuucugaugcgcaccacaugggcccugugugagucuaucacccucgccacaggcccgcugaccacgcuuugggaagggucccccggaaaguuuuggaauacaaccauugcgguuagcauggcuaacaucuucagaggcucuuaucuggccggggcuggacucgccuucagccugaugaaaucccugggcgggggacggcgcggcaccggcgcccagggggagacacucggagagaaguggaaaagacaacuuaaucagcugucuaagagcgaauuuaacaccuacaagcgguccggcauuauggaggucgauagaagcgaagcuaaagaggggcugaagcgcggagaaacaacgaaucaugccgugucccggggcaccgcgaaacucagaugguucguggagcgcaaccuggucaagccugaggggaaaguuaucgaccuuggaugcggccggggcggguggucuuauuacugugccggacugaagaaggugacagaagugaaaggcuacaccaaggggggacccggccacgaggaaccuauucccauggcuacauauggguggaaucucgucaaacugcauagcggaaaggauguguuuuucaugccuccggagaaaugcgacacccugcucugugauaucggcgaauccucucccaacccuacgaucgaggagggcagaacccuucgcguucugaagaugguggaacccuggcugcgggggaaucaguuuugcauuaaaauccucaacccuuacaugcccagcgucguggagacacuggaacagaugcaaagaaagcacggaggcaugcuuguucgcaauccgcugucccggaacucuacccacgagauguauugggugagcugugggacaggaaacauugucuccgccgugaauaugaccagcagaaugcuccugaaccgcuucacaauggcucaucggaagccuaccuacgagagagacguggaucugggcgccgggacgcgccacgucacaguugaacccgagguggcgaaucucgacaucauuggacagagaaucgaaaacauuaaaaaugagcauaagucuaccuggcacuaugaugaagacaaccccuacaaaaccugggccuaucacggcuccuacgaggugaagccuagcggcucugcuuccagcauggucaauggggugguucggcugcuuacaaaacccugggaugugaucccuauggucacgcagaucgccaugaccgacacaaccccguuuggacaacagcgcguguucaaggagaagguugacacaagaaccccccgggcuaaaagaggcacaacccagauuauggaagugacggccaaguggcuguggggguuucucucucggaacaaaaagccucgcaucugcaccagagaggaauucacacggaaaguccgcuccaaugcugccauuggagcgguguuuguugaugagaaccaguggaauagcgccaaggaagcuguggaggacgagagauucugggaucugguccaucgggaacgcgagcuucacaagcaaggcaaaugcgccaccuguguguacaacaugauggggaagagagaaaaaaagcugggcgaguuuggaaaagcuaagggcucccgggccaucugguauauguggcucggggcccgcuuccuggaauucgaggcgcugggauuuaugaaugaggaccauugguucagcagagaaaacucucucagcggcgucgagggggaaggacugcacaagcuuggcuacauucugcgggauaucuccaaaauccccgggggcaauauguaugcugacgauacagccggaugggacacccgcauuacggaggaugaccuccagaacgaggccaagaucacagauauuauggaaccugagcaugcucugcuugccaccucuaucuuuaaacugacauaccagaacaaggugguuagagugcagcggcccgcuaaaaauggcaccgucauggacgugauuagccgcagagaucaacggggguccggacaggugggcacguaugggcucaacaccuucacaaauauggaaguucagcugaucagacagauggagucugaaggaaucuuucugccgagcgagcucgagaccccuaaccuggccgaacgcgugcuugacuggcuggagaagcacggcgcggaacggcucaaaagaauggccauuuccggggacgauugcgucgugaagcccaucgacgaucgcuucgcuacagcccugaccgcucuuaaugacaugggcaagguucggaaagauauuccucaaugggagcccucuaagggauggaacgacuggcagcaggugccuuuuuguagccaccauuuccaccagcugaucaugaaagauggcagagaaauugucgugcccugccgcaaucaagacgagcucgucgggcgggccagagugucccagggagcgggcuggagccugcgcgagacagccugucuggggaagucuuacgcucagauguggcaacucauguauuuucaucggagagaucugcgccuugccgcuaacgccaucugcuccgcuguuccgguggacugggucccuaccagccggacgacauggucuauccacgcccaccaucaguggaugaccaccgaagauaugcuguccguguggaauagaguuuggauugaggaaaaccccuggauggaggacaaaacacacgugagcuccugggaagagguccccuaccucggaaagcgggaggaccagugguguggcucucugaucgggcuuaccgcgagagccacaugggcuacgaauauucagguggccaucaaccaagugcgccggcugauuggcaaugaaaacuaccucgauuauaugaccagcaugaagagauucaaaaaugaguccgacccugaaggagcccugugguga

SEQ ID NO: 18803 - RNA, 9879 nt, Artificial Sequence
  derived and/or modified CDS sequence (opt5) from DENV-1__GU056031__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccccccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagguguuugggaccgccuacggaguucuguucagcggcguguccuggacgaugaaaaucgggaucggcauucuucugaccuggcucggacugaauagccgcucuacaucccugagcaugaccuguaucgcugucggcauggugacacuuuaccucgggguuauggugcaggccgauucuggaugcgucauuaacuggaagggccgggagcugaaauguggguccggaaucuuugugaccaacgaaguucacacauggaccgagcaauauaaguuccaggcugacagcccuaagagacuguccgccgcgauuggcaaagccugggaggaaggggugugcggcauccgcucugcuacgcggcucgagaauauuauguggaagcagaucagcaacgaacugaaucauauccuucuggagaacgauaugaaauuuacagucguggugggagacgccaauggcauucucgcucaggggaagaaaaugaucagaccgcaacccauggaacacaaguacuccuggaaaucuuggggaaaggccaagauuaucggcgccgacauucagaacaccaccuucaucaucgaugggccugacacacccgaguguccugauggacagcgcgcuuggaauauuugggaggucgaagacuauggcuuuggcguuuucaccacgaacaucuggcugaaacugcgggauagcuacacacagaugugcgaccacagacuuauguccgcggccauuaaggauagcaaagcugugcaugccgacaugggguauuggaucgagucugaaaagaaugagaccuggaaacucgcccgcgcuuccuucauugaagugaagacauguaccuggcccaagagccacacacuguggucuaacggaguccuggaguccgagaugaucaucccgaaaauuuacggcgggccuaucagccaacauaauuaucggcccggauacuuuacccagacggccggcccuuggcaccucgggaagcuggaacuugauuucaaccugugcgagggaaccacagugguuguggacgaacacugcggcaauagaggccccucucuccggaccacaaccgucacggggaaaauuauccaugagugguguugccgcagcuguacacugccuccccugagauuucggggagaggauggcugcugguacgggauggaaauuagaccggugaaggagaaagaagagaaccuuguucgcuccauggugagcgcgggaucuggcgaagucgacuccuucagccucgggauccuguguguguccaucaugauugaggagguuaugcggucuagauggagccgcaagaugcugaugaccggaacacucgcuguguuucugcuucugaucaugggccagcucaccuggaaugaucugauuagacugugcaucauggucggcgccaacgccuccgaccggauggggaugggaaccacauaucuugcucugauggccacguucaagaugcgcccuauguuugcggugggccuccuguucagacggcucaccucucgcgaagugcugcuucugacaauugggcucagccuggucgcuuccguugagcugcccaacucucuugaagagcugggagacggccucgccauggggaucaugaugcugaaacuccugaccgaauuucaaccccaccagcuuuggacaacccugcucagccugacguucgugaagacaacccugucccuugauuacgccuggaaaaccacagcuauggugcugagcauugucucucucuuuccucugugucucuccaccacaagccagaagacgaccuggcugccggugcuucugggaucuuucggcugcaaacccuccacaauguuucugaucaccgagaauaagaucuggggcagaaagagcuggccucucaacgaggggauuauggccaucggaauuguuucuauccugcuuuccagccugcucaaaaaugacgugccccuggcuggcccucucauugccgggggaaugcugaucgcguguuaugucaucuccggcagcucugccgaucuuagccuggaaaaggcugccgagguguccugggaacaggaggcugaacauucuggggccagccacaacauucugguugaggugcaagacgauggaacaaugaaaaucaaggacgaggaacgggaugacacccucacgauucugcuuaaagccacccugcucgcugucuccggcguguaccccaugucuaucccugcgacacuguucgucugguauuucuggcagaagaaaaagcagcgcagcggcgugcucugggauacccccuccccgccugagguugaaagagccgugcuggacgaugggauuuaccggauccuucagcgcggacugcugggcagaucucaagucggggugggaguuuuucaggacggcguguuccauacaauguggcacgucacccggggggcugugcucauguaucagggaaagagacuggagcccagcugggccuccgugaaaaaggaucuuaucagcuacggcggcggguggcgcuuucagggaucuuggaauacaggcgaggaaguucaagucauugccguggagccugggaaaaaccccaagaaugugcagacgaccccgggaacauucaaaaccccugaaggcgaggucggggcuaucgcccuggacuuuaagcccggaaccuccggcagcccuauugugaaccgggaaggcaagaucguugggcucuacggaaauggcguggucacaacgucugggaccuauguguccgcgauugcucaggccaaagccagccaagagggaccccugcccgagaucgaagacgagguuuucaagaaaagaaaccucacaauuauggaucugcacccuggcuccgggaagacccgccgguaccuuccggcuaucgugagagaagccaucaaacgcaagcugcggacacugauucucgcgcccaccagagucguggcuucugagauggccgaagcccugaagggcaugccuauccgcuaucagacgacagcuguuaaaagcgagcauaccggacgggagauuguggaccuuaugugccacgccaccuuuacaaugagacugcucucccccguccgggugccuaauuacaacaugaucauuauggaugaagcucauuucaccgaccccgccagcaucgcggcccgcggcuauaucucuacaagaguggggaugggagaggcugccgcuauuuuuaugaccgccacgccuccgggcuccgucgaagccuucccccagagcaaugcuguuauccaggaugaggaacgggacauuccugagcgcucuuggaacagcggguacgauuggaucacagacuuucccggaaagaccgugugguucgugccuuccauuaaaucuggcaaugauaucgcgaacugucugagaaagaacgggaaacgggucauccaacugagcagaaagacauucgacaccgaguaucagaagacgaaaaauaacgauugggacuacgugguuaccacagacauuuccgaaaugggcgccaauuuucgcgcugaucgggugaucgaccccagacgcugccucaagccggucauucuuaaagauggaccugagcgggugauccuggccggccccaugcccguuaccguggccucugcugcccagagacgcgggcggauuggaagaaaccagaauaaggaaggcgaccaauacgucuauauggggcagccucugaacaaugaugaggaccacgcgcauuggacagaggcuaaaaugcuccuggauaacaucaauacccccgaaggaauuaucccugcccuuuucgagccggaacgcgagaagagcgccgcuaucgacggcgaauacagacugcggggggaggcccgcaagacauuuguggagcucaugagacggggcgaucugcccgucuggcuguccuauaaaguggcgagcgaaggauuccaguacucugaccgcagauggugcuuugauggcgagcggaacaaucagguucucgaagagaacauggacguggaaauuuggaccaaggagggggagagaaaaaagcuucgcccucgguggcuggaugccagaacguauuccgacccccuggcucuccgcgaauucaaagaguuugccgcuggacggagaagcguguccggcgaccugauccuugaaauugggaagcugccucaacaccucacacugcgggcccagaaugcucuggauaaccucgucaugcuucacaauucugagcagggaggcaaagccuaccgccaugcgauggaagagcugcccgacaccaucgagacccugaugcuccuggcccuuauugcuguucugacaggcggggugacccucuucuuucugagcggaaagggccuggggaagacauccaucggacuccuuugugugacggccucuagcgcucugcuguggauggccuccgucgaaccgcacuggaucgccgcuagcauuauccucgaguucuuucugauggugcuucugauuccugaacccgauagacagcggaccccucaagacaaccagcucgcguauguugugaucggccugcuguucaugauucucacagucgccgcuaacgagauggggcuucuggagaccacaaaaaaggaucugggaaucggcuacguggccgccgaaaaucaucagcacgcuaccaugcucgacgucgaucugcaccccgccucugcguggacgcuuuacgccguggcuaccacaguuaucaccccuaugaugcgccauacaauugagaacaccacggccaauaucucccugacagcuauugccaaccaagcggccauccucaugggccuggacaaaggguggcccauuagcaagauggauaucggagugccgcugcucgcucuuggcugcuauucucaggucaauccucugacccugacagccgcugugcucaugcugguugcccacuacgcuauuaucgggcccggacuucaggccaaagcgaccagagaagcccagaagcggaccgcugccggcaucaugaagaaccccacaguggacgggauugucgcuaucgaucuggacccugugguguaugaugccaaauuugagaagcaacucggacagauuaugcugcugauccucuguacgucccagauucuucugaugcgcaccacaugggcccugugcgaaagcaucacccucgcgacaggcccgcugaccacgcuuugggagggcucucccgggaaauucuggaauacaaccaucgcuguuagcauggccaacauuuucagaggauccuaccuggcuggcgccgggcucgccuuuucucugaugaagagccugggaggcgggcggcgcggaaccggcgcucagggcgagacacucggggaaaaauggaagagacaacuuaaucagcuguccaagagcgaguucaacaccuauaaacgguccggaaucauggaagucgacagaucugaggccaaggaaggccugaaacgcggggagacaacgaagcaugcggugagccggggaaccgccaaacucagaugguuuguggagcgcaaucuggucaagccugaaggcaagguuauugaccuuggguguggacggggcggcugguccuacuauugcgcugggcugaaaaaggugacagaggugaaaggauacaccaagggcgggcccggacacgaagagccuauccccauggccacauacggcuggaaccucgucaaacugcauucugggaaggauguguucuuuaugccuccggaaaaaugugacacccugcucugcgauauuggagagagcucccccaauccuacgaucgaggaaggcagaacccuucgcguucugaagaugguggagcccuggcugcggggcaaccaguucuguaucaagauucucaauccuuauaugcccucugucguggaaacacuggagcagaugcaaagaaaacacgggggaaugcuuguucgcaacccgcugagccggaauuccacccacgagauguacugggugagcugcggcacagggaacaucgucucugcugugaacaugaccuccagaaugcuccugaaucgcuuuacaauggcccaucggaagccuaccuaugaaagagacguggaucugggagcgggcacgcgccacgucgccguugagcccgaaguggcuaaccucgacauuaucgggcagagaauugagaauaucaaaaacgaacauaagagcacauggcacuacgaugaggacaaucccuauaaaaccugggccuaccacggaucuuaugaggugaagccuuccggcagcgcuucuuccauggucaacggcgugguucggcugcuuaccaagcccugggaugugauuccuauggucacacagaucgccaugacggacaccacaccguucgggcaacagcgcguguuuaaagaaaagguugauaccagaacaccccgggcuaaaagaggaaccacacagaucauggaggugaccgccaaguggcuguggggcuuccucagccggaauaaaaagccucgcauuuguacgagagaagaguuuacccggaagguccgcuccaacgcggccaucggggcuguguucguugacgaaaaucaguggaacagcgccaaagaggcuguggaggacgaaagauuuugggaucugguccaucgggagcgcgaacuucacaagcaaggaaaaugcgccacaugcguguacaauaugaugggcaagagagagaaaaagcugggggaauucggcaaggccaaaggaucucgggcgauuugguacauguggcucggcgcucgcuuccuggaguuugaggcccugggguucaugaacgaagaccauugguuuagcagagagaauucccucucuggagucgaaggcgaggggcugcacaagcuuggauauauccugcgggauauuagcaaaauccccggcgggaacauguacgccgacgauaccgcuggcugggacacacgcaucaccgaggaugaccuccagaaugaagccaagauuacggauaucauggagccugaacaugcucugcuugccacauccauuuucaaacugaccuaucagaacaaggugguuagagugcagcggcccgcgaaaaacggaacagucauggacgugaucucucgcagagaucaacggggcagcgggcaggugggaaccuacggccucaauacguuuaccaacauggagguucagcugauuagacagauggaauccgaggggaucuuccugccgucugagcucgaaacaccuaaucuggccgagcgcgcucuugacuggcuggaaaagcacggagccgagcggcucaagagaauggcuaucagcggcgaugacuguguggucaaacccauugacgaucgcuuugccaccgcgcugacagcccuuaacgacauggggaaggugcggaaagauaucccucaaugggaacccuccaagggcuggaaugacuggcagcagguuccuuucugcagccaccauuuucaccagcugauuaugaaagauggaagagagaucgugguccccugucgcaaccaagacgagcucgugggccgggcuagagucucucagggggccggauggucccugcgcgaaaccgcuugccugggcaagagcuaugcccagauguggcaacucauguacuuccaucggagagaucugcgccuugcugccaaugcgauuuguucugccgugccgguugacugggugccuacaucccggaccacguggagcauccacgcucaccaucaguggaugacaaccgaggauaugcuguccgucuggaacagaguguggaucgaagagaaucccuggauggaagacaagacccacguuucuagcugggaggaggugcccuaucucgggaaacgggaagaucaguggugcggaucccugauuggccuuacagccagagccaccugggcuacaaacauccaggucgccauuaaucaagugcgccggcugaucgggaacgagaauuacagcgacuacaugacgucuaugaagagauuuaaaaacgaauccgacccugagggcgcgcucugguga

SEQ ID NO: 18804 - RNA, 9879 nt, Artificial Sequence
  derived and/or modified CDS sequence (opt5) from DENV-1__GU056032__SS-prME
agcguggccaugcugcucaugcugcuucccaccgcucuggccuuccaccucacaacgagaggcggggagccucauaugaucgucuccaagcaggaacggggaaaaucucugcuuuuuaagaccagcgcgggcguuaacaugugcacacugauugcuauggaccucggggagcugugugaagauaccaugacauacaaaugcccgcgcaucaccgaggccgaacccgacgauguggacuguuggugcaaugccacagauaccugggugacguauggaaccuguucccaaacaggcgagcacagacgggacaagcgcucugucgcucuggccccucauguggggcucggacuggagaccagaacagaaaccuggaugagcuccgagggcgcuuggaaacagauucagcggguugaaacgugggcccuucgccaccccggcuucacagugaucgcgcuguuucucgcccaugcuauugggaccucuaucacacagaagggaaucauuuucauccugcuuaugcuggucaccccuagcauggccaugagaugcgugggcauugggaaccgggauuuuguugagggacucuccggcgcuaccuggguggacgucgugcuggagcacgggagcugugugacaacgauggccaagaauaaacccacccuggauaucgaacuccugaagacagaggucaccaacccugcgguucuucgcaaacugugcauugaagccaagaucucuaauacaaccacggacuccagauguccgacacaaggagaggcuacccucguggaagagcaggaugccaacuucgugugccggcgcaccuuugucgacagaggcuggggcaauggguguggacuguucggcaaagggagccuucugacaugcgcuaaguuuaagugcgugaccaaacucgagggaaagauuguucaguacgaaaaccugaaauauucugugaucgucacagugcacacgggcgaucagcaucaaguugggaaugagaccacagaacacggaaccaucgccacaauuaccccccaggccccuacguccgagauccagcugaccgacuacggcgcucucacacuggacuguagcccccggaccggccuugauuucaacgaaauggugcugcucacaaugaaggagaaaucuuggcugguccauaagcagugguuucuugaccugccucuccccuggaccuccggggcgagcacgucccaagagacauggaaucgccaggaucugcuggugaccuucaaaacagcccacgcuaagaagcaggaagucgugguucucggaucucaagagggcgccaugcacaccgcccugaccggggcuacagaaauucagacgagcggaaccacaaccaucuuugccggccaucuuaaaugcagacugaagauggacaaacucacacugaaggggaccuccuaugugauguguacgggcagcuucaaacuggagaaggaagucgcggagacacagcacggaaccgugcuuguucaggugaaguacgagggcaccgaugcuccgugcaaaauuccuuucucuacacaagacgaaaagggggucacccagaacggacggcucaucacagccaaucccaucgugacggauaaagagaagccugugaacauugaaaccgagccccccuuuggcgaguccuauaucguugucggggccggagaaaaagcucugaagcugagcugguucaagaaaggcucuagcauugggaagauguuugaggccacagcuagaggcgcccgccggauggcgauccucggagacaccgccugggauuucggcuccauugggggaguguuuacaucugugggcaaacugguccaucagguguucgggaccgcuuacggaguucuuuuuagcggcguguccuggacgaugaagaucgggaucggcauucugcucaccuggcugggacugaauagcagaucuacaucccuuagcaugaccuguaucgccgucggcauggugacacucuaccuggggguuauggugcaggcugacucuggaugcgucauuaacuggaaaggccgcgaacugaaguguggguccggaaucuucgugaccaacgagguucacacauggaccgaacaauauaaguuucaggccgauagcccuaaacggcucuccgcggccauuggcaaggcuugggaggagggggugugcggcaucagaucugccacgcgccuggaaaauauuauguggaaacagaucagcaacgagcuuaaucauauccugcucgaaaacgacaugaaguucacagucguggugggagacgcuaauggcauucuggcccaggggaaaaagaugauccggccgcaacccauggagcacaaauacuccuggaagucuuggggaaaggccaaaauuaucggcgcugauauucagaacaccaccuuuaucaucgacgggccugauacacccgaauguccugacgaucagagagcguggaauauuugggaggucgaggacuauggauucggcaucuuuaccacgaacauuuggcugaagcuucgcgauagcuacacacagaugugcgaccaccggcucauguccgccgcuaucaaagauagcaaggccguucaugccgacaugggcuauuggauugaaucugagaaaaaugaaaccuggaagcuggcuagagccuccuucaucgaggugaagacauguaccuggcccaaaagccacacacuguggucuaacggggugcucgaauccgagaugaucauuccgaagaucuacggaggcccuauuagccaacauaauuaucgccccggguacuucacccagacggcgggaccuuggcaccugggcaaacuugagcuggauuuugaccucugcgaagggaccacagucgugguugaugagcacugcggaaaccggggccccucucugagaaccacaaccgugacgggcaagaucauucaugaaugguguugccggagcuguacacugccuccccuucgcuucagaggggaggacggaugcugguacggcauggagauccggccggucaaagaaaaggaggaaaaucucgugagauccaugguuagcgcugggucuggagagguggacuccuuuagccugggcauccugugugucuccauuaugaucgaagaggugaugcgcucucgguggagcagaaagaugcucaugaccgggacacuggccguuuuccuucugcucauuaugggacagcugaccuggaacgaucugauccgccuuugcauuauggugggcgccaaugcuuccgacagaaugggcauggggaccacauaucuggcccucauggcgacguuuaaaaugcggccuauguucgcugucggacugcucuuucgcagacugaccucucgggaggugcuucugcucacaaucggccugagccugguggccuccgucgaacuucccaacucucuggaggaacucggggauggacuggccaugggcauuaugaugcucaagcugcuuaccgaguuccaaccccaccagcuguggacaacccuccugagccugacguuuaucaaaacaacccuuucccuggacuacgcuuggaagaccacagccaugguucucagcaucgugucucuguucccucucugucuguccaccacaagccagaaaacgaccuggcuuccggugcugcuggggucuuuuggaugcaagccccucacaauguuccugauuaccgaaaacaagaucuggggccgcaaauccuggccucuuaaugagggcauuauggcugucgggaucgugagcaugcugcucucuucccugcucaagaacgauguuccccuggccggaccucuuauugcgggcgggaugcugaucgccuguuaugugaucagcggauccagcgcugaccugucucucgagaaagccgcugaagucagcugggagcaggaagccgagcauuccggcacaucucacaauauucugguggaaguucaagaugacgggaccaugaagaucaaagaugaggagagagacgauacgcuuaccauucugcucaaggccacacugcucgcugugagcggagucuaccccauguccaucccugcgacccuguuugugugguauuucuggcagaaaaagaagcagcggucuggcguccuuugggacacacccagcccgccugaaguggagcgcgccguucuggaugacggcauuuacagaauccugcagcgggggcuccugggacgcucccaagugggcgucgggguguuccaggacggaguuuuucauaccauguggcacgugacaagaggcgcuguccuuauguaucaggggaaacggcuggaacccucuugggccagcgugaagaaagaucucaucuccuacggaggcggcuggagauuccaggggagcuggaacacgggagaggaggugcaaguuauugccgucgaaccuggcaagaaucccaaaaacgugcagaccacaccggggaccuuuaagaccccugagggagaagugggcgcuaucgcccuggacuucaagcccgggacaucuggauccccuauugucaaucgcgagggcaaaaucgugggccucuacgggaacggaguugugacgaccagcggcacauaugucucugcgauugcucaggccaaggccucccaagaagggccccugcccgagaucgaggaugaaguguuuaaaaagcggaaucuuaccauuauggaccugcacccuggaagcggcaaaacaagacgcuaccugccggcuaucguucgggaggccaucaagagaaagcuccgcacccugauucuugcgcccacgcggguggucgcuuccgaaauggccgaggcccugaaagggaugccuaucagauaucagacaaccgcugugaagucugaacauaccggccgcgagauuguugaucucaugugccacgccacauucaccaugcggcugcugagccccgugagagucccuaacuacaauaugaucauuauggacgaggcucauuuuacagaucccgccuccaucgcggcccggggauauaucagcacccgcgugggcaugggggaagcugccgcuauuuucaugacggccacaccuccgggaucuguggaggccuuuccccaguccaacgcugucauccaggacgaagagagagauauuccugaacggagcuggaauucuggcuacgacuggaucaccgauuuccccgggaaaacaguuugguuugugccuagcauuaaguccggaaacgacaucgcgaauugucuccgcaaaaacggcaagagagugauccaacuuucucggaagaccuucgacacggaguaucagaaaaccaagaacaaugauugggacuacgucgugacaaccgauauuagcgagaugggggccaacuucagagcugaccgcguuaucgauccccggagaugccugaaaccggugauucugaaggacggcccugaacgcgucauccucgccggacccaugcccgugacaguugccuccgcugcccagcggagaggccgcauugggcggaaucagaacaaagagggagaucaauacguguauaugggccagccucugaauaacgacgaagaucacgcgcauuggaccgaggcuaagaugcuucuggacaauaucaacacacccgaggggauuaucccugcccucuuugaaccggagagagaaaagucugccgcuaucgauggagaguaccgccugagaggcgaagcccggaaaaccuucgucgagcugaugcgcagaggggaccuccccguguggcuuagcuauaaggucgcguccgagggcuuucaguacagcgaucggcgcuggugcuucgacggagaaagaaauaaccaggugcuggaggaaaauauggacguugagauuuggacgaaagaaggcgagcggaagaaacugagaccucgcuggcucgaugcccggacauauucugacccccuggcucuuagagaguuuaaggaauucgccgcugggcgccgguccgugagcggagaucugauccucgagauuggcaaacugccucaacaccugacccucagagcccagaacgcucuugacaaucuggugaugcugcacaacuccgaacaggggggaaaggccuaccggcaugcgauggaggaacuccccgauaccaucgagacacugaugcuucuggcccucauugcuguccugaccggcggcguuacacuguuuuuccucucugggaagggacuuggcaaaacgagcaucgggcugcugugugugaccgccuccucugcucuccuguggauggccagcguggagccgcacuggaucgccgcuuccauuauccuugaauuuuuccugaugguccuccugauuccugagcccgaccgccagagaacaccucaagauaaucagcuggcguaugugguuaucggacuccuuuuuaugauucugaccguggccgcuaacgaaaugggccugcucgagacaaccaagaaagaccuggggaucggacaugucgccgccgagaaccaccagcacgcuacgaugcuugauguggaccugcggcccgccagcgcguggacccucuacgccgucgcuacaaccgugaucacaccuaugaugcgccauaccauugaaaauacgacagccaacaucucucugaccgcuauugccaaucaagcggccauccugaugggccucgauaagggcuggcccauuuccaaaauggacaucgggguuccgcuucuggcucugggaugcuacagccaggugaacccucucacacugaccgccgcuguccuuaugcugguggcccacuaugcuauuaucggccccgggcuccaggccaaggcgaccagagaggcccagaagcggacagcugccggaaucaugaaaaaucccacgguugauggcauuguggcuaucgaccuggacccugucguguacgaugccaaguucgaaaaacaacuggggcagauuaugcuccuuauccuguguaccucucagauucugcucaugcgcacaaccugggcccugugcgaguccaucacacuugcgaccggaccgcugacgacacucugggaaggcagccccggcaaguuuuggaacaccaccaucgcugugucuauggccaauauuuucagagggagcuaucuggcuggagccggccuggccuucucccucaugaaaucucuugggggaggccggcgcgggacaggagcucagggcgagacccugggcgagaaguggaagagacaacugaaccagcucagcaaauccgaauuuaauacauacaagcggagcgggaucauggagguugacagauccgaagccaaagagggacugaagcgcggcgaaacgaccaaacaugcggucucucgggggacagccaagcuuagaugguucguggagcgcaaccuggugaagccugagggaaaagucauugaucucggcugugggcggggaggcuggagcuauuacugcgcuggccugaagaaaguuaccgaagugaagggguauacaaaaggaggccccgggcacgaggaaccuauccccauggccaccuacggauggaaucuggugaagcuccauuccggcaaagacgucuuuuucaugccuccggagaagugugauacgcuucugugcgacauuggggaaucuagccccaacccuaccaucgaggagggaagaacacugcgcgugcucaagaugguugaacccuggcugcggggcaaucaguuuuguaucaaaauucuuaacccuuacaugcccuccguggucgagacccuggaacagaugcaaagaaagcacggcgggaugcucgugcgcaauccgcugucucggaacagcacacacgagauguauuggguuuccugcggaaccggcaauaucgugagcgcugucaacaugacaucuagaaugcugcucaaccgcuucaccauggcccaucggaaaccuacguacgagagagauguggaccugggggcgggaacacgccacguggccgucgaacccgagguugcuaaucuugauauuaucggccagagaauugaaaacaucaagaaugagcauaaauccaccuggcacuaugacgaagauaaccccuacaagaccugggccuaucacgggagcuacgaggugaagccuucuggauccgcuagcucuauggugaauggcgucgugcggcugcucacaaaacccugggacguuauuccuauggugacgcagaucgccaugaccgacacaaccccguuuggccaacagcgcgucuucaaggagaaaguggauacaagaaccccccgggcuaagagagggacaacccagaucauggaaguuacggccaaauggcuguggggauuucuuucccggaacaagaagccucgcauuuguaccagagaggaauucacacggaaagugcgcagcaaugcggccaucggcgcugucuuuguggacgagaaccaguggaauuccgccaaggaagcuguugaggaugagagauucugggaccuggugcaucgggaacgcgagcuccacaaacaagggaagugcgccaccugcgucuauaacaugaugggaaaaagagaaaagaagcugggcgaguuugggaaagccaagggcagccgggcgauuugguacauguggcugggagcucgcuuccucgaauucgaggcccugggcuuuaugaaugaggaucauugguucucuagagaaaacagccuuuccgggguggagggagaaggccugcacaaacucggguacauccugcgggacauuucuaagauccccggaggcaauauguaugccgaugacacagcugggugggauacccgcaucacggaggacgaucuucagaacgaggccaaaauuacagacaucauggaaccugagcaugcucugcucgccaccagcauuuuuaagcugacauaccagaauaaagucgugagaguucagcggcccgcgaagaacggcaccgugauggaugucaucucccgcagagaccaacggggaucuggccagguggggacguauggacugaacaccuucacaaauauggaagugcagcucauuagacagauggagagcgaaggcaucuuucugccguccgagcuugagaccccuaaccuggccgaacgcguucucgacuggcuggagaagcacggggcugaacggcuuaaaagaauggccaucucuggagaugacuguguggucaagcccauugaugaccgcuucgcuacagcccugaccgcgcucaaugauaugggcaaaauccggaaggacauuccucaaugggagcccagcaaaggguggaacgauuggcagcaggugccuuuuugcucccaccauuuccaccagcugaucaugaaggacggcagagaaauuguugugcccugucgcaaucaagaugagcuggucggacgggccagagugagccagggcgcuggguggucucuccgcgagacagccugccugggaaaguccuacgcucagauguggcaacuuauguauuuucaucggagagaccugcgccucgccgcuaacgccaucuguagcgcggucccgguggauuggguuccuaccucucggacgacaugguccauccacgcccaccaucaguggaugaccaccgaagacaugcugagcguguggaauagagucuggauugaggaaaaccccuggauggaggacaaaacacacguguccucuugggaagagguucccuaccuuggcaagcgggaggaucaguggugcgggagccugaucggacucaccgcuagagccacaugggccacgaauauucagguggcuaucaaccaaguccgccggcugauuggcaaugaaaacuaucuggacuacaugaccuccaugaaaagauucaagaaugagagcgauacagaaggggcccucugguga

SEQ ID NO: 18805 - RNA, 9879 nt, Artificial Sequence
  derived and/or modified CDS sequence (opt5) from DENV-1__GU056033__SS-prME
agcgugacaaugcugcucaugcugcuucccacagcccuggcuuuccaccucacgaccagaggaggggaaccucauaugaucgucuccaagcaggaacggggaaaaucucugcuuuuuaagacaagcguuggcgugaacaugugcacccugauugccauggaccucggggaacugugugaagauacaaugaccuacaaaugcccccgcaucacagaagcggaacccgacgauguggacuguuggugcaaugcuaccgauacgugggucaccuauggaacauguucccagaccggcgagcacagacgggacaagcgcucuguggcccuggccccucauguugggcucggacuggagacaagaaccgaaacguggaugagcuccgagggcgcuuggaaacagauucagcggguggaaacaugggcccuucgccaccccggcuucaccgucaucgcucuguuucucgcccaugcgauugggacaucuaucacccagaagggaaucauuuucauccugcuuaugcuggugaccccuagcauggccaugagaugcguuggcauugggaaccgggauuuuguggagggacucuccggcgcuacaugggucgacguggugcuggagcacgggagcugugucacgaccauggccaagaauaaacccacacuggauaucgaacuccugaagaccgagguuacaaacccugcugugcuucgcaaacugugcauugaagccaagaucucuaauaccacgacagacuccagauguccgacccaaggagaggcgacccucguggaagaacaggaugccaacuucgucugccggcgcacauuuguggacagaggcuggggcaauggguguggacuguucggcaaagggagccuucugaccugcgcuaaguuuaagugcguuacaaaacucgagggaaagauugugcaguacgaaaaccugaaauauucugucaucgugacgguucacaccggcgaucagcaucaaguggggaaugagacaaccgaacacggaacaaucgccaccauuacgccccaggcuccuaccuccgagauccagcugacagacuacggcgcccucacccuggacuguagcccccggacaggccuugauuucaacgaaaugguccugcucaccaugaaggagaaaucuuggcuggugcauaagcagugguuucuugaccugccucuccccuggacguccggggccagcacaucccaagagaccuggaaucgccaggaucugcuggucacauucaaaaccgcucacgcgaagaagcaggaagugguugugcucggaucucaagagggcgccaugcacaccgcucugacaggggccacggaaauucagaccagcggaacaaccacaaucuuugccggccaucuuaaaugcagacugaagauggacaaacucacccugaaggggauguccuaugucauguguacgggcagcuucaaacuggagaaggaaguggcugagacacagcacggaaccguucuugugcaggucaaguacgagggcaccgaugccccgugcaaaauuccuuucucuacacaagacgaaaagggggugacccagaacggacggcucaucacagcgaaucccaucgugacggauaaagagaagccuguuaacauugaaaccgagccgcccuuuggcgaguccuauaucgucgugggggcuggagaaaaagcccugaagcugagcugguucaagaaaggcucuagcauugggaagauguuugaggccacagcuagaggcgcccgccggauggcuauccucggagacaccgccugggauuucggcuccauugggggaguguuuacaucugucggcaaacuggugcaucagguuuucgggaccgcguacggagugcuuuuuagcggcgucuccuggacgaugaagaucgggaucggcauucugcucaccuggcugggacugaauagcagaucuacaucccuuagcaugaccuguaucgccgugggcaugguuacacucuaccugggggugaugguccaggcugacucuggaugcgugauuaacuggaaaggccgcgaacugaaguguggguccggaaucuucguuaccaacgaggugcacacauggaccgaacaauauaaguuucaggccgauagcccuaaacggcucuccgcugccauuggcaaggcgugggaggagggggucugcggcaucagaucugccacgcgccuggaaaauauuauguggaaacagaucagcaacgagcuuaaucauauccugcucgaaaacgacaugaaguucacagugguggucggagacguuaauggcauucuggcucaggggaaaaagaugauccggccgcaacccauggagcacaaauacuccuggaagucuuggggaaaggccaaaauuaucggcgcugauauucagaacaccaccuuuaucaucgacgggccugauacacccgaauguccugacgaucagagagccuggaauauuugggagguggaggacuauggauucggcaucuuuaccacgaacauuuggcugaaacuucgcgauagcuacacacagaugugcgaccaccggcucauguccgccgcuaucaaagauagcaaggcggugcaugccgacaugggcuauuggauugaaucugagaaaaaugaaaccuggaagcuggcuaaggccuccuucaucgaggucaaaacauguaucuggcccaagagccacacccuguggucuaacggggugcucgaauccgagaugauuaucccgaaaauuuacggaggcccuaucagccaacauaauuauagacccggguacuucacacagaccgccggaccuuggcaccugggcaaacuugagcuggauuuugaccucugcgaagggacgaccguuguggucgaugagcacugcggaaaccgcggccccucucugcggacaaccacagugaccggcaaaauuauccaugaaugguguugcagaagcuguacgcugccuccccuucgguuccgcggggaggacggaugcugguacggcauggagaucagaccgguuaaggaaaaggaggaaaaucucgugcgguccauggucagcgcugggucuggagagguggacuccuuuagccugggcauucuguguguuuccaucaugauugaagaggugaugagaucucgcuggagccggaaaaugcucaugacagggacccuggccgucuuccuucugcucaucaugggacagcugacauggaacgaucugauuagacuuugcaucauggugggcgcgaaugcuuccgaccgcaugggcauggggaccaccuaucuggcccucauggccacauuuaagaugagaccuauguucgcugugggacugcucuuucggcgccugacgucuagagagguccuucugcucaccauuggccugagccugguugccuccguggaacuucccaacucucuggaggaacucggggauggacuggcgaugggcaucaugaugcucaaacugcuuacagaguuccaaccccaccagcuguggaccacacuccugagccugaccuuuaucaagacgacacuuucccuggacuacgcuuggaaaaccaccgccauggcccucagcauugugucucuguucccucucugucuguccacaaccagccagaagacaacguggcuuccgguccugcuggggucuuuuggaugcaagccccucaccauguuccugaucacagaaaacaaaauuuggggccggaaguccuggccucuuaaugagggcaucauggcuauugggaucgugagcauccugcucucuucccugcucaaaaacgauguuccccuggccggaccucuuauugcuggcgggaugcugaucgccuguuaugugauuagcggauccagcgcggaccugucucucgagaaggccgcugaagucagcugggagcaggaagccgagcauuccggcaccucucacaauauccugguggaaguucaagaugacgggacaaugaaaauuaaggaugaggagcgcgacgauacccuuacgauccugcucaaagcuacccugcucgccgugagcggagucuaccccauguccaucccugccacacuguuugugugguauuucuggcagaagaagaaacagagaucuggcguccuuugggacacccccagcccgccugaaguggagcgggcuguucuggaugacggcauuuaccgcaucucccagagagggcugcucggacggucucaagugggcgucgggguguuccaggacggaguuuuucauacaauguggcacgugacccgcggcgcgguccugauguaucaggggaagagacuugaacccagcugggccuccgugaaaaaggaucugauuagcuacggaggcggcuggcgguuccaggggucuuggaacacaggagaggaggugcaaguuaucgcugucgaaccuggcaaaaaucccaagaacgugcagacgaccccggggacauuuaagaccccugagggagaagugggcgccauugcccucgacuucaaacccgggaccuccggaagcccuaucgucaauagagagggcaagauugugggccuguacgggaacggaguugugacaacgucuggcaccuaugucuccgcuaucgcccaggcgaaagcuagccaagaagggccccuccccgagaucgaggaugaaguguuuaagaaacgcaaucugacaauuauggaccuucacccuggauccggcaagacccggagauaccugccggccaucguucgcgaggccauuaagcggaaacugagaacacucauccuggcucccacccgcguggucgccucugaaauggcggaggcucuuaaggggaugccuauucgguaucagacgacagccgugaaaagcgaacauaccggcagagagaucguugaucugaugugccacgccaccuucacaaugcgccuccugucccccgugcgggucccuaacuacaauaugaucauuauggacgaggcucauuuuaccgaucccgccagcaucgcugccagaggauauauuucuacacgggugggcaugggggaagcggccgcuaucuucaugaccgccacgccuccgggauccguggaggcuuuuccccagagcaacgccgucauucaggacgaagaaagagauaucccugaaagaucuuggaauagcggcuacgacuggaucacagauuuccccgggaagaccguuugguuugugccuuccauuaaaucuggaaacgacaucgccaauugucugcggaagaacggcaagcgcgugauucaacucagcagaaaaacauucgacaccgaguaucagaagacgaaaaacaaugauugggacuacgucgugaccacagauaucuccgagaugggggcuaacuuccgggcggacagaguuauugauccccgccggugccuuaagccggugauccugaaagacggcccugaaagagucauucuggccggacccaugcccgugaccguugcuucugccgcccagcgccggggcagaaucgggcgcaaucagaacaaggagggagaucaauacguguauaugggccagccucucaauaacgacgaagaucacgcucauuggacagaggccaagaugcugcuugacaauaucaacacccccgaggggauuaucccugcgcuguuugaaccggagcgggaaaagagcgcugccauugauggagaguacagacuccgcggcgaggccagaaagacauucgucgagcugaugcggcgcggggaccugcccguguggcucuccuauaaagucgcuagcgagggcuuucaguacucugauagacgguggugcuucgacggagaacgcaauaaccaggugcuugaggaaaauauggacguugagaucuggaccaaggaaggcgagcgcaagaagcugcggccuagauggcuggaugcccgcacguauuccgacccccucgcgcugcgggaguuuaaagaguucgccgcugggagacgcagcguguccggagaucuuauucuggagaucggcaagcucccucaacaccugacacugcgggcccagaacgcucucgacaaucuugugaugcugcacaacucugaacaagggggaaaggccuacagacaugcuauggaggaacugcccgauaccaucgagacccucaugcugcuugcccugauugcgguccucacaggcggcguuacccuguuuuuccugagcgggaaaggacucggcaagacauccaucgggcuucugugugugacggccucuagcgcucugcucuggauggccuccguggagccgcacuggauugcugccagcaucauucuggaauuuuuccuuaugguccugcucaucccugagcccgaccggcagcgcaccccucaagauaaucagcuggccuaugugguuaucggacugcucuuuaugauucuuacaguggcugcgaacgaaaugggccugcuggagaccaccaaaaaggaccucgggaucggacaugucgccgcugagucucaccagcacgccaccaugcuggauguggaccuuagacccgccuccgcuuggacgcuguacgccgucgcgaccacagugauuaccccuaugaugcggcauacaaucgaaaacaccacggccaauauuagccucacagcuaucgccaaccaagcugccauucugaugggccuggauaaaggcuggcccaucucuaagauggacaucgggguuccgcuccuugcgcugggaugcuacucccaggugaauccucugacccucacagccgcuguccugaugcuuguggcccacuaugcuauuaucggccccgggcugcaggccaaggcuacccgcgaggcccagaaaagaaccgcggccggaauuaugaagaaccccacaguugauggcaucguggcuauugaccucgacccugucguguacgaugccaaauucgaaaagcaacuggggcagaucaugcugcucauccuuuguacgagccagauucugcugaugcggaccacaugggcucucugcgagucuaucacccuggccacaggaccgcuuaccacgcugugggaaggcagccccggcaaauuuuggaauacaaccauugccguguccauggcgaacaucuuccgcgggucuuaucucgcuggagccggccuggcuuucagccugaugaagucccucgggggaggcagacgggggaccggagcccagggcgagacacuuggcgagaaguggaaacgccaacugaaucagcugagcaagaccgaauuuaacacauacaaaagauccgggauuauggagguugaccggucugaagccaaggagggacucaaaagaggcgaaacgaccaagcaugcugucagccgcgggacagccaagcugcggugguucguggagagaaaucuugugaaaccugagggaaaggucaucgaucugggcugugggcgcggaggcugguccuauuacugcgcgggccucaaaaagguuaccgaagugaaaggguauacaaagggaggccuggggcacgaggaacccaucccuauggccaccuacggauggaaccuggugaaacuccauucuggcaaggacgucuuuuucaugcccccugagaagugugauacgcuucugugcgacauuggggaaagcuccccgaaucccaccaucgaggagggacggacacugagagugcucaaaaugguugaaccuuggcugcgcggcaaccaguuuuguauuaagauccuuaaucccuacaugccuucuguggucgagacccuggaacagaugcaacggaaacacggcgggaugcucgugagaaacccccugagccgcaauuccacacacgagauguauuggguuagcugcggaaccggcaacauugugucugcugucaauaugacaucccggaugcugcucaacagauucaccauggcccaucgcaagccgacguacgagcgggauguggaccugggggcuggaacaagacacguggccgucgaaccugagguugcgaaccuugauaucauuggccagcgcaucgaaaauaucaaaaacgagcauaagagcaccuggcacuaugacgaagauaaucccuacaagaccugggccuaucacgggucuuacgaggugaaacccuccggaagcgcuucuuccauggugaacggcgucgugaagcugcucacaaaaccuugggacguuauucccauggugacgcagaucgccaugaccgacacaaccccuuuuggccaacagagagucuucaaggagaaaguggauacacggaccccgcgcgcuaagagagggacaacccagauuauggaaguuacggccaaguggcuguggggauuucuuagccggaauaaaaagcccagaaucuguacccgggaggaguucacacgcaaagugagauccaacgcugccauuggcgcggucuuuguggacgagaaucaguggaacagcgccaaggaagcuguugaggaugagcgguucuggaaucuggugcaucgcgaaagagagcuccacaaacaagggaagugcgcuaccugcgucuauaacaugaugggaaagcgggagaaaaagcugggcgaguuugggaaagccaagggcucucgcgccaucugguacauguggcugggagccagauuccucgaguucgaggcgcugggcuuuaugaaugaggaccauugguucagccgggaaaacucccuuucugggguggagggagaaggccugcacaaacucggguacauccugcgcgauauuagcaagaucccuggaggcaauauguaugcugacgauacagccgggugggacaccagaauuacggaggaugaccuucagaacgaggccaaaaucacagauauuauggaacccgagcaugcucugcucgccaccuccaucuuuaagcugacauaccagaauaaggucgugcggguucagcgcccugcuaaaaacggcaccgugauggacgucaucucuagacgggaucaacgcggaagcggccagguggggacguauggacugaacaccuucacaaauauggaagugcagcucauuagacagauggaguccgaaggcaucuuucugcccucugagcuugagaccccgaaccuggccgaacggguucucgacuggcuggagaagcacggggcggaaagacuuaaacgcauggccauuagcggagacgauuguguggucaagccuaucgacgaucgguucgcuacagcccugaccgcucucaaugacaugggcaaagugagaaaggauauuccccaaugggagccuuccaagggguggaacgacuggcagcagguucccuuuugcagccaccauuuccaccagcugaucaugaaagauggccgcgaaaucguggucccuugucggaaucaagacgagcuggugggcagagcccgcgucucucagggcgcgggguggucccuccgggagacagccugccugggaaagagcuacgcucagauguggcaacuuauguauuuucauagacgcgaucugcggcucgccgcuaacgccauuuguucugcugugcccguugacugggugccgaccuccagaacgacauggagcauccacgcccaccaucaguggaugaccaccgaagauaugcuguccgucuggaaucgcguguggauugaggaaaacccuuggauggaggacaaaacacacguuucuagcugggaagaggugcccuaccuuggcaagcgggaggaccaguggugcgggucccugaucggacucaccgcgagagccacaugggcuacgaauauucaggucgccaucaaccaagugcggagacugauuggcaaugaaaacuaucuggauuacaugaccagcaugaaacgcuucaagaaugagucugaccccgaaggggcccucugguga

SEQ ID NO: 18806 - RNA, 9879 nt, Artificial Sequence
  derived and/or modified CDS sequence (opt5) from DENV-1__GU131833__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggacguccuaugugauguguacaggcagcuucaaacuggagaaggaagucgccgagacccagcacggaaccgugcuuguucaggugaaguacgagggcacagaugcgccgugcaaaauuccuuuccucacccaagacgaaaagggggucacacagaacggacggcugaucacggcuaaucccaucgugaccgauaaagagaagccugugaacauugaaacagagccccccuuuggcgagucuuauaucguugucggggccggagaaaaagcccugaagcucuccugguucaagaaaggcagcucuauugggaagauguuugaggcuaccgccagaggcgcucgccggauggccauccugggagacacagcgugggauuucggcagcauugggggaguguuuaccuccgugggcaaacuuguccaucagguguucgggacggccuacggaguucuguuuucuggcgugagcuggaccaugaagaucgggaucggcauucuccugacauggcugggacuuaauuccagaagcaccucucucuccaugacauguaucgcugucggcauggugacccuguaccuggggguuauggugcaggccgacagcggaugcgucauuaacuggaaaggccgcgaacucaagugugggucuggaaucuucgugacaaacgagguucacaccuggacggaacaauauaaguuucaggcugauuccccuaaacggcugagcgccgcgauuggcaaggccugggaggagggggugugcggcaucagauccgcuacacgccuugaaaauauuauguggaaacagaucucuaacgagcugaaucauauccuccuggaaaacgacaugaaguucaccgucguggugggagacgccaauggcauucuggcucaggggaaaaagaugauccggccgcaacccauggagcacaaauacagcuggaaguccuggggaaaggccaaaauuaucggcgccgauauucagaacaccacauuuaucaucgacgggccugauacccccgaauguccugacgaucagagagcuuggaauauuugggaggucgaggacuauggauucggcaucuuuacgacaaacauuuggcuuaagcuccgcgauucuuacacccagaugugcgaccaccggcugaugagcgcggccaucaaagauuccaaggcuguucaugccgacaugggcuauuggauugaaagcgagaaaaaugaaacauggaagcuggccagagcuucuuucaucgaggugaagaccuguacauggcccaaaucccacacccucuggagcaacggggugcuggaaucugagaugaucauuccgaagaucuacggaggcccuauuucccaacauaauuaucgccccggguacuucacgcagaccgccggaccuuggcaccuuggcaaacuggagcucgauuuugaccugugcgaagggacaaccgucgugguugaugagcacugcggaaaccggggccccagccugagaacaaccacggugacaggcaagaucauucaugaaugguguugccggucuuguacccuuccuccccuccgcuucagaggggaggacggaugcugguacggcauggagauccggccggucaaagaaaaggaggaaaaucuggugagaagcaugguuuccgcggggagcggagagguggacucuuuuucccugggcauccucugugucagcauuaugaucgaagaggugaugcgcucccgguggucuagaaagaugcugaugacagggacccuugcuguuuuccugcuccugauuaugggacagcugaccuggaacgaucuuauccgccugugcauuauggugggcgccaaugccagcgacagaaugggcauggggacaacguaucucgcucugauggccaccuuuaaaaugcggccuauguucgcggucggacuccuguuucgcagacuuacaucccgggaggugcugcuccugaccaucggccugucucuuguggcuagcgucgaacugcccaacucccucgaggaacugggggauggacucgccaugggcauuaugaugcugaagcuucugacagaguuccaaccccaccagcucuggaccacgcugcugucucuuacauuuaucaaaaccacccugagccucgacuacgccuggaagacaaccgcuauggcccuguccaucguuagccucuucccucugugucuuucuacaacgucccagaaaaccacauggcugccggugcugcucgggagcuuuggaugcaagccccugaccauguuccuuauuacagaaaacaagaucuggggccgcaaaucuuggccucugaaugagggcauuauggcuaucgggauuguguccauccuccugagcucucuccugaagaacgaugucccccuugccggaccucugaucgcgggcgggaugcugauugccuguuaugugaucuccggaagcuccgcugaccucagccuggagaaagccgcugaaguuucuugggagcaggaagccgagcauagcggcaccucccacaauauucuuguggaaguccaagaugacgggacgaugaagaucaaagaugaggagaaggacgauacccugacaauucuccugaaagccacccuccuggcugugucuggaguuuaccccaugagcaucccugcgacacuuuuugugugguauuucuggcagaagaagaaacagagauccggcguccugugggacacccccucuccgccugaaguggagcgggccguccuggaugacggcaucuaccgcauucuccagagagggcugcuuggacggagccaagugggcguugggguguuccagaacggagucuuucauacaauguggcacgugacgcgcggcgcuguucugauguaucaggggaagagacucgaacccuccugggccucugugaaaaaggaccugaucagcuacggaggcggcuggcgguuccagggguccuggaauaccggagaggagguccaagugauugccguggaaccuggcaaaaaccccaagaauguucagacaaccccggggaccuuuaagacaccugagggagaagucggcgcuaucgcccucgauuucaaacccgggacgagcggaucuccuauugugaacagagagggcaagaucgugggccuguacgggaauggagucgugaccacauccggcaccuauguuagcgcgauugcucaggccaaagccucucaagaagggccccuucccgagaucgaggacgaaguguuuaagaaacgcaaccugacaaucauggaucugcacccuggauccggcaagacccggagauaccucccggcuauuguccgcgaggccaucaagcggaaacugagaacgcuuauucuggcgcccacacgcgugguugcuagcgaaauggccgaggcccucaaggggaugccuauccgguaucagaccaccgcugugaaauccgaacauacaggcagagagauugucgaccugaugugccacgccaccuucacaaugcgccugcucucucccgugcggguuccuaauuacaacaugaucaucauggaugaggcucauuuuaccgaccccgccagcauugcggccagaggauauaucuccacgcgggugggcaugggggaagcugccgcuauuuucaugacagccaccccuccgggaagcgucgaggccuuuccccagucuaaugcugugauccaggaugaagagcgcgacauuccugaaagauccuggaacagcggcuacgauuggaucacagacuuccccgggaagaccgugugguuugucccuucuaucaaaagcggaaaugauauugcgaacugucuucggaagaacggcaagcgcguuauccaacuguccagaaaaacguucgacaccgaguaucagaagacaaaaaauaacgacugggauuacguggugaccacagacauuucugagaugggggccaauuuccgggcugauagagucaucgacccccgccggugccugaagccggugauucucaaagauggcccugaaagaguuauccuggccggacccaugcccgugaccgucgccagcgcugcccagcgccggggcagaauugggcgcaaccagaauaaggagggagaccaauacguguauaugggccagccucuuaacaaugaugaagaccacgcgcauuggacagaggcuaagaugcugcucgauaacaucaauacccccgaggggaucauuccugcccuguuugaaccggagcgggaaaaauccgccgcuaucgacggagaguacagacugcgcggcgaagccagaaagacguucguugagcucaugcggcgcggggaucuucccguguggcugucuuauaaagucgcgagcgagggcuuucaguacuccgacagacgguggugcuucgauggagaacgcaacaaucaggugcuggaggaaaacauggacgucgagauuuggacaaaggaaggcgagagaaaaaagcuccggccuagauggcuggacgcccgcaccuauagcgauccccuugcucugcgggaguuuaaagaauucgccgcugggagacgcucuguguccggagaccucauccuggagauuggcaagcugccucaacaccucacccuucgggcccagaaugcucuggauaaccugguuaugcuccacaauagcgaacaggggggaaaggccuacagacaugcgauggaggaacugcccgacacaaucgagacccuuaugcugcucgcccugaucgcugugcugacaggcggcgugacgcucuuuuuccuuuccgggaaaggacugggcaagaccucuauugggcugcucugugucacagccagcuccgcucugcuuuggauggccucuguugagccgcacuggaucgccgcuagcauuauccuggaauuuuuccucauggugcugcugauuccugagcccgaucggcagcgcaccccucaagacaaccagcucgcguauguggucaucggacuucuguuuaugauccugacaguggccgcuaacgaaaugggccuccuggagaccacgaaaaaggaucuugggauuggacauguugccgccgagaaucaccagcacgcuaccaugcuggacguggaucucagacccgccuccgcguggacacuguacgccgucgcuaccacagugaucaccccuaugaugcggcauacgauugaaaacacaaccgccaauaucagccugacagcuauugccaaccaagcggccauccucaugggccuugacaaaggcuggcccauuucuaagauggauaucggggucccgcugcuggcucucggaugcuacucccaggugaauccucugacccuuaccgccgcuguucugaugcucguggcccacuaugcuaucauuggccccgggcugcaggccaaggcgacacgcgaggcccagaaaagaacggcugccggaaucaugaagaaccccaccgucgacggcauuguggcuaucgaucuggacccuguuguguacgacgccaaauucgaaaagcaacucgggcagauuaugcuucugauccuguguacaagccagauccuccugaugcggaccacaugggcccuuugcgagucuauuacccuggcgacgggaccgcucacaacccugugggaaggcucccccggcaaauuuuggaauaccacaaucgcugucagcauggccaacauuuuccgcgggucuuaucuggcuggagccggccucgccuucagccuuaugaagucccuggggggaggcagacgggggaccggagcucagggcgagacacugggcgagaaguggaaacgccaacucaaucagcugucuaagagcgaauuuaacacguacaaaagauccgggaucauggagguggaucggagcgaagccaaggagggacuuaaaagaggcgaaaccacaaagcaugcggugucccgcgggaccgccaagcugcggugguucguugagagaaaucucgucaaaccugagggaaaggugauugaccugggcugugggcgcggaggcuggucuuauuacugcgcuggccugaaaaaggugacagaagucaaaggguauaccaagggaggccccgggcacgaggaaccuauccccauggccacguacggauggaaccucguuaaacuucauagcggcaaggauguguuuuucaugccuccggagaagugugacacccugcugugcgauaucggggaauccucucccaauccuacaauugaggagggacggacccucagagugcugaaaauggucgaacccuggcuucgcggcaaccaguuuuguaucaagauucugaauccuuacaugcccagcgugguugagacacucgaacagaugcaacggaaacacggcgggaugcuggugagaaacccgcugucccgcaauucuacccacgagauguauugggucagcugcggaacaggcaacaucguguccgcuguuaacaugaccagccggaugcuccugaauagauucacgauggcccaucgcaagccuacauacgagcgggacguggaucuuggggcgggaaccagacacgucgccguggaacccgagguggcuaaccuggacauuaucggccagcgcauugaaaauaucaaaaacgagcauaagucuaccuggcacuaugaugaagacaaucccuacaagacaugggccuaucacggguccuacgaggucaaaccuagcggaucugcuuccagcaugguuaacggcguggugagacuccugacgaagcccugggaugucaucccuauggugacccagauugccaugacagacaccacaccguuuggccaacagcggguuuucaaagagaagguggacacccgcacacccagagcuaaacgggggaccacgcagaucauggaagucaccgccagauggcuuuggggauuucugucucggaauaagaagccucgcauuuguacaagagaggaauucacccggaaagugcgcuccaacgcggccaucggcgcuguuuuuguggaugagaaucaguggaacagcgccaaggaagcugucgaggacgagagauucugggaucucgugcaucgggaacgcgagcugcacaaacaagggaagugcgccacaugcguuuauaauaugaugggaaaaagagaaaagaagcugggcgaguuugggaaagccaagggcucccgggcgauuugguacauguggcucggagcucgcuuccuggaauucgaggcccuuggcuuuaucaacgaggaccauugguucagcagagaaaauucucugagcgggguggagggagaaggccuccacaaacugggguacauccuucgggauauuuccaagauccccggaggcaacauguaugccgacgauaccgcugggugggacacgcgcauuacagaggaugaccugcagaaugaggccaaaaucaccgauauuauggaaccugagcaugcucuccuggccacaucuaucuuuaagcugaccuaccagaacaaagucgugagaguccagcggcccgcgaagaacggcacggugauggacguuaucagccgcagagaucaacggggauccggccagguggggaccuauggacucaauacauucaccaacauggaaguccagcugauuagacagauggagucugaaggcaucuuucuuccgagcgagcuggagacaccuaaucucgccgaacgcgugcuggacuggcuugagaagcacggggcugaacggcugaaaagaauggccauuuccggagacgauugugugguuaagcccaucgacgaucgcuucgcuaccgcccucacagcgcugaacgacaugggcaaagugcggaaggauauuccucaaugggagcccucuaaaggguggaaugacuggcagcaggucccuuuuugcagccaccauuuccaccagcugaucaugaaggauggcagagaaaucgugguucccugucgcaaccaagacgagcucgugggacgggccagagucucccagggcgcuggguggagccugcgcgagaccgccugccuuggaaagucuuacgcucagauguggcaacugauguauuuucaucggagagaucuccgccuggccgcuaaugccauuuguuccgcggugccggucgacugggugccuacgagccggacaaccuggucuauccacgcccaccaucaguggaugaccacagaagauaugcuuuccguuuggaacagaguguggauugaggaaaaucccuggauggaggacaaaacccacgucagcuccugggaagaggugcccuaccugggcaagcgggaggaccaguggugcgggucucucaucggacugacagcuagagccacgugggccaccaacauucagguugcuaucaaucaagugcgccggcugauuggcaacgaaaauuaucucgauuacauggccagcaugaaaagauucaagaacgaguccgacccugaaggggcgcugugguga

SEQ ID NO: 18807 - RNA, 9879 nt, Artificial Sequence
  derived and/or modified CDS sequence (opt5) from DENV-1__GU131834__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccccccuuuggcgaguccuauaucguugucggggccggagaaaaaacacugaagcugagcugguucaagaaaggcucuagcauugggaagauguuugaggccaccgcuagaggcgcccgccggauggcuauccucggagacacagccugggauuucggcuccauugggggaguguuuaccucugugggcaaacugguccaucagguguucgggacggcguacggaguucuuuuuagcggcguguccuggaccaugaagaucgggaucggcauucugcucacauggcugggacugaauagcagaucuaccucccuuagcaugacauguaucgccgucggcauggugacccucuaccuggggguuauggugcaggcugacucuggaugcgucauuaacuggaaaggccgcgaacugaaguguggguccggaaucuucgugacaaacgagguucacaccuggacggaacaauauaaguuucaggccgauagcccuaaacggcucuccgcugccauuggcaaggcgugggaggagggggugugcggcaucagaucugccacacgccuggaaaauauuauguggaaacagaucagcaacgagcuuaaucauauccugcucgaaaacgacaugaaguucaccgucguggugggagacgcuaauggcauucuggcccaggggaaaaagaugauccggccgcaacccauggagcacaaauacuccuggaagucuuggggaaaggcuaaaauuaucggcgccgauauucagaacaccacauuuaucaucgacgggccugauacccccgaauguccugacggacagagagccuggaauauuugggaggucgaggauuauggcuucggcaucuuuacgacaaacauuuggcugaagcuucgcgacagcuacacccagaugugcgaucaccggcucauguccgcugcgaucaaagacagcaaggccguucaugcugauaugggguauuggauugaaucugagaaaaaugaaacauggaagcuggccagagccuccuucaucgaggugaagaccuguacauggcccaaaagccacacccuguggucuaacggagugcucgaauccgagaugaucauuccgaagaucuacggcgggccuauuagccaacauaauuaucgccccggauacuucacgcagaccgcuggcccuuggcaccuggggaaacuugagcuggacuuugaucucugcgaaggaacaaccgucgugguugacgagcacugcggcaaccggggccccucucugagaacaaccacggugacagggaagaucauucaugaaugguguugccggagcuguacccugccuccccuucgcuucagaggagaggauggcugcugguacgggauggagauccggccggucaaagaaaaggaggaaaaucucgugagauccaugguuagcgccggaucuggcgagguggacuccuuuagccuggggauccugugugucuccauuaugaucgaagaggugaugcgcucucgguggagcagaaagaugcucaugacaggaacccuggcgguuuuccuucugcucauuaugggccagcugaccuggaacgaccugauccgccuuugcauuauggugggcgcuaaugccuccgauagaauggggaugggaacaacguaucuggcccucauggcuaccuuuaaaaugcggccuauguucgccgucggccugcucuuucgcagacugacaucucgggaggugcuucugcucaccaucgggcugagccugguggcguccgucgaacuucccaacucucuggaggaacucggagacggccuggcuauggggauuaugaugcucaagcugcuuacagaguuccaaccccaccagcuguggaccacgcuccugagccugacauuuguuaaaaccacccuuucccuggauuacgccuggaagacaaccgccauggugcucagcaucgugucucuguucccucucugucuguccacaacgagccagaaaaccacauggcuuccgguccugcugggaucuuuuggcugcaagccccucaccauguucuuuaucacagaaaacaagauuuggggccgcaaauccuggccucugaaugaggggaucauggcuauuggaaucgugagcauucuucugucuucccuccugaagaacgacguuccccucgccggcccucugaucgcugggggaaugcuuaucgccuguuaugugauuagcggcuccagcgcggaucugucucuggagaaagccgcugaagucagcugggagcaggaagccgagcauuccggggcuucucacaauauccucguggaaguucaagacgauggaaccaugaagauuaaagacgaggagagagaugacacgcugaccauccuucugaaggccacacuccuggccgugagcggcgucuaccccauguccauuccugcuacccucuucgugugguauuucuggcagaaaaagaagcagcggucuggcguccugugggauacacccagcccgccugaaguggagcgcgcgguucuugacgaugggaucuacagaauccugcagcggggacugcucggccgcucccaagugggggucggaguguuucaggacggcguuuuccauaccauguggcacgugacaagaggggccguccugauguaucagggaaaacggcuugaacccucuugggcuagcgugaagaaagaccugauuuccuacggcggcggguggagauuucagggaagcuggaacacgggcgaggaggugcaaguuaucgccgucgaaccugggaagaaucccaaaaacgugcagaccacaccgggaaccuucaagaccccugagggcgaagugggggccauugcucucgauuuuaagcccggaacaucuggcuccccuaucgucaaucgcgagggcaaaauuguggggcuguacggaaacggcguugugacgaccagcgggacauaugucucugccaucgcgcaggcuaaggccucccaagaaggaccccuccccgagauugaggacgaaguguucaaaaagcggaaucugaccaucauggaucuucacccuggcagcgggaaaacaagacgcuaccugccggccaucguucgggaggcuauuaagagaaagcugcgcacccucauccuggcccccacgcggguggucgcguccgaaauggcugaggcccuuaaaggcaugccuauuagauaucagacaaccgccgugaagucugaacauaccggacgcgagaucguugaccugaugugccacgcuacauuuaccaugcggcuccugagccccgugagagucccuaacuacaauaugauuaucauggaugaggcccauuucacagaccccgcuuccaucgccgcgcggggcuauauuagcacccgcguggggaugggagaagccgcugccaucuuuaugacggcuacaccuccgggcucuguggaggccuucccccaguccaacgccgucauucaggaugaagagagagacaucccugaacggagcuggaauucuggguacgauuggauuaccgacuuucccggaaaaacaguuugguucgugccuagcaucaaguccggcaacgauaucgcuaauugucugcgcaaaaacgggaagagagugauucaacucucucggaagaccuucgacacggaguaucagaaaaccaagaacaaugacugggauuacgucgugacaaccgacaucagcgagaugggcgcgaacuuuagagccgaucgcguuauugacccccggagaugccuuaaaccggugauccugaaggauggaccugaacgcgucauucuggcuggccccaugcccgugacaguugccuccgccgcucagcggagagggcgcaucggacggaaucagaacaaagagggcgaccaauacguguauauggggcagccucucaauaacgaugaagaccacgcccauuggaccgaggcgaagaugcugcuugauaauauuaacacacccgagggaaucaucccugcucuguucgaaccggagagagaaaagucugccgccauugacggcgaguaccgccucagaggggaagcucggaaaaccuuugucgagcugaugcgcagaggcgaucugcccguguggcucagcuauaaggucgccuccgagggauuccaguacagcgaccggcgcuggugcuuugauggcgaaagaaauaaccaggugcuugaggaaaauauggacguugagaucuggacgaaagaaggggagcggaagaaacugagaccucgcuggcuggacgcgcggacauauucugauccccucgcccugagagaguucaaggaauuugcugccggacgccgguccgugagcggcgaccuuauucuggagaucgggaaacucccucaacaccugacccugagagcucagaacgcccucgauaaucuugugaugcugcacaacuccgaacagggaggcaaggcuuaccggcaugccauggaggaacugcccgacaccauugagacacucaugcugcuugcgcugaucgccguccucaccggcgggguuacacuguucuuucugucuggaaagggccucgggaaaacgagcaucggacuucugugugugaccgcuuccucugcccugcucuggauggcuagcguggagccgcacuggauugccgccuccaucauucuggaauucuuucuuaugguccugcucaucccugagcccgaucgccagagaacaccucaagacaaucagcuggcuuaugugguuauuggccugcucuucaugauccuuaccguggcggccaacgaaauggggcugcuggagacaaccaagaaagaucucggaaucggcuacgucgcugccgagaaccaucagcacgccacgaugcuggacguggaucuucggcccgcuagcgccuggacccuguacgcggucgccacaaccgugauuacaccuaugaugcgccacaccaucgaaaauacgacagcuaacauuucucucaccgccaucgcuaaucaagccgcgauucugaugggccuggacaagggguggcccaucuccaaaauggauauuggaguuccgcuccuugcccugggcugcuauagccaggugaacccucugacacucaccgcugccguccugaugcuuguggcucauuacgccaucaucgggcccggacugcaggcuaaggccaccagagaggcgcagaagcggacagccgcuggcauuaugaaaaaucccacgguugacgggaucguggccauugaucucgacccugucguguaugacgcuaaguuugaaaaacaacugggacagaucaugcugcucauucuuuguaccucucagauccugcugaugcgcacaaccugggcccucugcgaguccaucacacuggccaccggcccgcuuacgacacugugggaaggcagccccgggaaguucuggaacaccaccauugcggugucuauggcuaauaucuucagaggaagcuaccucgccggcgcugggcuggccuuuucccugaugaaaucucucggaggcgggcggcgcggaacaggcgcccagggcgagacccuuggggagaaguggaagagacaacugaaccagcugagcaaauccgaauucaauacauauaagcggagcggaauuauggagguugauagauccgaagcuaaagagggccucaagcgcggggaaacgaccaaacacgccgucucucggggaacagcgaagcugagaugguuuguggagcgcaaccuugugaagccugagggcaaagucaucgaccugggguguggacggggcggcuggagcuacuauugcgccgggcucaagaaaguuaccgaagugaagggauacacaaaaggcgggcccggacaugaggaaccuauucccauggcuaccuacggcuggaaucuggugaagcugcacuccgggaaagaugucuucuuuaugccuccggagaagugugacacgcuccuuugcgauaucggagaaucuagccccaacccuaccaucgaggagggcagaacacugcgcgugcugaagaugguugaacccuggcuccggggcaaucaguucuguauuaaaauccugaacccuuauaugcccuccguggucgagacccuugaacagaugcaaagaaagcaugggggaaugcuggugcgcaauccgcucucucggaacagcacacacgagauguacuggguuuccugcggcaccgggaauauugugagcgccgucaacaugacaucuagaaugcugcugaaccgcuuuaccauggcucaccggaaaccuacguaugagagagacguggaucucggagccggcacacgccauguggcggucgaacccgagguugccaaucuggacaucauugggcagagaaucgaaaacauuaagaaugagcacaaauccaccuggcauuacgaugaagacaaccccuauaagaccugggcuuaccacggaagcuaugaggugaagccuucuggcuccgccagcucuauggugaauggcgucgugcggcuucugacaaaacccugggauguuaucccuauggugacgcagaucgcuaugaccgacacaaccccguucgggcaacagcgcgucuuuaaggagaaaguggacacaagaaccccccgggccaagagaggaacaacccagauuauggaaguuacggcuaaauggcucuggggcuuccugucccggaacaagaagccucgcaucuguaccagagaggaauuuacacggaaagugcgcagcaaugccgcgauuggggccgucuucguggaugagaaccaguggaauuccgcuaaggaagccguugaggacgagagauuuugggaucuugugcaccgggaacgcgagcugcauaaacaaggaaagugcgcuaccugcgucuacaacaugaugggcaaaagagaaaagaagcucggggaguucggcaaagccaagggaagccgggccaucugguacauguggcugggcgcgcgcuuccuggaauuugaggcucucggguucaugaaugaggaccacugguuuucuagagaaaacagccuguccggaguggagggcgaagggcuucauaaacugggauauauucuccgggauaucucuaagauccccggcgggaauauguacgccgacgauacagccggcugggacacccgcauuacggaggaugaccugcagaacgaggcuaaaaucacagauauuauggaaccugagcacgcccuucuggcuaccagcaucuucaagcucacauaucagaauaaagucgugagaguucagcggcccgccaagaacggaaccgugauggacgucauuucccgcagagaucaacggggcucugggcaggugggaacguacggccugaacaccuuuacaaauauggaagugcagcugaucagacagauggagagcgaagggaucuuccucccguccgagcuggagaccccuaaccuugcggaacgcguucuggacuggcucgagaagcauggagccgaacggcugaaaagaauggcuauuucuggcgacgauuguguggucaagcccaucgacgaucgcuuugccacagcucuuaccgcccugaaugacauggggaaagugcggaaggauauuccucaaugggagcccagcaaaggcuggaacgacuggcagcagguuccuuucugcucccaccacuuucaucagcucaucaugaaggauggaagagaaauugugguccccugucgcaaucaagacgagcuggugggccgggcgagagucagccagggggccggauggucucugcgcgagacagcuugccucggcaaguccuaugcccagauguggcaacugauguacuuccaccggagagaucuucgccuggcugccaacgcuaucuguagcgccgugccgguugacugggugccuaccucucggacgacaugguccauccaugcgcaccaccaguggaugaccaccgaagauaugcucagcgucuggaauagaguguggauugaggaaaaccccuggauggaggacaaaacacauguuuccucuugggaagaggugcccuaucuggggaagcgggaggaccaguggugcggaagccuuaucggccugaccgccagagcuacaugggccacgaauauucaggucgccaucaaccaagugcgccggcucauugggaaugaaaacuaccuggauuacaugaccuccaugaaaagauuuaagaaugagagcgacccugaaggcgcucugugguga

SEQ ID NO: 18808 - RNA, 9879 nt, Artificial Sequence
  derived and/or modified CDS sequence (opt5) from DENV-1__GU131835__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggugcuucgccaccccggcuucaccgucaucgcuuuuuuccuggcccaugcgauugggacaucuaucacccagaagggaaucauuuuuauccuccugaugcuugugaccccuagcauggccaugagaugcguuggcauugggaaccgggauuucguggagggacuguccggcgcuacaugggucgacguggugcucgagcacgggagcugugucacgaccauggccaagaauaaacccacacuggauaucgaacugcucaagaccgagguuacaaacccugcugugcugcgcaaacuuugcauugaagccaagaucucuaauaccacgacagacuccagauguccgacccaaggagaggcgacccuggccgaagagcaggaugcuaacuuugugugccggcgcacauucgucgacagaggcuggggcaauggguguggacucuuuggcaaagggagccugcuuaccugcgccaaguucaagugcgugacaaaacuggagggaaagauuguucaguacgaaaaccucaaauauucugugaucgucacggugcacaccggcgaucagcaucaaguugggaaugagacaaccgaacacggaacaaucgcuaccauuacgccccaggccccuaccuccgagauccagcugacagacuacggcgcccugacccucgacuguagcccccggacaggccuggauuuuaacgaaauggugcuucugaccaugaaggagaaaucuuggcucguccauaagcagugguuccuggaccuuccucugcccuggacguccggggcuagcacaucccaagagaccuggaaucgccaggaucuccuggugacauuuaaaaccgcgcacgccaagaagcaggaagucgugguucugggaucucaagagggcgcuaugcacaccgcccucacaggggccacggaaauucagaccagcggaacaaccacaaucuucgcuggccaucugaaaugcagacuuaagauggacaaacugacccucaaggggacguccuaugugauguguacaggcagcuucaaacuggagaaggaagucgccgagacccagcacggaaccgugcugguucaggugaaguacgagggcacagaugcgccgugcaaaauuccuuuuucuacccaagacgaaaagggggucacacagaacggacggcuuaucacggcuaaucccaucgugaccgauaaagagaagccugugaacauugaaacagagccccccuucggcgaguccuauaucguugucggggccggagaaaaagcccucaagcugagcugguuuaagaaaggcucuagcauugggaagauguucgaggcuaccgccagaggcgcucgccggauggccauccugggagacacagcgugggauuuuggcuccauugggggaguguucaccucugugggcaaacucguccaucagguguuugggacggccuacggaguucuguucagcggcguguccuggaccaugaagaucgggaucggcauucuucugacauggcucggacugaauagcagaucuaccucccugagcaugacauguaucgcugucggcauggugacccuuuaccucgggguuauggugcaggccgacucuggaugcgucauuaacuggaaaggccgcgaacugaaguguggguccggaaucuuugugacaaacgagguucacaccuggacggaacaauauaaguuccaggcugauagcccuaaacggcuguccgccgcgauuggcaaggccugggaggagggggugugcggcaucagaucugcuacacgccucgaaaauauuauguggaaacagaucagcaacgagcugaaucauauccuucuggaaaacgacaugaaguuuaccgucguggugggagacgccaauggcauucucgcucaggggaaaaagaugauccggccgcaacccauggagcacaaauacuccuggaagucuuggggaaaggccaaaauuaucggcgccgauauucagaacaccacauucaucaucgacgggccugauacccccgaauguccugacgaucagagagcuuggaauauuugggaggucgaggacuauggauuuggcaucuucacgacaaacauuuggcugaagcugcgcgauagcuacacccagaugugcgaccaccggcuuauguccgcggccaucaaagauagcaaggcuguucaugccgacaugggcuauuggauugaaucugagaaaaaugaaacauggaagcucgccagagcuuccuucaucgaggugaagaccuguacauggcccaaaagccacacccuguggucuaacggggugcuggaauccgagaugaucauuccgaagaucuacggaggcccuauuagccaacauaauuaucgccccggguacuuuacgcagaccgccggaccuuggcaccucggcaaacuggagcuugauuucgaccugugcgaagggacaaccgucgugguugaugagcacugcggaaaccggggccccucucucagaacaaccacggugacaggcaagaucauucaugaaugguguugccggagcuguacccugccuccccugcgcuuuagaggggaggacggaugcugguacggcauggagauccggccggucaaagaaaaggaggaaaaucuugugagauccaugguuagcgcggggucuggagagguggacuccuucagccucggcauccugugugucuccauuaugaucgaagaggugaugcgcucucgguggagcagaaagaugcugaugacagggacccucgcuguuuuucugcuucugauuaugggacagcucaccuggaacgaucugauccgccugugcauuauggugggcgccaaugccuccgacagaaugggcauggggacaacguaucuugcucugauggccaccuucaaaaugcggccuauguuugcggucggacuccuguuccgcagacucacaucucgggaggugcugcuucugaccaucggccucagccugguggcuuccgucgaacugcccaacucucuugaggaacugggggauggacucgccaugggcauuaugaugcugaagcuccugacagaguuucaaccccaccagcuuuggaccacgcugcucagccugacauucaucaaaaccacccugucccuugacuacgccuggaagacaaccgcuaugguucugagcaucgugucucucuuuccucugugucucuccacaacgagccagaaaaccacauggcugccggugcuucuggggucuuucggaugcaagccccugaccauguuucucauuacagaaaacaagaucuggggccgcaaauccuggccucugaaugagggcauuauggccaucgggauugucagcauccuucugucuucccuccugaagaacgaugugccccucgcuggaccucugaucgccggcgggaugcuuauugcguguuauguuaucagcggauccagcgccgaccugucucuggagaaagcugccgaagugagcugggagcaggaagcugagcauuccggcaccucucacaauauucucgucgaagugcaagaugacgggacgaugaagaucaaagaugaggagagagacgauacccugacaauucuucugaaggccacccuccuggccguuagcggaguguaccccauguccaucccugcuacacucuucgucugguauuucuggcagaaaaagaagcagcggucuggcgugcugugggacacccccagcccgccugaagucgagcgcgcggugcuugaugacggcaucuacagaauucugcagcgggggcugcucggacgcucccaaguuggcgugggggucuuucaggacggaguguuccauacaauguggcacguuacgagaggcgccgugcugauguaucaggggaaacggcuugaacccucuugggcuagcgucaagaaagaucugaucuccuacggaggcggcuggagauuucaggggagcuggaacaccggagaggaggugcaagugauugccguugaaccuggcaagaaucccaaaaacguccagacaaccccggggaccuucaagacaccugagggagaagugggcgccaucgcucucgacuuuaagcccgggacgucuggauccccuauugugaaucgcgagggcaaaaucgucggccuguacgggaacggagugguuaccacaagcggcaccuaugugucugccauugcgcaggcuaaggccucccaagaagggccccuccccgagaucgaggaugaagucuucaaaaagcggaaucugacaaucauggaccuucacccuggaagcggcaaaaccagacgcuaccugccggccauugugcgggaggcuaugaagagaaagcugcgcacgcucauccuggcccccacacggguuguggcguccgaaauggcugaggcccuuaaagggaugccuauuagauaucagaccaccgccgucaagucugaacauacaggccgcgagaucguggaucugaugugccacgcuaccuuuacaaugcggcuccugagccccguuagagugccuaacuacaauaugauuaucauggacgaggcccauuucaccgaucccgcuuccaucgccgcgcggggauauauuagcacgcgcgucggcaugggggaagccgcugccaucuuuaugacagcuaccccuccgggaucuguggaggccuucccccaguccaacgccgugauucaggacgaagagagagauaucccugaacggagcuggaauucuggcuacgaguggauuacagacuuucccgggaaaaccgucugguucguuccuagcaucaaguccggaaacgauaucgcuaauugucugcgcaaaaacggcaagagagugauucaacucucucggaagacguucgacaccgaguaucagaaaacaaagaacaaugacugggauuacguggucaccacagacaucagcgaaaugggggcgaacuuuagagccgaucgcgugauugacccccggagaugccuuaaaccgguuauccugaaggauggcccugagcgcgugauucuggcuggacccaugcccgucaccguggccuccgccgcucagcggagaggccgcaucgggcggaaucagaacaaagaaggagaccaauacguuuauaugggccagccucucaauaacgaugaggaccacgcccauuggacagaggcgaagaugcugcuugauaauauuaacacccccgaagggaucaucccugcucuguucgagccggaaagagagaagucugccgccauugacggagaauaccgccucagaggcgaggcucggaaaacguuuguggagcugaugcgcagaggggaucugcccgucuggcucagcuauaagguggccuccgaaggcuuccaguacagcgaccggcgcuggugcuuugauggagagagaaauaaccagguccuugaagagaauauggacguggaaaucuggacaaaagagggcgagcggaagaaacugagaccucgcuggcuggacgcgcggaccuauucugauccccucgcccugagagaauucaaggaguuugcugccgggcgccgguccguuagcggagaccuuauucuggaaaucggcaaacucccucaacaccugacccugagagcucagaacgcccucgauaaucuugugaugcugcacaacuccgagcaggggggaaaggcuuaccggcaugccauggaagagcugcccgacacaauugagacccucaugcugcuugcgcugaucgccgugcucacaggcggcgucaugcuguucuuucugucugggaagggacucggcaaaacgagcaucgggcuucuguguguuaccgcuuccucugcccugcucuggauggcuagcguggaaccgcacuggauugccgccuccaucgugcuggaguucuuucuuaugguccugcucauuccugaacccgaucgccagagaacaccucaagacaaucagcuggcuuaugugguuaucggacugcucuucaugauucuuaccguggcggccaacgagaugggccugcuggagacaaccaagaaagaucucgggaucggacaugcugccgccgaaaaccaccagcacgcuacgaugcuggacgucgaucuucggcccgccagcgcguggacccuguacgccguggcuacaaccgucaucacaccuaugaugcgccauaccauugagaauacgacagccaacaucucucucaccgcuauugccaaucaagcggccauccugaugggccuggacaagggcuggcccauuuccaaaauggauaucggggugccgcuccuugcucugggaugcuacagccagguuaacccucugacacucaccgccgcugugcugaugcuugucgcccacuaugcuauuaucggccccgggcugcaggccaaggcgaccagagaagcccagaagcggacagcugccggaaucaugaaaaaucccacgguggacggcauuguugcuaucgaucucgacccuguggucuacgacgccaaguuugagaaacaacuggggcagauuaugcugcucauccuuuguaccucucagauucugcugaugcgcacaaccugggcccucugcgaauccaucacacuggcgaccggaccgcuuacgacacugugggagggcagccccggcaaguucuggaacaccaccaucgcugugucuauggccaauauuuucagagggagcuaucucgcuggagccggccuggccuuuucccugaugaaaucucucgggggaggccggcgcgggacaggagcucagggcgagacccuuggcgaaaaguggaagagacaacugaaccagcugagcaaaccugaguucaauacauacaagcgguccgggaucauggaaguggauagaagcgaggccaaagaaggacucaagcgcggcgagacgaccaaacaugcgguuucccgggggacagccaagcugagaugguuugucgagcgcaaccuugugaagcccgaaggaaaagugauugaccugggcugugggcggggaggcuggucuuauuacugcgcuggccucaagaaagucaccgagguuaagggguauacaaaaggaggcccugggcacgaagagcccaucccuauggccaccuacggauggaaucuggugaagcugcauagcggcaaagauguguucuuuaugccgcccgaaaagugugacacgcuccuuugcgauauuggggaguccucuccuaaccccaccaucgaggaaggaagaacacugcgcguccugaagaugguggagccuuggcuccggggcaaucaguucuguaucaaaauucugaaccccuacaugccgaccguuguggaaacacuugagcagaugcaaagaaagcacggcgggaugcugguccgcaauccucucagccggaacuccacccacgagauguauugggugucuugcggaacaggcaauaucguuagcgcugugaacaugaccuccagaaugcugcugaaccgcuuuacgauggcccaucggaaacccacauacgaaagagacgucgaucucggggcgggaacccgccacguggccguggagcccgaagucgcuaaucuggacauuaucggccagagaauugagaacaucaagaaugaacauaaaagcaccuggcacuaugaugaggacaacccuuacaagacaugggccuaucacgggucuuacgagguuaagcccuccggaagcgcuucuuccauggugaauggcgugguccggcuucugacgaaaccuugggaugugauuccgaugguuacccagaucgccaugacagacaccacacccuucggccaacagcgcguguuuaaggaaaaagucgacaccagaacaccucgggcuaagagagggaccacgcagaucauggaggugaccgccaaauggcucuggggauuccugagccggaacaagaagccccgcauuuguacaagagaagaguuuacccggaaaguucgcucuaaugcggccaucggcgcuguguucgucgaugaaaaccaguggaauuccgccaaggaggcuguggaggacgaaagauuuugggaucuuguucaucgggagcgcgaacugcacaaacaagggaagugcgccacaugcguguauaacaugaugggaaaaagagagaagaagcucggcgaauucgggaaagccaagggcagccgggcgauuugguacauguggcugggagcucgcuuccuggaguuugaggcccucggcuucaugaaugaagaccauugguuuuccagagagaacagccugucuggggucgaaggagagggccuucacaaacugggguacauccuccgggauauuagccgcaucccuggaggcaauauguaugccgacgauaccgcugggugggacacgagaaucacagaggaugaccugcagaacgaagccaagauuaccgauaucauggagcccgaacaugcucuucuggccacauccauuuucaaacucaccuaccagaauaaggugguccgggugcagcgcccggcgaaaaacggcacgguuauggacgugaucucuagacgggaucaaagaggaagcggccaggucgggaccuauggacugaacacauuuaccaauauggaggugcagcugauucgccagauggaauccgagggcaucuuccucccuucugagcuggaaacacccaaccuugccgagcgggugcuggacuggcucgaaaagcacggggcugagagacugaagcgcauggccaucagcggagacgauuguguugugaaaccuauugacgaucgguuugcuaccucccuuacagcccugaaugacaugggcaaggucagaaaagauaucccccaaugggaaccuucuaagggguggaacgacuggcagcaggugcccuucugcagccaccauuuucaccagcucauuaugaaagauggccgcgagaucguugugccgugucggaaucaagacgagcuggucggaagagcgcgcgugucccagggcgccggguggagccugcgggaaaccgcuugccucggaaagucuuacgcccagauguggcaacugauguauuuccauagacgcgaucuucggcuggcugccaacgcuauuuguuccgccgucccuguggacuggguucccacgagcagaacaaccuggucuauccacgcgcaccaucaguggaugaccacagaggauaugcucuccguguggaaucgggucuggaucgaagagaaccccuggauggaagacaagacccacgugagcuccugggaggagguuccuuaccugggcaaaagagaagaccaguggugcgggucucuuauuggacugacagcccgcgcuacgugggccaccaauauccagguggccauuaaccaaguccggagacucaucggcaaugagaacuaucuggauuacaugacaagcaugaagcgcuuuaaaaaugaauccgaccuggagggggcucucugguga

SEQ ID NO: 18809 - RNA, 9879 nt, Artificial Sequence
  derived and/or modified CDS sequence (opt5) from DENV-1__GU131836__SS-prME
agcgugacaaugcugcucaugcugcuucccacagcccuggcuuuccaccucacgaccagaggcggggaaccucauaugaucgucuccaagcaggaacggggaaaaucucugcuuuuuaagacaagcgccggcguuaacaugugcacccugauugcgauggaccucggggaacugugugaagauacaaugaccuacaaaugcccccgcaucacagaggcugaacccgacgauguggacuguuggugcaaugccaccgauacgugggugaccuauggaacauguucccagaccggcgagcacagacgggacaagcgcucugucgcccuggcuccucauguggggcucggacuggagacaagaaccgaaacguggaugagcuccgagggcgccuggaaacagauucagcggguugaaacaugggcucuuagacaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccagggagaggccacccucguggaagaacaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggacguccuaugugauguguacaggcagcuucaaacuggagaaggaagucgccgagacccagcacggaaccgugcuuguucaggugaaguacgagggcacagaugcgccgugcaaaauuccuuucucuacccaagacgaaaagggggucacacagaacggacggcucaucacggcuaaucccaucgugaccgauaaagagaagccugugaacauugaaacagagccgcccuuuggcgaguccuauaucguugucggggccggagaaaaagcccugaagcugagcugguucaagaaaggcucuagcauugggaagauguuugaggcuaccgccagaggcgcucgccggauggccauccucggagacacagcgugggauuucggcuccauugggggaguguuuaccucugugggcaaacugguccaucagguguucgggacggccuacggaguucuuuuuagcggcguguccuggaccaugaagaucgggaucggcauucugcucacauggcugggacugaauagcagaucuaccucccuuagcaugacauguaucgcugucggcauggugacccucuaccuggggguuauggugcaggccgacucuggaugcgucauuaacuggaaaggccgcgaacugaaguguggguccggaaucuucgugacaaacgagguucacaccuggacggaacaauauaaguuucaggcugauagcccuaaacggcucuccgccgcgauuggcaaggccugggaggagggggugugcggcaucagaucugcuacacgccuggaaaauauuauguggaaacagaucagcaacgagcuuaaucauauccugcucgaaaacgacaugaaguucaccgucguggugggagacgccaauggcauucugguccaggggaaaaagaugauccggccgcaacccauggagcacaaauacuccuggaagucuuggggaaaggcuaaaauuaucggcgccgauauucagaacaccacauuuaucaucgacgggccugauacccccgaauguccugacgaucagagagccuggaauauuugggagguugaggacuauggauucggcaucuuuacgacaaacauuuggcugaaacuucgcgauagcuacacccagaugugcgaccaccggcucauguccgcugcgaucaaagauagcaaggccgugcaugcugacaugggcuauuggauugaaucugagaaaaaugaaacauggaagcuguccagagccagcuucaucgaggugaagaccuguacauggcccaaaucucacacccugugguccaacgggguccucgaaagcgagaugaucauuccgaagaucuacggaggcccuauuucucaacauaauuaucgccccggguacuucacgcagaccgccggaccuuggcaccugggcaaacuugagcuggauuuugaccucugcgaagggacaaccgugguuguggaugagcacugcggaaaccggggccccagccugagaacaaccacggucacaggcaagaucauucaugaaugguguugccgguccuguacccugccuccccuucgcuucagaggggaggacggaugcugguacggcauggagauccggccggugaaagaaaaggaggaaaaucucguuagaagcauggugucugcuggguccggagaggucgacagcuuuucccugggcauccugugugugucuauuaugaucgaagagguuaugcgcagccggugguccagaaagaugcucaugacagggacccuggccguguuccuucugcucauuaugggacagcugaccuggaacgaucugauccgccuuugcauuauggucggcgcgaaugcuucugacagaaugggcauggggacaacguaucuggcccucauggccaccuuuaaaaugcggccuauguucgcugugggacugcucuuucgcagacugacaagccgggaggugcuucugcucaccaucggccugucccuggucgccucuguugaacuucccaacagccuggaggaacucggggauggacuggcgaugggcauuaugaugcucaagcugcuuacagaguuccaaccccaccagcuguggaccacgcuccugucccugacauuuaucaaaaccacccuuagccuggacuacgcuuggaagacaaccgccauggcccucucuaucgugucccuguucccucucugucugagcacaacgucucagaaaaccacauggcuuccggugcugcugggguccuuuggaugcaagccccucaccauguuccugauuacagaaaacaagaucuggggccgcaaaagcuggccucuuaaugagggcauuauggcuaucgggauugucucuauccugcucuccagccugcucaagaacgaugugccccuggccggaccucuuaucgcuggcgggaugcugauugccuguuauguuaucuccggaagcucugcggaccugagccucgagaaagccgcugaaguguccugggagcaggaagccgagcauucuggcaccagccacaauauucuggucgaagugcaagaugacgggacgaugaagaucaaagaugaggagaaggacgauacccuuacaauucugcucaaagcuacccugcucgccguuuccggaguguaccccaugucuaucccugccacacuguuugucugguauuucuggcagaagaagaaacagagaagcggcgugcuuugggacacccccuccccgccugaagucgagcgggcugugcuggaugacggcaucuaccgcauucugcagagagggcuccugggacggucucaaguuggcgugggggucuuccaggacggaguguuucauacaauguggcacguuacgcgcggcgcggugcuuauguaucaggggaagagacuggaacccagcugggccuccgucaaaaaggaucucaucagcuacggaggcggcuggcgguuccaggggucuuggaacaccggagaggaggugcaagugauugcuguugaaccuggcaaaaaucccaagaacguccagacaaccccggggaccuuuaagacaccugagggagaagugggcgccaucgcccuggacuucaaacccgggacguccggaagcccuauugugaauagagagggcaagaucgucggccucuacgggaacggagugguuaccacaucuggcaccuauguguccgcuauugcccaggcgaaagcuagccaagaagggccccugcccgagaucgaggaugaagucuuuaagaaacgcaaucuuacaaucauggaccugcacccuggauccggcaagacccggagauaccugccggccauugugcgcgaggccaucaagcggaaacucagaacgcugauucuugcucccacacgcguuguggccucugaaauggcggaggcucugaaggggaugccuauccgguaucagaccaccgccgucaaaagcgaacauacaggcagagagauuguggaucucaugugccacgccaccuucacaaugcgccugcugucccccguucgggugccuaacuacaauaugaucaucauggacgaggcucauuuuaccgaucccgccagcauugcugccagaggauauaucucuacgcgggucggcaugggggaagcggccgcuauuuucaugacagccaccccuccgggauccguggaggcuuuuccccagagcaacgccgugauccaggacgaagaacgcgauauuccugaaagaucuuggaauagcggcuacgacuggaucacagauuuccccgggaagaccgucugguuuguuccuuccaucaaaucuggaaacgacauugccaauugucuccggaagaacggcaagcgcgugauccaacuuagcagaaaaacguucgacaccgaguaucagaagaccaagaacaaugauugggacuacguggucaccacagauauuuccgagaugggggcuaacuuccgggcggacagagugaucgauccccgccggugccugaagccgguuauucugaaagacggcccugaaagagugauccucgccggacccaugcccgucaccguggcuucugccgcccagcgccggggcagaauugggcgcaaucagaacaaggagggagaucaauacguuuauaugggccagccucugaauaacgacgaagaucacgcucauuggacagaggccaagaugcuucuggacaauaucaacacccccgaggggaucauuccugcgcucuuugaaccggagcgggaaaagagcgcugccaucgauggagaguacagacugcgcggcgaggccagaaagacguucguggagcugaugcggcgcggggaccuccccgucuggcuuuccuauaaaguggcuagcgagggcuuucaguacucugauagacgguggugcuucgacggagaacgcaauaaccagguccuggaggaaaauauggacguggagauuuggacaaaggaaggcgagcgcaagaagcugcggccuagauggcucgaugcccgcaccuauuccgacccccuggcgcuucgggaguuuaaagaguucgccgcugggagacgcagcguuuccggagaucugauccucgagauuggcaagcugccucaacaccugacccuccgggcccagaacgcucuugacaaucuggugaugcugcacaacucugaacaagggggaaaggccuacagacaugcuauggaggaacuccccgauacaaucgagacccugaugcuucuggcccucaucgcggugcugacaggcggcgucacgcuguuuuuccucagcgggaaaggacuuggcaagaccuccauugggcugcuguguguuauggccucuagcgcucuccuguggauggccuccguggagccgcacuggaucgcugccagcauuauccuugaauuuuuccugauggugcuccugauuccugagcccgaccggcagcgcacaccucaagauaaucagcuggccuaugucgugaucggacuccuuuuuaugauccugaccguugcugcgaacgaaaugggccugcucgagacaaccaaaaaggaccuggggauuggacauguggccgcugagaaccaccagcacgccacgaugcuugaugucgaccugagacccgccucugcuuggacccucuacgccguggcgacaaccgucaucacaccuaugaugcggcauaccauugaaaauacgacagccaacaucucccugaccgcuauugccaaucaagcugccauccugaugggccucgauaaaggcuggcccauuagcaagauggacaucggggugccgcuucuggcgcugggaugcuacucucagguuaacccucucacacugaccgccgcugugcuuaugcuggucgcccacuaugcuaucauuggccccgggcuccaggccaaggcuacccgcgaggcccagaaaagaacagcggccggaaucaugaagaaucccacgguggauggcauuguugcuaucgaccuggacccuguggucuacgaugccaaauucgaaaagcaacuggggcagauuaugcuccuuauccuguguaccucccagauccugcucaugcggacaaccugggcucugugcgagagcauuacacuugccaccggaccgcugacgacacucugggaaggcucucccggcaaauuuuggaacaccaccaucgccgugagcauggcgaauauuuuccgcggguccuaucuggcuggagccggccuggcuuucucucucaugaaaagccuugggggaggcagacgggggacaggagcccagggcgagacccugggcgagaaguggaaacgccaacugaaccagcucuccaagagcgaauuuaauacauacaaaagauccgggaucauggagguggaccggucugaagccaaggagggacugaaaagaggcgaaacgaccaagcaugcuguuagccgcgggacagccaaacuucggugguucgucgagagaaaccuggugaaaccugagggaaaggugauugaucucggcugugggcgcggaggcugguccuauuacugcgcgggccugaaaaaggucaccgaaguuaaaggguauacaaagggaggccccgggcacgaggaaccuauccccauggccaccuacggauggaaucuggugaaacuccauucuggcaaggacguguuuuucaugccuccggagaagugugauacgcuucugugcgacaucggggaaagcucccccaacccuaccauugaggagggacggacacugagaguccucaaaaugguggaacccuggcugcgcggcaaucaguuuuguaucaagauucuuaacccuuacaugcccucuguuguggagacccuggaacagaugcaacggaaacacggcgggaugcucgucagaaauccgcugagccgcaacuccacacacgagauguauugggugagcugcggaaccggcaauaucguuucugcugugaacaugacaucccggaugcugcucaacagauucaccauggcccaucgcaagccuacguacgagcgggaugucgaccugggggcuggaacaagacacguggccguggaacccgagguccccaaucuugauauuaucggccagcgcauugaaaacaucaaaaaugagcauaagagcaccuggcacuaugacgaagauaacccuuacaagaccugggcguaucacgggucuuacgagguuaaacccuccggaagcgccucuuccauggugaauggcguggucagacugcucacaaagccuugggacgugaucccgaugguuacgcagauugcuaugaccgacacaacccccuuuggccaacagcggguguucaaagagaaggucgauacacgcaccccuagagccaaacgggggacaacccagaucauggaagugacggcuaaguggcuguggggauuucuuagcagaaacaagaaaccccggauuuguacccgcgaggaguucacaagaaagguucgguccaaugccgcuaucggcgccguguuugucgacgagaaccaguggaauagcgcgaaagaagccguggaggaugagcgcuucugggaccugguucauagagaacgggagcuccacaagcaagggaaaugcgcuaccugcguguauaacaugaugggaaagcgcgaaaagaaacugggcgaguuugggaaggccaaaggcucuagagcuauuugguacauguggcugggagcccgguuccucgaguucgaggcccugggcuuuaugaaugaggaucauugguucagccgcgaaaacucccuuucuggggucgagggagaaggccugcacaagcucggguacauccugagagacaucagcaaaauuccuggaggcaauauguaugcggaugacacagcugggugggauacccggaucacggaggacgaucuucagaacgaggccaagauuacagacaucauggaacccggccaugcccugcucgcuaccuccauuuuuaaacugacauaccagaauaaggugguccgcgugcagagaccggccaagaacggaaccguuauggaugugaucucucggcgcgaccaaagaggcagcgggcaggucggaacguauggccugaacaccuucacaaauauggaggugcagcucauccggcagauggaauccgaggggauuuuucugccuucugaacuugagacccccaaccuggcugagagagugcucgacuggcuggaaaaacacggagccgagcgccuuaagcggauggcgaucagcggcgaugacuguguugugaaaccuauugaugacagauucgccacagcucugaccgcccucaaugauauggggaagguccgcaaagacaucccccaaugggaaccuuccaagggcuggaacgauuggcaacaggugcccuuuugcagccaccauuuccaccagcugauuaugaaggacggacgggagaucguugugccguguagaaaucaagaugaacuggucggccgcgcucgggugucucagggggccggauggucccucagagagacagcgugccugggcaaaagcuacgcccagauguggcaacuuauguauuuucaucgccgggaccugagacucgcugccaacgcuaucuguucugccgucccuguggauuggguucccaccucccgcacgacauggagcauucacgcucaccaucaguggaugaccaccgaggacaugcuguccguguggaaucgggucuggaucgaagagaaccccuggauggaagacaagacacacgugucuagcugggaggaaguuccuuaccuugggaaaagagaggaucaguggugcggaucccugauuggccucaccgcccgggcgacaugggccacgaauauccagguggcuauuaaccaagucagacgccugaucgggaaugagaacuaucuggacuacaugaccagcaugaagcgguucaaaaaugaaucugauccggagggcgcccucugguga

SEQ ID NO: 18810 - RNA, 9879 nt, Artificial Sequence
  derived and/or modified CDS sequence (opt5) from DENV-1__GU131837__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugaucgcccuguuucucgcgcaugccauugggacaucuaucacccagaagggaaucauuuucauccugcuuaugcuggucaccccuagcauggcuaugagaugcgugggcauugggaaccgggauuuuguugagggacucuccggcgccacauggguggacgucgugcuggagcacgggagcugugugacgaccauggcuaagaauaaacccacacuggauaucgaacuccugaagaccgaggucacaaacccugccguucuucgcaaacugugcauugaagcgaagaucucuaauaccacgacagacuccagauguccgacccaaggagaggccacccucguggaagagcaggaugcuaacuucgugugccggcgcacauuugucgacagaggcuggggcaauggguguggacuguucggcaaagggagccuucugaccugcgccaaguuuaagugcgugacaaaacucgagggaaagauuguucaguacgaaaaccugaaauauucugugaucgucacggugcacaccggcgaucagcaucaaguugggaaugagacaaccgaacacggaacaaucgcuaccauuacgccccaggccccuaccuccgagauccagcugacagacuacggcgcccucacccuggacuguagcccccggacaggccuugauuucaacgaaauggugcugcucaccaugaaggagaaaucuuggcugguccauaagcagugguuucuugaccugccucuccccuggacguccggggcuagcacaucccaagagaccuggaaucgccaggaucugcuggugacauucaaaaccgcgcacgccaagaagcaggaagucgugguucucggaucucaagagggcgcuaugcacaccgcccugacaggggccacggaaauucagaccagcggaacaaccacaaucuuugcuggccaucuuaaaugcagacugaagauggacaaacucacccugaaggggauguccuaugugauguguacgggcagcuucaaacuggagaaggaagucgccgagacacagcacggaaccgugcuuguucaggugaaguacgagggcaccgaugcgccgugcaaaauuccuuucucuacacaagacgaaaagggggucacccagaacggacggcucaucacagcuaaucccaucgugacggauaaagagaagccugugaacauugaaaccgagccccccuuuggcgaguccuauaucguugucggggccggagaaaaagcccugaagcugagcugguucaagaaaggcucuagcauugggaagauguuugaggcuacagccagaggcgcucgccggauggccauccucggagacaccgcgugggauuucggcuccauugggggaguguuuacaucugugggcaaacugguccaucagguguucgggaccgccuacggaguucuuuuuagcggcguguccuggacgaugaagaucgggaucggcauucugcucaccuggcugggacugaauagcagaucuacaucccuuagcaugaccuguaucgcugucggcauggugacacucuaccuggggguuauggugcaggccgacucuggaugcgucauuaacuggaaaggccgcgaacugaaguguggguccggaaucuucgugaccaacgagguucacacauggaccgaacaauauaaguuucaggcugauagcccuaaacggcucuccgccgcgauuggcaaggccugggaggagggggugugcggcaucagaucugcuacgcgccuggaaaauauuauguggaaacagaucagcaacgagcuuaaucauauccugcucgaaaacgacaugaaguucacagucguggugggagacgccaauggcauucuggcucaggggaaaaagaugauccggccgcaacccauggagcacaaauacuccuggaagucuuggggaaaggccaaaauuaucggcgccgauauucagaacaccaccuuuaucaucgacgggccugauacacccgaauguccugacggacagagagcuuggaauauuugggaggucgaggauuauggcuucggcaucuuuaccacgaacauuuggcugaagcuucgcgacagcuacacacagaugugcgaucaccggcucauguccgcggccaucaaagacagcaaggcuguucaugccgauaugggguauuggauugaaucugagaaaaaugaaaccuggaagcuggccagagcuuccuucaucgaggugaagacauguaccuggcccaaaagccacacacuguggucuaacggagugcucgaauccgagaugaucauuccgaagaucuacggcgggccuauuagccaacauaauuaucgccccggauacuucacccagacggccggcccuuggcaccuggggaaacuugagcuggacuuugaucucugcgaaggaaccacagucgugguugacgagcacugcggcaaccggggccccucucugagaaccacaaccgugacggggaagaucauucaugaaugguguugccggagcuguacacugccuccccuucgcuucagaggagaggauggcugcugguacgggauggagauccggccggucaaagaaaaggaggaaaaucucgugagauccaugguuagcgcgggaucuggcgagguggacuccuuuagccuggggauccugugugucuccauuaugaucgaagaggugaugcgcucucgguggagcagaaagaugcucaugaccggaacacuggcuguuuuccuucugcucauuaugggccagcugaccuggaacgaccugauccgccuuugcauuauggugggcgccaaugccuccgauagaauggggaugggaaccacauaucuggcucucauggccacguuuaaaaugcggccuauguucgcggucggccugcucuuucgcagacugaccucucgggaggugcuucugcucacaaucgggcugagccugguggcuuccgucgaacuucccaacucucuggaggaacucggagacggccuggccauggggauuaugaugcucaagcugcuuaccgaguuccaaccccaccagcuguggacaacccuccugagccugacguuuguuaaaacaacccuuucccuggauuacgccuggaagaccacagcuauggugcucagcaucgugucucuguucccucucugucuguccaccacaagccagaaaacgaccuggcuuccgguccugcugggaucuuuuggcugcaagccccucacaauguuccugaucaccgaaaacaagauuuggggccgcaaauccuggccucuuaaugaggggaucauggccauuggaaucgugagcauucugcucucuucccugcucaagaacgacguuccccuggcuggcccucuuaucgccgggggaaugcugaucgcguguuaugugauuagcggcuccagcgccgaucugucucucgagaaagcugccgaagucagcugggagcaggaagcugagcauuccggggccucucacaauauccugguggaaguucaagacgauggaacaaugaagauuaaagacgaggagagagaugacacccuuacgauccugcucaaggccacccugcucgcugugagcggcgucuaccccauguccauuccugcgacacuguuugugugguauuucuggcagaaaaagaagcagcggucuggcguccuuugggauacccccagcccgccugaaguggagcgcgccguucuggacgaugggaucuacagaauccugcagcggggacuccugggccgcucccaagugggggucggaguguuccaggacggcguuuuucauacaauguggcacgugaccagaggggcuguccuuauguaucagggaaaacggcuggaacccucuugggccagcgugaagaaagaccucauuuccuacggcggcggguggagauuccagggaagcuggaacacaggcgaggaggugcaaguuaucgccgucgaaccugggaagaaucccaaaaacgugcagacgaccccgggaacauuuaagaccccugagggcgaagugggggcuauugcccuggauuucaagcccggaaccucuggcuccccuaucgucaaucgcgagggcaaaauuguggggcucuacggaaacggcguugugacaacgagcgggaccuaugucucugcgaucgcucaggccaaggccucccaagaaggaccccugcccgagauugaggacgaaguguuuaaaaagcggaaucuuacaaucauggaucugcacccuggcagcgggaaaaccagacgcuaccugccggcuaucguucgggaggccauuaagagaaagcuccgcacacugauccuugcgcccacccggguggucgcuuccgaaauggccgaggcccugaaaggcaugccuauuagauaucagacgacagcugugaagucugaacauaccggacgcgagaucguugaccucaugugccacgccaccuucacaaugcggcugcugagccccgugagagucccuaacuacaauaugauuaucauggaugaggcucauuuuaccgaccccgccuccaucgcggcccggggcuauauuagcacacgcguggggaugggagaagcugccgcuaucuucaugaccgccacgccuccgggcucuguggaggccuuuccccaguccaacgcugucauucaggaugaagagagagacaucccugaacggagcuggaauucuggguacgauuggauuacagacuuccccggaaaaaccguuugguuugugccuagcaucaaguccggcaacgauaucgcgaauugucuccgcaaaaacgggaagagagugauucaacuuucucggaagacauucgacaccgaguaucagaaaacgaagaacaaugacugggauuacgucgugaccacagacaucagcgagaugggcgccaacuucagagcugaucgcguuauugacccccggagaugccugaaaccggugauccugaaggauggaccugaacgcgucauucucgccggccccaugcccgugaccguugccuccgcugcccagcggagagggcgcaucggacggaaucagaacaaagagggcgaccaauacguguauauggggcagccucugaauaacgaugaagaccacgcgcauuggacagaggcuaagaugcuucuggauaauauuaacacccccgagggaaucaucccugcccucuuugaaccggagagagaaaagucugccgcuauugacggcgaguaccgccugagaggggaagcccggaaaacauucgucgagcugaugcgcagaggcgaucuccccguguggcuuagcuauaaggucgcguccgagggauuucaguacagcgaccggcgcuggugcuucgauggcgaaagaaauaaccaggugcuggaggaaaauauggacguugagaucuggaccaaagaaggggagcggaagaaacugagaccucgcuggcucgacgcccggacguauucugauccccuggcucuuagagaguuuaaggaauucgccgcuggacgccgguccgugagcggcgaccugauucucgagaucgggaaacugccucaacaccugacacucagagcccagaacgcucuugauaaucuggugaugcugcacaacuccgaacagggaggcaaggccuaccggcaugcgauggaggaacuccccgacaccauugagacccugaugcuucuggcccucaucgcuguccugacaggcgggguuacccuguuuuuccucucuggaaagggccuugggaaaacaagcaucggacugcugugugugacggccuccucugcucuccuguggauggccagcguggagccgcacuggauugccgcuuccaucauucuugaauuuuuccugaugguccuccugaucccugagcccgaucgccagagaaccccucaagacaaucagcuggcguaugugguuauuggccuccuuuuuaugauccugacaguggccgcuaacgaaauggggcugcucgagaccacaaagaaagaucugggaaucggcuacgucgccgccgagaaccaucagcacgcuaccaugcuugacguggaucugcggcccgccagcgcguggacgcucuacgccgucgcuaccacagugauuaccccuaugaugcgccacacaaucgaaaauaccacggccaacauuucucugacagcuaucgccaaucaagcggccauucugaugggccucgacaagggguggcccaucuccaaaauggauauuggaguuccgcuucuggcucugggcugcuauagccaggugaacccucucacccugacagccgcuguccuuaugcugguggcccauuacgcuaucaucgggcccggacuccaggccaaggcgaccagagaggcccagaagcggaccgcugccggcauuaugaaaaaucccacaguugacgggaucguggcuauugaucuggacccugucguguaugacgccaaguucgaaaaacaacugggacagaucaugcuccuuauucuguguacgucucagauccugcucaugcgcaccacaugggcccugugcgaguccaucacccuugcgacaggcccgcugaccacgcucugggaaggcagccccgggaaguuuuggaacacaaccauugcugugucuauggccaauaucuucagaggaagcuaccuggcuggcgccgggcuggccuucucccucaugaaaucucuuggaggcgggcggcgcggaaccggcgcucagggcgagacacugggggagaaguggaagagacaacugaaccagcucagcaaauccgaauuuaauaccuauaagcggagcggaauuauggagguugauagauccgaagccaaagagggccugaagcgcggggaaacaacgaaacacgcggucucucggggaaccgccaagcuuagaugguucguggagcgcaaccuggugaagccugagggcaaagucaucgaccucggguguggacggggcggcuggagcuacuauugcgcugggcugaagaaaguuacagaagugaagggauacaccaaaggcgggcccggacaugaggaaccuauucccauggccacauacggcuggaaucuggugaagcuccacuccgggaaagaugucuuuuucaugccuccggagaagugugacacccuucugugcgauaucggagaaucuagccccaacccuacgaucgaggagggcagaacccugcgcgugcucaagaugguugaacccuggcugcggggcaaucaguuuuguauuaaaauccuuaacccuuauaugcccuccguggucgagacacuggaacagaugcaaagaaagcaugggggaaugcucgugcgcaauccgcugucucggaacagcacccacgagauguacuggguuuccugcggcacagggaauauugugagcgcugucaacaugaccucuagaaugcugcucaaccgcuucacaauggcccaccggaaaccuaccuaugagagagacguggaucugggagcgggcacgcgccauguggccgucgaacccgaggaagcuaaucuugacaucauugggcagagaaucgagaacauuaagaaugaacacaaauccacauggcauuacgaugaggacaaccccuauaagaccugggccuaccacggaagcuaugagguuaagccuucuggcuccgcuagcucuauggugaauggcgugguccggcugcucaccaaacccugggaugugaucccuaugguuacacagaucgccaugacggacaccacaccguuugggcaacagcgcguguucaaggaaaaagucgacaccagaacaccccgggcuaagagaggaaccacacagauuauggaggugaccgccaaauggcuguggggcuuucuuucccggaacaagaagccucgcaucuguacgagagaagaguucacccggaaaguucgcagcaaugcggccauuggggcuguguuugucgaugaaaaccaguggaauuccgccaaggaggcuguggaggacgaaagauucugggaucugguucaccgggagcgcgaacuccauaaacaaggaaagugcgccacaugcguguacaacaugaugggcaaaagagagaagaagcugggggaauuuggcaaagccaagggaagccgggcgaucugguacauguggcugggcgcucgcuuccucgaguucgaggcccugggguuuaugaaugaagaccacugguucucuagagagaacagccuuuccggagucgaaggcgaggggcugcauaaacucggauauauucugcgggauaucucuaagauccccggcgggaauauguacgccgacgauaccgcuggcugggacacacgcauuaccgaggaugaccuucagaacgaagccaaaaucacggauauuauggagccugaacacgcucugcucgccacaagcaucuuuaagcugaccuaucagaauaaaguggucagagugcagcggcccgcgaagaacggaacaguuauggacgugauuucccgcagagaucaacggggcucugggcaggucggaaccuacggccugaacacguucaccaauauggaggugcagcucaucagacagauggaaagcgaggggaucuuucugccguccgagcuugaaacaccuaaccuggccgagcgcgugcucgacuggcuggaaaagcauggaaccgagcggcuuaaaagaauggcuauuucuggcgacgauuguguugugaagcccaucgacgaucgcuucgccacagcucugaccgcccucaaugacauggggaaaguccggaaggauauuccucaaugggaacccagcaaaggcuggaacgacuggcagcaggugccuuuuugcucccaccacuuccaucagcugaucaugaaggauggaagagagauuguugugcccugucgcaaucaagacgagcuggucggccgggcgagagugagccagggggccggauggucucuccgcgaaacagcuugccugggcaaguccuaugcccagauguggcaacuuauguacuuucaccggagagaucugcgccucgcugccaacgcuaucuguagcgccgucccgguggacuggguuccuaccucucggacgacaugguccauccaugcgcaccaccaguggaugaccaccgaggauaugcugagcguguggaauagagucuggauugaagagaaccccuggauggaagacaaaacacauguguccucuugggaggagguucccuaucuugggaagcgggaagaccaguggugcggaagccugaucggccucaccgccagagcuacaugggccacgaauauucagguggccaucaaccaaguccgccggcugauugggaaugagaacuaccuggauuacaugaccuccaugaaaagauucaagaaugaaagcgacccugagggcgcucucugguga

SEQ ID NO: 18811 - RNA, 9879 nt, Artificial Sequence
  derived and/or modified CDS sequence (opt5) from DENV-1__JN819415__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcucggacuggagacaagaaccgaaacguggaugagcuccgagggcgccuggaaacagauucagcggguugaaacaugggcucuucgccaccccggcuucaccgugacagcccuguuucucgcgcaugccaucgggaccucuauuacccagaagggaaucaucuucauucugcuuaugcuggucacaccuagcauggcuaugagaugcgugggcaucgggaaccgggauuuuguugagggacucuccggcgccacguggguggacgucgugcuggagcacgggagcugugugaccacaauggcuaagaauaaacccacccuggauauugaacuccugaagacagaggucaccaacccugccguucuucgcaaacugugcaucgaagcgaagauuucuaauacgacaaccgacuccagauguccgacccaaggagaggccacacucguggaagagcaggaugcuaacuucgugugccggcgcaccuuugucgacagaggcuggggcaauggguguggacuguucggcaaagggagccuucugacaugcgccaaguuuaagugcgugacgaaacucgagggaaagaucguucaguacgaaaaccugaaauauucugugauugucaccgugcacacaggcgaucagcaucaaguugggaaugagaccacagaacacggaaccaucgcuacgaucaccccccaggccccuacauccgagauucagcugaccgacuacggcgcccucacacuggacuguagcccccggaccggccuugauuucaacgaaauggugcugcucacgaugaaggagaaaucuuggcugguccauaagcagugguuucuugaccugccucuccccuggacauccggggcuagcaccucccaagagacauggaaucgccaggaucugcuggugaccuucaaaaccgcgcacgccaagaagcaggaagucgugguucucggaucucaagagggcgcuaugcacacagcccugacgggggccaccgaaauccagacaagcggaaccacaaccauuuuugcuggccaucuuaaaugcagacugaagauggacaaacucacgcugaaggggacauccuaugugauguguaccggcagcuucaaacuggagaaggaagucgccgagacccagcacggaacagugcuuguucaggugaaguacgagggcaccgaugcgccgugcaaaaucccuuucucuacacaagacgaaaagggggucacgcagaacggacggcucauuaccgcuaaucccaucgugacagauaaagagaagccugugaacaucgaaaccgagccccccuuuggcgaguccuauauuguugucggggccggagaaaaagcccugaagcugagcugguucaagaaaggcucuagcaucgggaagauguuugaggcuacagccagaggcgcucgccggauggccauucucggagacaccgcgugggauuucggcuccaucgggggaguguuuacgucugugggcaaacugguccaucagguguucgggaccgccuacggaguucuuuuuagcggcguguccuggacaaugaagauugggaucggcauccugcucaccuggcugggacugaauagcagaucuacaucccuuagcaugaccuguauugcugucggcauggugacacucuaccuggggguuauggugcaggccgacucuggaugcgucaucaacuggaaaggccgcgaacugaaguguggguccggaauuuucgugaccaacgagguucacacguggacagaacaauauaaguuucaggcugauagcccuaaacggcucuccgccgcgaucggcaaggccugggaggagggggugugcggcauuagaucugcuacccgccuggaaaauaucauguggaaacagauuagcaacgagcuuaaucauauccugcucgaaaacgacaugaaguucaccgucguggugggagacgccaauggcauccuggcucaggggaaaaagaugauucggccgcaacccauggagcacaaauacuccuggaagucuuggggaaaggccaaaaucauuggcgccgauauccagaacacaaccuuuauuaucgacgggccugauacgcccgaauguccugacgaucagagagcuuggaauaucugggaggucgaggacuauggauucggcauuuuuacaaccaacaucuggcugaagcuucgcgauagcuacacacagaugugcgaccaccggcucauguccgcggccauuaaagauagcaaggcuguucaugccgacaugggcuauuggaucgaaucugagaaaaaugaaaccuggaagcuggccagagcuuccuucauugaggugaagacauguaccuggcccaaaagccacacgcuguggucuaacggggugcucgaauccgagaugaucaucccgaagauuuacggaggcccuaucagccaacauaauuaucgccccggguacuucacccagacagccggaccuuggcaccugggcaaacuugagcuggauuuuaaccucugcgaagggaccacagucgugguugacgagcacugcggaaaucggggccccucucugagaaccacgacagugaccggcaagauuauccaugaaugguguugccggagcuguacacugccuccccuucgcuucagaggggaggauggaugcugguacggcauggagauucggccggucaaagaaaaggaggaaaaccucgugagauccaugguuagcgcggggucuggagagguggacuccuuuagccugggcauccugugugucuccaucaugauugaagaggugaugcgcucucgguggagcagaaagaugcucaugaccgggacccuggcuguuuuccuucugcucaucaugggacagcugacauggaaugaccugauucgccuuugcaucauggugggcgccaacgccuccgauagaaugggcauggggacgaccuaucuggcucucauggccacauuuaaaaugcggccuauguucgcggucggacugcucuuucgcagacugaccucucgggaggugcuucugcucacaauuggccugagccugguggcuuccgucgaacuucccaacucucuggaggaacucggggacggacuggccaugggcaucaugaugcucaagcugcuuaccgaguuccaaccccaccagcuguggacgacacuccugagccugaccuuuauuaaaaccacacuuucccuggauuacgccuggaagaccacagcuauggcccucagcaucguuucucuguucccucucugucuguccacgaccagccagaaaacaaccuggcuuccggugcugcuggggucuuuuggaugcaagccccucacaauguuccugaucaccgaaaauaagauuuggggccgcaaauccuggccucuuaacgagggcaucauggcuauugggaucgugagcauucugcucucuucccugcucaagaaugacgucccccuggccggaccucuuaucgcgggcgggaugcugaucgccuguuaugugauuagcggauccagcgcugaucugucucucgagaaagccgcugaaguuagcugggagcaggaagccgagcauuccggcacgucucacaacauccugguggaaguccaagacgaugggaccaugaagauuaaagacgaggagaaggaugacacacuuaccauccugcucaaagccacacugcucgcugugagcggaguuuaccccauguccauuccugcgacccuguuugugugguauuucuggcagaagaagaaacagagaucuggcguccuuugggauacacccagcccgccugaaguggagcgggccguccuggacgauggcaucuaccgcauccugcagagagggcuccugggacggucccaagugggcguugggguguuccaggacggagucuuucauacgauguggcacgugacccgcggcgcuguucuuauguaucaggggaagagacuggaacccucuugggccagcgugaaaaaggaccucauuuccuacggaggcggcuggcgguuccaggggagcuggaauacaggagaggagguccaagugaucgccguggaaccuggcaaaaaccccaagaauguucagaccaccccggggacauuuaagacgccugagggagaagucggcgcuauugcccuggauuucaaacccgggaccucuggauccccuaucgugaacagagagggcaagauugugggccucuacgggaauggagucgugacaaccagcggcacauauguuucugcgaucgcucaggccaaagccucccaagaagggccccugcccgagauugaggacgaaguguuuaagaaacgcaaccuuaccaucauggaucugcacccuggaagcggcaagacgcggagauaccugccggcuaucguccgcgaggccauuaagcggaaacucagaacacugauccuugcgcccacccgcgugguugcuuccgaaauggccgaggcccugaaggggaugccuauucgguaucagaccacagcugugaaaucugaacauaccggcagagagaucgucgaccucaugugccacgccacauucaccaugcgccugcugagccccgugcggguuccuaauuacaacaugauuaucauggaugaggcucauuuuacggaccccgccuccaucgcggccagaggauauauuagcacacgggugggcaugggggaagcugccgcuaucuucaugaccgccacaccuccgggaucugucgaggccuuuccccaguccaaugcugugauucaggaugaagagcgcgacaucccugaaagaagcuggaacucuggcuacgauuggauuaccgacuuccccgggaagacggugugguuugucccuagcaucaaauccggaaaugauaucgcgaacugucuccggaagaacggcaagcgcguuauucaacuuucuagaaaaaccuucgacacagaguaucagaagaccaaaaauaacgacugggauuacguggugacaaccgacaucagcgagaugggggccaauuuccgggcugauagagucauugacccccgccggugccugaagccggugauccugaaagauggcccugaaagaguuauucucgccggacccaugcccgugacagucgccuccgcugcccagcgccggggcagaaucgggcgcaaccagaauaaggagggagaccaauacguguauaugggccagccucugaacaaugaugaagaccacgcgcauuggaccgaggcuaagaugcuucuggauaacauuaauacgcccgaggggaucaucccugcccucuuugaaccggagcgggaaaaaucugccgcuauugacggagaguacagacugcgcggcgaagccagaaagacauucguugagcugaugcggcgcggggaucuccccguguggcuuagcuauaaagucgcguccgagggcuuucaguacagcgacagacgguggugcuucgauggagaacgcaacaaucaggugcuggaggaaaacauggacgucgagaucuggaccaaggaaggcgagagaaaaaagcugcggccuagauggcucgacgcccgcaccuauucugauccccuggcucuucgggaguuuaaagaauucgccgcugggagacgcuccgugagcggagaccugauucucgagaucggcaagcugccucaacaccugacacuccgggcccagaaugcucuugauaaccugguuaugcugcacaauuccgaacaggggggaaaggccuacagacaugcgauggaggaacuccccgacaccauugagacacugaugcuucuggcccucaucgcugugcugacgggcggcgugacccuguuuuuccucucugggaaaggacuuggcaagacaagcaucgggcugcugugugucaccgccuccucugcucuccuguggauggccagcguugagccgcacuggauugccgcuuccaucauucuugaauuuuuccugauggugcuccugaucccugagcccgaucggcagcgcacaccucaagacaaccagcuggcguauguggucauuggacuccuuuuuaugauccugaccguggccgcuaacgaaaugggccugcucgagacgaccaaaagagaucuggggaucggacauguugccgccgagaaucaccagcacgcuacaaugcuugacguggaucugcggcccgccagcgcguggacccucuacgccgucgcuacaaccgugauuacgccuaugaugcgccauacaaucgaaaacaccacagccaauauuucucugaccgcuaucgccaaccaagcggccauucugaugggccucgacaagggcuggcccaucuccaaaauggauauuggggucccgcuucuggcucugggaugcuacagccaggugaauccucucacccugacagccgcuguucuuaugcugguggcccacuaugcuaucaucggccccgggcuccaggccaaggcgacgagagaggcccagaagcggaccgcugccggaauuaugaaaaaccccacagucgacggcaucguggcuauugaucuggacccuguuguguacgacgccaaguucgaaaaacaacuggggcagaucaugcuccuuauucuguguaccucucagauccugcucaugcgcacaaccugggcccugugcgaguccaucacgcuugcgacaggaccgcugaccacccucugggaaggcagccccggcaaguuuuggaauacaaccauugcugucucuauggccaacaucuucagagggagcuaucuggcuggagccggccuggccuucucccucaugaaaucucuugggggaggccggcgcgggacaggagcucagggcgagacgcugggcgagaaguggaagagacaacugaaucagcucagcaaauccgaauuuaacaccuacaagcggagcgggauuauggagguggauagauccgaagccaaagagggacugaagcgcggcgaaacaaccaaacaugcggugucucgggggacagccaagcuuagaugguucguugagcgcaaucuggucaagccugagggaaaagugaucgaccucggcugugggcggggaggcuggagcuauuacugcgcuggccugaagaaagugaccgaagucaagggguauacgaaaggaggccccgggcacgaggaaccuauucccauggccaccuacggauggaaccugguuaagcuccauuccggcaaagauguguuuuucaugccuccggagaagugugacacacuucugugcgauaucggggaaucuagccccaauccuaccaucgaggagggaagaacacugcgcgugcucaagauggucgaacccuggcugcggggcaaccaguuuuguauuaaaauccuuaauccuuacaugcccuccgugguugagacccuggaacagaugcaaagaaagcacggcgggaugcucgugcgcaacccgcugucucggaauagcacacacgagauguauugggucuccugcggaaccggcaacauugugagcgcuguuaacaugacgucuagaaugcugcucaaucgcuucacaauggcccaucggaaaccuaccuacgagagagacguggaucugggggcgggaacccgccacgucgccguggaacccgagguggcuaaccuugacaucauuggccagagaaucgaaaauauuaagaacgagcauaaauccacauggcacuaugaugaagacaaucccuacaagacgugggccuaucacgggagcuacgaggucaagccuucuggauccgcuagcucuaugguuaacggcguggugcggcugcucaccaaacccugggaugucaucccuauggugacacagaucgccaugaccgacacaaccccguuuggccaacagcgcguuuucaaggagaaaguggacacaagaaccccccgggcuaagagagggacgacccagauuauggaagucacagccaaauggcuguggggauuucuuucccggaauaagaagccucgcaucuguaccagagaggaauucacacggaaagugcgcagcaacgcggccauuggcgcuguuuuuguggaugagaaucaguggaacuccgccaaggaagcugucgaggacgagagauucugggaucuggugcaucgggaacgcgagcuccacaaacaagggaagugcgccaccugcguuuauaauaugaugggaaaaagagaaaagaagcugggcgaguuugggaaagccaagggcagccgggcgaucugguacauguggcugggagcucgcuuccucgaauucgaggcccugggcuuuaugaacgaggaccauugguucucuagagaaaauagccuuuccgggguggagggagaaggccugcacaaacucggguacauucugcgggauaucucuaagauccccggaggcaacauguaugccgacgauacggcugggugggacacacgcauuaccgaggaugaccuucagaaugaggccaaaaucacagauauuauggaaccugagcaugcucugcucgccaccagcaucuuuaagcugacguaccagaacaaagucgugagaguccagcggcccgcgaagaacggcaccgugauggacguuauuucccgcagagaucaacggggaucuggccagguggggacauauggacugaauaccuucacaaacauggaaguccagcucaucagacagauggagagcgaaggcaucuuucugccguccgagcuugagaccccuaaucuggccgaacgcgugcucgacuggcuggagaagcacggggcugaacggcuuaaaagaauggccauuucuggagacgauugugugguuaagcccaucgacgaucgcuucgcuacagcccugaccgcgcucaacgacaugggcaaagugcggaaggauauuccucaaugggagcccagcaaaggguggaaugacuggcagcaggucccuuuuugcucccaccauuuccaccagcugaucaugaaggauggcagagaaauugugguucccugucgcaaccaagacgagcuggugggacgggccagagucagccagggcgcuggguggucucuccgcgagacggccugccugggaaaguccuacgcucagauguggcaacuuauguauuuucaucggagagaucugcgccucgccgcuaaugccaucuguagcgcggugccggucgacugggugccuacaucucggaccaccugguccauccacgcccaccaucaguggaugacaaccgaagauaugcugagcguuuggaacagaguguggauugaggaaaaucccuggauggaggacaaaacacacgucuccucuugggaagaggugcccuaccuuggcaagcgggaggaccaguggugcgggagccugaucggacucacggcuagagccaccugggccacaaacauucagguugcuaucaaucaagugcgccggcugauuggcaacgaaaauuaucuggauuacaugaccuccaugaaaagauucaagaacgagagcgacccugaaggggcccucugguga

SEQ ID NO: 18812 - RNA, 9879 nt, Artificial Sequence
  derived and/or modified CDS sequence (opt5) from DENV-1__GU131838__SS-prME
agcgugaccaugcugcucaugcugcuucccaccgcccuggcuuuccaccucacgacccggggcggggagccucauaugaucgucuccaagcaggaacgggggaaaucucugcuuuuuaagacaagcgccggcguuaauaugugcacccugauugcgauggaccucggggagcugugugaagauacaaugaccuacaaaugcccccgcaucacagaggcugaacccgacgauguggacuguuggugcaaugccaccgauacgugggugaccuauggaacauguucccaaaccggcgagcaccggcgggagaagcgcucugucgcccuggcuccucauguggggcucggacuggaaacaagaaccgagacguggaugagcuccgaaggcgccuggaaacagauucagcggguugagacaugggcucuuagacaccccggcuucaccgugaucgccuuuuuccuggcgcaugccauugggacaucuaucacccagaagggaaucauuuuuauccuccugaugcuugucaccccuagcauggcuaugagaugcgugggcauugggaaucgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagauuguucaguacgagaaccucaaauauucugugaucgucacggugcacaccggcgaccagcaucaaguugggaaugaaacaaccgagcacggaacaaucgcuaccauuacgccccaggccccuaccuccgaaauccagcugacagauuacggcgcccugacccucgacuguagcccccggacaggccuggacuuuaacgagauggugcuucugaccaugaaggagaaaucuuggcucguccauaagcagugguuccuggaucuuccucugcccuggacguccggggcuagcacaucccaagaaaccuggaaucgccaggaccuccuggugacauuuaaaaccgcgcacgccaagaagcaggaggucgugguucugggaucucaagaaggcgcuaugcacaccgcccucacaggggccacggagauucagaccagcggaacaaccacaaucuucgcuggccaucugaaaugcagacuuaagauggauaaacugacccucaaggggauguccuaugugauguguacgggcagcuucaaacuggaaaaggaggucgccgagacacagcacggaaccgugcugguucaggugaaguacgaaggcaccgacgcgccgugcaaaauuccuuuuucuacacaagaugagaagggggucacccagaacggacggcuuaucacagcuaaucccaucgugacggacaaagaaaagccugugaacauugagaccgagccgcccuucggcgaauccuauaucguugucggggccggagagaaagcccucaagcugagcugguuuaagagaggcucuagcauugggaaaauguucgaagcuacagcccgcggcgcucggagaauggccauccugggagauaccgcgugggacuuuggcuccauugggggaguguucacaucugugggcaagcucguccaucagguguuugggaccgccuacggaguucuguucagcggcguguccuggacgaugaaaaucgggaucggcauucuucugaccuggcucggacugaauagccgcucuacaucccugagcaugaccuguaucgcugucggcauggugacacuuuaccucgggguuauggugcaggccgauucuggaugcgucauuaacuggaagggccgggagcugaaauguggguccggaaucuuugugaccaacgaaguucacacauggaccgagcaauauaaguuccaggcugacagcccuaagagacuguccgccgcgauuggcaaagccugggaggaaggggugugcggcauccgcucugcuacgcggcucgagaauauuauguggaagcagaucagcaacgaacugaaucauauccuucuggagaacgauaugaaauuuacagucguggugggagacgccaauggcauucucgcucaggggaagaaaaugaucagaccgcaacccauggaacacaaguacuccuggaaaucuuggggaaaggccaagauuaucggcgccgacauucagaacaccaccuucaucaucgaugggccugacacacccgaguguccugauggacagcgcgcuuggaauauuugggaggucgaagacuauggcuuuggcguuuucaccacgaacaucuggcugaaacugcgggauagcuacacacagaugugcgaccacagacuuauguccgcggccauuaaggauagcaaagcugugcaugccgacaugggguauuggaucgagucugaaaagaaugagaccuggaaacucgcccgcgcuuccuucauugaagugaagacauguaccuggcccaagagccacacacuguggucuaacggaguccuggaguccgagaugaucaucccgaaaauuuacggcgggccuaucagccaacauaauuaucggcccggauacuuuacccagacggccggcccuuggcaccucgggaagcuggaacuugauuucgaccugugcgagggaaccacagugguuguggaugaacacugcggcaacagaggccccucucuccggaccacaaccgucacggggaaaauuauccaugagugguguugccgcagcuguacacugccuccccugagauuucggggagaggacggcugcugguacgggauggaaauuagaccggugaaggagaaagaagagaaucuuguucgcuccauggugagcgcgggaucuggcgaagucgauuccuucagccucgggauccuguguguguccaucaugauugaggagguuaugcggucuagauggagccgcaagaugcugaugaccggaacacucgcuguguuucugcuucugaucaugggccagcucaccuggaacgaccugauuagacugugcaucauggucggcgccaaugccuccgaccggauggggaugggaaccacauaucuugcucugauggccacguucaagaugcgcccuauguuugcggugggccuccuguucagacggcucaccucucgcgaagugcugcuucugacaauugggcucagccuggucgcuuccguugagcugcccaacucucuugaagaacugggagauggccucgccauggggaucaugaugcugaaacuccugaccgaauuucaaccccaccagcuuuggacaacccugcucagccugacguucgugaagacaacccugucccuugacuacgccuggaaaaccacagcuauggugcugagcauugucucucucuuuccucugugucucuccaccacaagccagaagacgaccuggcugccggugcuucugggaucuuucggcugcaaaccccugacaauguuucucaucaccgagaacaagaucuggggcagaaaguccuggccucugaaugaggggauuauggccaucggaauuguuagcauccuucugucuucccuccugaaaaacgaugugccccucgcuggcccucugauugccgggggaaugcuuaucgcguguuaugucaucagcggcuccagcgccgaccugucucuggaaaagacagcugaggugagcugggaacaggaggccgaacauuccggggcuucucacaauauucucguugaggugcaagaugacggaaccaugaaaaucaaggaugaggaacgggacgauacgcugaccauucuucugaaagccacacuccuggccgucagcggcguguaccccauguccaucccugcuacccucuucgucugguauuucuggcagaagaaaaagcagcgcucuggcgugcugugggacacacccagcccgccugagguugaaagagcggugcuugaugacgggauuuaccggauccugcagcgcggacugcucggcagaucccaagucggggugggaguuuuucaggauggcguguuccauaccauguggcacgucacaagaggggccgugcugauguaucagggaaagagacuugagcccucuugggcuagcgugaaaaaggaccugaucuccuacggcggcggguggcgcuuucagggaagcuggaacacgggcgaggaaguucaagucauugccguggagccugggaaaaaucccaagaacgugcagaccacaccgggaaccuucaaaaccccugaaggcgaggucggggccaucgcucucgacuuuaagcccggaacaucuggcuccccuauugugaaucgggaaggcaagaucguugggcuguacggaaacggcguggucacgaccagcgggacauaugugucugccauugcgcaggcuaaagccucccaagagggaccccuccccgagaucgaagaugagguuuucaagaaaagaaaucugaccauuauggaccuucacccuggcagcgggaagacacgccgguaccugccggccaucgugagagaagcuaucaaacgcaagcugcggacccucauucuggcccccacgagagucguggcguccgagauggcugaagcccuuaagggcaugccuauccgcuaucagacaaccgccguuaaaucugagcauaccggacgggagauuguggaucugaugugccacgcuacauuuaccaugagacuccugagccccguccgggugccuaacuacaauaugaucauuauggacgaagcccauuucacagaucccgcuuccaucgccgcgcgcggcuauaucagcaccagaguggggaugggagaggccgcugccauuuuuaugacggcuacaccuccgggcucugucgaagccuucccccaguccaacgccguuauccaggacgaggaacgggauauuccugagcgcagcuggaacucuggguacgacuggaucaccgauuuucccggaaagacagugugguucgugccuagcauuaaauccggcaacgacaucgcuaauugucugagaaagaacgggaaacgggucauccaacucucuagaaagaccuucgauacggaguaucagaagaccaaaaacaaugacugggacuacgugguuacaaccgauauuagcgaaaugggcgcgaacuuucgcgccgaccgggugaucgaucccagacgcugccuuaagccggucauucugaaagacggaccugagcgggugauccuggcuggccccaugcccguuacaguggccuccgccgcucagagacgcgggcggauuggaagaaaucagaacaaggaaggcgaucaauacgucuauauggggcagccucucaauaacgacgaggaucacgcccauuggaccgaggcgaaaaugcugcuugacaauaucaacacacccgaaggaauuaucccugcucuguucgagccggaacgcgagaagucugccgccaucgauggcgaauacagacucagaggggaagcucgcaagaccuuuguggagcugaugagacggggcgaccugcccgucuggcucagcuauaaaguggccuccgaaggauuccaguacagcgaucgcagauggugcuuugacggcgagcggaauaaccagguucuugaagagaauauggauguggaaauuuggacgaaggagggggagcgcaagaaacugcgcccucgguggcuggacgcgagaacauauucugacccccucgcccugcgcgaguucaaagaguuugcugccggacggagauccgugagcggcgaucuuauccuggaaauugggaaacucccucaacaccugacccugcgggcucagaacgcccucgacaaucuugucaugcugcacaacuccgagcagggaggcaaggcuuaccgccaugccauggaggaacugcccgauaccaucgagacacucaugcugcuugcgcugauugccguucucaccggcggggugacacuguucuuucugucuggaaagggccucgggaagacgagcaucggacuucugugugugaccgcuuccucugcccugcucuggauggcuagcgucgaaccgcacuggaucgccgccuccauuauccuggaguucuuucuuauggugcugcucauuccugaacccgacagacagcggacaccucaagauaaucagcuggcuuauguugugaucggccuccuguucaugauucuuaccgucgcggccaacgagauggggcugcuggagacaaccaaaaaggaccucggaaucggcuacguggcugccgaaaaccaucagcacgccacgaugcuggaugucgaccuucaccccgcuagcgccuggacccuguacgcgguggccacaaccguuaucacaccuaugaugcgccauaccauugagaauacgacagcuaacaucucucucaccgccauugcuaaucaagccgcgauccugaugggccuggauaaaggguggcccauuuccaagauggacaucggagugccgcuccuugcccugggcugcuauagccaggucaacccucugacacucaccgcugccgugcugaugcuuguugcucacuacgccauuaucgggcccggacugcaggcuaaagccaccagagaagcgcagaagcggacagccgcuggcaucaugaagaaucccacgguggaugggauugucgccaucgaccucgauccugugguguaugacgcuaaauuugagaagcaacugggacagauuaugcugcucauccuuuguaccucucagauucugcugaugcgcacaaccugggcccucugcgaauccaucacacuggccaccggcccgcuuacgacacugugggagggcagccccgggaaauucuggaacaccaccaucgcgguuucuauggcuaauauuuucagaggaagcuaccucgccggcgcugggcuggccuuuucccugaugaagucucucggaggcgggcggcgcggaacaggcgcccagggcgagacccuuggggaaaaauggaagagacaacugaaccagcugagcaaguccgaguucaauacauauaaacggagcggaaucauggaagucgacagauccgaggcuaaggaaggccucaaacgcggggagacgaccaagcaugccgugucucggggaacagcgaaacugagaugguuuguggagcgcaaccuugucaagccugaaggcaagguuauugaucugggguguggacggggcggcuggagcuacuauugcgccgggcucaaaaaggugaccgaggugaaaggauacacaaagggcgggcccggacacgaggaaccuauccccauggcuaccuacggcuggaaucuggucaaacugcauuccgggaaggacguguucuuuaugccuccggaaaaaugugauacgcuccuuugcgacauuggagagucuagccccaacccuaccaucgaggaaggcagaacacugcgcguucugaagaugguggagcccuggcuccggggcaaucaguucuguaucaagauucugaacccuuauaugcccuccgucguggaaacccuugagcagaugcaaagaaaacacgggggaaugcugguucgcaauccgcucucucggaacagcacacacgagauguacuggguguccugcggcaccgggaauaucgucagcgccgugaacaugacaucuagaaugcugcugaaccgcuuuaccauggcucaucggaagccuacguaugaaagagauguggaccucggagccggcacacgccacgucgcgguugagcccgaaguggccaaucuggauauuaucgggcagagaauugagaacaucaaaaaugaacauaaguccaccuggcacuacgacgaggauaaccccuauaaaaccugggcuuaccacggaagcuaugaggugaagccuucuggcuccgccagcucuauggucaauggcgugguucggcuucugacaaagcccugggacgugauuccuauggucacgcagaucgcuaugaccgauacaaccccguucgggcaacagcgcguguuuaaagaaaagguugacacaagaacaccccgggccaaaagaggaacaacccagaucauggaggugacggcuaaguggcucuggggcuuccugucccggaacaaaaagccucgcauuuguaccagagaagaguuuacacggaagguccgcagcaaugccgcgaucggggccguguucguugacgaaaaccaguggaacuccgcuaaagaggccguggaggaugaaagauuuugggaccuuguccaucgggagcgcgaacugcacaagcaaggaaaaugcgcuaccugcguguacaacaugaugggcaagagagagaaaaagcucggggaguucggcaaggccaaaggaagccgggccauuugguacauguggcugggcgcgcgcuuccuggaguuugaggcucucggguucaugaaugaagaucauugguuuucuagagagaacagccuguccggagucgaaggcgaggggcuucacaagcugggauauauccuccgggacauuucuaaaauccccggcgggaauauguacgccgaugacacagccggcugggauacccgcaucacggaggacgaucugcagaacgaagcuaagauuacagacaucauggagccugaacaugcccuucuggcuaccagcauuuucaaacucacauaucagaauaaggugguuagagugcagcggcccgccaaaaacggaaccgucauggaugugaucucccgcagagaccaacggggcucuggacaggugggaacguacggccugaacaccuuuacaaauauggagguucagcugauuagacagauggaaagcgaggggaucuuccucccguccgagcuggaaaccccuaaccuugcggagcgcgcccuggauuggcucgaaaagcacggagcugagcggcugaagagaauggccaucucuggcgacgacuguguggucaaacccauugaugaccgcuuugcuacagcccuuaccgcgcugaaugauauggggaaggugcggaaagacaucccucaaugggaacccagcaagggcuggaacgauuggcagcagguuccuuucugcucccaccauuuucaccagcucauuaugaaagacggaagagagaucgugguccccugucgcaaucaagaugagcuggugggccgggccagagucagccagggggcuggauggucucugcgcgaaacagccugccucggcaaguccuaugcucagauguggcaacugauguacuuccaucggagagaccuucgccuggccgcuaacgccauuuguagcgcggugccgguugauugggugccuaccucucggacgacaugguccauccacgcccaccaucaguggaugaccaccgaggacaugcucagcgucuggaauagaguguggaucgaagagaaccccuggauggaagauaagacacacguuuccucuugggaggaggugcccuaucuggggaaacgggaagaccaguggugcggaagccuuauuggccugaccgcuagagccacaugggccacgaauauccaggucgcuauuaaccaagugcgccggcucaucgggaaugagaacuaccuggacuacaugaccuccaugaagagauuuaaaaaugaaagcgauccugagggcgcccugugguga

SEQ ID NO: 18813 - RNA, 9879 nt, Artificial Sequence
  derived and/or modified CDS sequence (opt5) from DENV-1__GU131839__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcgccggcguuaacaugugcacccugauugcgauggaccucggggagcugugugaagauacaaugaccuacaaaugcccgcgcaucacagaggcugaacccgacgauguggacuguuggugcaaugccaccgauacgugggugaccuauggaacauguucccaaaccggcgagcacagacgggagaagcgcucugucgcccuggcuccucauguggggcucggacuggaaacaagaaccgagacguggaugagcuccgaaggcgccuggaaacagauucagcggguugagacaugggcucuucgccaccccggcuucaccgugaucgccuuuuuccuggcgcaugccauugggacaucuaucacccagaagggaaucauuuuuauccuccugaugcuugucaccccuagcauggcuaugagaugcgugggcauugggaaccgggacuucguugagggacuguccggcgccacauggguggaugucgugcucgaacacgggagcugugugacgaccauggcuaagaauaaacccacacuggacaucgagcugcucaagaccgaagucacaaacccugccguucugcgcaaacuuugcauugaggcgaagaucucuaauaccacgacagauuccagauguccgacccaaggagaagccacccugguggaggagcaggacgcuaacuuugugugccggcgcacauucgucgauagaggcuggggcaauggguguggacucuuuggcaaagggagccugcuuaccugcgccaaguucaagugcgugacaaaacuggaaggaaagacgguucaguacgagaaccucaaauauucugugauugucaccgugcacacaggcgaccagcaucaaguugggaaugaaaccacagagcacggaaccaucgcuacgaucaccccccaggccccuacauccgaaauucagcugaccgauuacggcgcccugacacucgacuguagcccccggaccggccuggacuuuaacgagauggugcuucugacgaugaaggagaaaucuuggcucguccauaagcagugguuccuggaucuuccucugcccuggacauccggggcuagcaccucccaagaaacauggaaucgccaggaccuccuggugaccuuuaaaaccgcgcacgccaagaagcaggaggucgugguucugggaucucaagaaggcgcuaugcacacagcccucacgggggccaccgagauccagacaagcggaaccacaaccauuuucgcuggccaucugaaaugcagacuuaagauggauaaacugacgcucaaggggauguccuaugugauguguacaggcagcuucaaacuggaaaaggaggucgccgagacccagcacggaaccgugcugguucaggugaaguacgaaggcacagacgcgccgugcaaaaucccuuuuucuacccaagaugagaagggggucacacagaacggacggcuuauuacggcuaaucccaucgugaccgacaaagaaaagccugugaacaucgagacagagccccccuucggcgaauccuauauuguugucggggccggagagaaagcccucaagcugagcugguuuaagagaggcucuagcaucgggaaaauguucgaagcuaccgcccgcggcgcucggagaauggccauucugggagauacagcgugggacuuuggcuccaucgggggaguguucaccucugugggcaagcucguccaucagguguuugggacggccuacggaguucuguucagcggcguguccuggaccaugaaaauugggaucggcauccuucugacauggcucggacugaauagccgcucuaccucccugagcaugacauguauugcugucggcauggugacccuuuaccucgggguuauggugcaggccgauucuggaugcgucaucaacuggaagggccgggagcugaaauguggguccggaauuuuugugacaaacgaaguucacaccuggacggagcaauauaaguuccaggcugacagcccuaagagacuguccgccgcgaucggcaaagccugggaggaaggggugugcggcauucgcucugcuacacggcucgagaauaucauguggaagcagauuagcaacgaacugaaucauauccuucuggagaacgauaugaaauuuaccgucguggugggagacgccaauggcauccucguccaggggaagaaaaugauuagaccgcaacccauggaacacaaguacuccuggaaaucuuggggaaaggcuaagaucauuggcgccgacacccagaacacaaccuucaucauugaugggccugacacgcccgaguguccugauggacagcgcgccuggaauaucugggagguugaagacuauggcuuuggcguguucacaaccaacaucuggcugaaacugcgggauagcuacacacagaugugcgaccacagacuuauguccgcugcgauuaaggauagcaaagccgugcaugcugacaugggguauuggaucgagucugaaaagaaugagaccuggaaacucgcccgcgccuccuucauugaagucaagacauguaccuggcccaagagccacacgcuguggucuaacggagugcuggaguccgagaugaucauuccgaaaaucuacggcgggccuaucagccaacauaauuaucggcccggauacuuuacccagacagcuggcccuuggcaccucgggaagcuggaacuugauuucgaccugugcgagggaaccacaguuguggucgaugaacacugcggcaacagaggccccucucuccggaccacgacagugaccgggaaaauuauccaugagugguguugccgcagcuguacacugccuccccugagauuucggggagaggacggcugcugguacgggauggaaauuagaccgguuaaggagaaagaagagaaucuugugcgcuccauggucagcgccggaucuggcgaaguggauuccuucagccucgggauccuguguguuuccauuaugaucgaggaggugaugcggucuagauggagccgcaagaugcugaugaccggaacccucgcggucuuucugcuucugaucaugggccagcucacauggaacgaccugauuagacugugcaucauggugggcgcuaaugccuccgaccggauggggaugggaacgaccuaucuugcccugauggcuacauucaagaugcgcccuauguuugccgugggccuccuguucagacggcucaccucucgcgaaguccugcuucugacaauugggcucagccugguugcguccguggagcugcccaacucucuugaagagcugggagauggccucgcuauggggaucaugaugcugaaacuccugaccgaauuucaaccccaccagcuuuggacgacacugcucagccugaccuucgugaagaccgcccugucccuugacuacgccuggaaaacaaccgcuaugguccugagcauugugucucucuuuccucugugucucuccacaacgagccagaagaccacauggcugccgguucuucugggaucuuucggcugcaaaccccugaccauguuucucaucacagagaacaagauuuggggcagaaaguccuggccucugaaugaggggaucauggccaucggaauugugagcauccuucugucuucccuccugaaaaacgaugucccccucgcuggcccucugauugccgggggaaugcuuaucgcguguuaugugauuagcggcuccagcgccgaccugucucuggaaaaggcugccgagguuagcugggaacaggaggcugaacauuccggggccucucacaauauccucguggagguccaagaugacggaaccaugaaaaucaaggaugaggaacgggacgauacgcugaccauucuucugaaagccacacuccuggcugugagcggcgucuaccccauguccaucccugcgacccucuucgugugguauuucuggcagaagaaaaagcagcgcucuggcguucugugggacacacccagcccgccugagguggaaagagccguccuugauaacgggauuuaccggauccugcagcgcggacugcucggcagaucccaaguggggguuggaguguuucaggacggcgucuuccauaccauguggcacgugacacggggggcugugcugauguaucagggaaagagacuugagcccucuugggccagcguuaaaaaggaucugauuuccuacggcggcggguggcgcuuucagggaagcuggaauacgggcgaggaaguccaagugaucgccguggagccugggaaaaaccccaagaauguccagaccacaccgggaaccuucaaaaccccugaaggcgaggugggggcuaucgcccucgacuuuaagcccggaacaucuggcuccccuauuguuaaccgggaaggcaagaucguggggcuguacggaaauggcgucgugacgaccagcgggacauauguuucugcgauugcucaggccaaagccucccaagagggaccccuccccgagaucgaagacgagguguucaagaaaagaaaccugaccauuauggaucuucacccuggcagcgggaagacacgccgguaccugccggcuaucgucagagaagccauuaaacgcaagcugcggacccucauccuggcgcccacgagagugguugcuuccgagauggccgaagcccuuaagggcaugccuauccgcuaucagacaaccgcugugaaaucugagcauaccggacgggagauugucgaccugaugugccacgccacauuuaccaugagacuccugagccccgugcgggugccuaauuacaacaugaucauuauggaugaagcucauuucacagaccccgccuccaucgcggcccgcggcuauauuagcaccagagucgggaugggagaggcugccgcuaucuuuaugacggccacaccuccgggcucuguugaagccuucccccaguccaaugcugugauccaggaugaggaacgggacauuccugagcgcagcuggaacucuggguacgauuggaucaccgacuuucccggaaagacagugugguucgucccuagcauuaaauccggcaaugauaucgcgaacugucugagaaagaacgggaaacgggugauucaacucucuagaaagaccuucgacacggaguaucagaagaccaaaaauaacgauugggacuacguugugacaaccgacaucagcgaaaugggcgccaauuuucgcgcugaucgggucaucgaccccagacgcugccuuaagccggugauucugaaagauggaccugagcggguuauccuggccggccccaugcccgugacagucgccuccgcugcccagagacgcgggcggauuggaagaaaccagaauaaggaaggcgaccaauacguguauauggggcagccucucaacaaugaugaggaccacgcgcauuggaccgaggcuaaaaugcugcuugauaacaucaauacacccgaaggaauuaucccugcccuguucgagccggaacgcgagaagucugccgcuauugacggcgaauacagacuccggggggaggcccgcaagaccuuugucgagcugaugagacggggcgaucugcccguguggcucagcuauaaaguugcguccgaaggauuccaguacagcgaccgcagauggugcuuugauggcgagcggaacaaucaggugcuugaagagaacauggacguggaaaucuggacgaaggagggggagagaaaaaagcugcgcccucgguggcuggaugccagaacauauucugacccccucgcucugcgcgaauucaaagaguuugccgcuggacggagauccgucagcggcgaccuuauccuggaaauugggaagcucccucaacaccugacccugcgggcccagaaugcucucgauaaccuuguuaugcugcacaauuccgagcagggaggcaaagccuaccgccaugcgauggaagagcugcccgacaccaucgagacacucaugcugcuugcccugauugcugugcucaccggcggggugacacuguucuuucugucuggaaagggccucgggaagacgagcaucggacuucugugugucaccgccuccucugcucugcucuggauggccagcguggaaccgcacuggauugccgcuuccaucauccuggaguucuuucuuaugguucugcucauuccugaacccgauagacagcggacaccucaagacaaccagcuggcguauguggucaucggccugcucuucaugauucuuaccguggccgcuaacgagauggggcugcuggagacaaccaaaaaggaucucggaaucggcuacgucgccgccgaaaaucaucagcacgcuacgaugcuggacguggaucuucaccccgccagcgcguggacccuguacgccguugcuacaaccgugauuacaccuaugaugcgccauaccaucgagaacacgacagccaauaucucucucaccgcuauugccaaccaagcggccauccugaugggccuggacaaaggguggcccauuuccaagauggauaucggagucccgcuccuugcucugggcugcuauagccaggugaauccucugacacucaccucugccguucugaugcuuguggcucacuacgccauuaucgggcccggacugcaggcuaaagccaccagagaagcgcagaagcggacagccgcuggcauuaugaagaaccccacggucgacgggaucguggccaucgaucucgacccugugguuuaugaugcuaaauuugagaagcaacugggacagauuaugcugcucauccuuuguaccucccagauucugcugaugcgcacaaccugggcccucugcgaaagcaucacacuggccaccggcccgcuuacgacacugugggagggcucucccgggaaauucuggaauaccaccauugcggucagcauggcuaacaucuucagaggauccuaccucgccggcgcugggcuggccuuuucucugaugaagagccucggaggcgggcggcgcggaacaggcgcccagggcgagacccuuggggaaaaauggaagagacaacugaaucagcuguccaagagcgaguucaacacauauaaacgguccggaaucauggaaguggacagaucugaggcuaaggaaggccucaaacgcggggagacgaccaagcaugccgugagccggggaacagcgaaacugagaugguuugucgagcgcaaucuuguuaagccugaaggcaaggugauugaccugggguguggacggggcggcugguccuacuauugcgccgggcucaaaaaggugaccgaggucaaaggauacacaaagggcgggcccggacacgaagagccuauccccauggcuaccuacggcuggaaccuggugaaacugcauucugggaaggauguuuucuuuaugccuccggaaaaaugugacacgcuccuuugcgauauuggagagagcucccccaauccuaccaucgaggaaggcagaacacugcgcgugcugaagauggucgagcccuggcuccggggcaaccaguucuguauuaagauccugaauccuuauaugcccucugugguugaaacccuugagcagaugcaaagaaaacacgggggaaugcuggugcgcaacccgcucagccggaauuccacacacgagauguacugggucagcugcggcaccgggaacaucgugucugccgugaacaugacauccagaaugcugcugaaucgcuuuaccauggcucaucggaagccuacguaugaaagagacgucgaucucggagccggcacacgccacguugcgguggagcccgaaguggccaaccuggacauuaucgggcagagaauugagaauaucaaaaacgaacauaagagcaccuggcacuacgaugaggacaaucccuauaaaaccugggcuuaccacggaucuuaugaggucaagccuuccggcagcgccucuuccauggugaacggcguugugcggcuucugacaaagcccugggaugucauuccuauggugacgcagaucgcuaugaccgacacaaccccguucgggcaacagcgcguuuuuagagaaaaaguggauacacggacccccagagccaagcggggaacaacccagauuauggaggucacggcuaaauggcucuggggcuuccugagccgcaauaagaaaccuagaaucuguacccgggaagaguuuacacgcaaggugagauccaacgccgcgaucggggccguuuucguggacgaaaaucaguggaacagcgcuaaggaggccgucgaggacgaacgguuuugggaucuugugcaucgcgagagagaacugcacaaacaaggaaagugcgcuaccugcgucuacaauaugaugggcaaacgggagaagaaacucggggaauucggcaaggccaagggaucucgcgccauuugguacauguggcugggcgcgagauuccuggaguuugaggcucucggguucaugaacgaagaccauugguuuagccgggagaauucccugucuggaguggaaggcgaggggcuucacaaacugggauauauccuccgcgauauuagcaagauccccggcgggaacguuuacgccgacgauacagccggcugggacaccagaauuacggaggaugaccugcagaaugaagcuaaaaucacagauaucauggagccugaacaugcccuucuggcuaccuccauuuucaagcucacauaucagaacaaagugguccgggugcagcgccccgccaagaacggaaccgugauggacguuaucucuagacgggaucaaagaggcagcgggcaggugggaacguacggccugaauaccuuuacaaacauggagguccagcugauucgccagauggaauccgaggggaucuuccucccgucugagcuggaaaccccuaaucuugcggagcgggcccuggacuggcucgaaaaacacggaguggagagacugaagcgcauggcuauuagcggcgaugacuguguugugaagcccaucgacgaucgguuugccacagcucuuaccgcccugaacgacauggggaaagucagaaaggauaucccucaaugggaacccuccaaaggcuggaaugacuggcagcaggugccuuucugcagccaccauuuucaccagcucauuaugaaggauggacgcgagaucgucgugcccugucggaaccaagacgagcugguuggcagagcgcgcgugucucagggggccggauggucccugcgggaaacagcuugccucggcaaaagcuaugcccagauguggcaacugauguacuuccauagacgcgaucuucggcuggcugccaaugcuauuuguucugccgucccgguggacuggguuccuaccuccagaacgacauggagcauccacgcgcaccaucaguggaugaccaccgaggauaugcucuccguguggaaccgggucuggauugaagagaaucccuggauggaagacaagacacacgugucuagcugggaggaggugcccuaucuggggaagagagaagaucaguggugcggaucccuuaucggccugaccgcccgcgcuacaugggccacgaacauccagguugccauuaaucaaguccggagacucaucgggaacgagaauuaccuggacuacaugaccagcaugaaacgcuuuaagaacgaaucugacuccgagggcgcucugugguga

SEQ ID NO: 18814 - RNA, 9879 nt, Artificial Sequence
  derived and/or modified CDS sequence (opt5) from DENV-1__GU131841__SS-prME
agcgugacaaugcugcucaugcugcuucccacagcccuggcuuuccaccucacgacccggggcggggagccucauaugaucgucuccaagcaggaacggggaaaaucucugcuuuuuaagacaagcguuggcgugaauaugugcacccugauugccauggaccucggggagcugugugaagauacaaugaccuacaaaugccccagaaucacagaggcggaacccgacgauguggacuguuggugcaaugcuaccgauacgugggucaccuauggaacauguucccagaccggcgagcaccggcgggagaagcgcucuguggcccuggccccucauguugggcucggacuggaaacaagaaccgagacguggaugagcuccgaaggcgcuuggaaacagauucagcggguggagacaugggcccuucgccaccccggcuucaccgucaucgccuuuuuccuggccuacgcgauugggacaucuaucacccagaagggaaucauuuuuauccuccugaugcuugugaccccuagcauggccaugagaugcguuggcauugggaaucgggacuucguggagggacuguccggcgcuacaugggucgauguggugcucgaacaugggagcugugucacgaccauggccaagaauaaacccacacuggacaucgagcugcucaagaccgaaguuacaaacccugcugugcugcgcaaacuuugcauugaggccaagaucucuaauaccacgacagauuccagauguccgacccaaggagaagcgacccugguggaggagcaggacgccaacuuugucugccggcgcacauucguggauagaggcuggggcaauggguguggacucuuuggcaaagggagccugcuuaccugcgcuaaguucaagugcguuacaaaacuggaaggaaagauugugcaguaugagaaccucaaauacucugucaucgugacgguucacaccggcgaccagcaccaaguggggaaugaaacaaccgagcauggaacaaucgccaccauuacgccccaggcuccuaccuccgaaauccagcugacagauuauggcgcccugacccucgacuguagcccccggacaggccuggacuuuaacgagaugguccuucugaccaugaaggagaaaucuuggcucgugcacaagcagugguuccuggaucuuccucugcccuggacguccggggccagcacaucccaagaaaccuggaaucgccaggaccuccuggucacauuuaaaaccgcucaugcgaagaagcaggaggugguugugcugggaucucaagaaggcgccaugcacaccgcucucacaggggccacggagauucagaccagcggaacaaccacaaucuucgccggccaccugaaaugcagacuuaagauggauaaacugacccucaaggggauguccuacgucauguguacgggcagcuucaaacuggaaaaggagguggcugagacacagcauggaaccguucuggugcaggucaaguaugaaggcaccgacgccccgugcaaaauuccuuuuucuacacaagaugagaagggggugacccagaacggacggcuuaucacagcgaaucccaucgugacggacaaagaaaagccuguuaacauugagaccgagccgcccuucggcgaauccuacaucgucgugggggcuggagagaaagcccucaagcugagcugguuuaagagaggcucuagcauugggaaaauguucgaagccacagcucgcggcgcccggagaauggcuauccugggagauaccgccugggacuuuggcuccauugggggaguguucacaucugucggcaagcucgugcaccagguuuuugggaccgcguacggagugcuguucagcggcgucuccuggacgaugaaaaucgggaucggcauucuucugaccuggcucggacugaauagccgcucuacaucccugagcaugaccuguaucgccgugggcaugguuacacuuuaucucggggugaugguccaggcugauucuggaugcgugauuaacuggaagggccgggagcugaaauguggguccggaaucuuuguuaccaacgaagugcauacauggaccgagcaauacaaguuccaggccgacagcccuaagagacuguccgcugccauuggcaaagcgugggaggaaggggucugcggcauccgcucugccacgcggcucgagaauauuauguggaagcagaucagcaacgaacugaaucacauccuucuggagaacgauaugaaauuuacagugguggucggagacgcuaauggcauucucgcccaggggaagaaaaugaucagaccgcaacccauggaacauaaguauuccuggaaaucuuggggaaaggcuaagauuaucggcgccgacauucagaacaccaccuucaucaucgaugggccugacacacccgaguguccugauggacagcgcgccuggaauauuugggagguugaagacuacggcuuuggcguguucaccacgaacaucuggcugaaacugcgggauagcuauacacagaugugcgaccacagacuuauguccgcugcgauuaaggauagcaaagccgugcacgcugacaugggguacuggaucgagucugaaaagaaugagaccuggaaacucgcccgcgccuccuucauugaagucaagacauguaccuggcccaagagccauacacuguggucuaacggagugcuggaguccgagaugaucaucccgaaaauuuauggcgggccuaucagccaacacaauuaccggcccggauacuuuacccagacggcuggcccuuggcaucucgggaagcuggaacuugauuucgaccugugcgagggaaccacaguuguggucgaugaacacugcggcaacagaggccccucucuccggaccacaaccgugacggggaaaauuauccacgagugguguugccgcagcuguacacugccuccccugagauuucggggagaggacggcugcugguaugggauggaaauuagaccgguuaaggagaaagaagagaaucuugugcgcuccauggucagcgccggaucuggcgaaguggauuccuucagccucgggauccuguguguuuccaucaugauugaggaggugaugcggucuagauggagccgcaagaugcugaugaccggaacacucgcggucuuucugcuucugaucaugggccagcucaccuggaacgaccugauuagacugugcaucauggugggcgcuaaugccuccgaccggauggggaugggaaccacauaccuugcccugauggcuacguucaagaugcgcccuauguuugccgugggccuccuguucagacggcucaccucucgcgaaguccugcuucugacaauugggcucagccugguugcguccguggagcugcccaacucucuugaagaacugggagauggccucgcuauggggaucaugaugcugaaacuccugaccgaauuucaaccccaucagcuuuggacaacccugcucagccugacguucgugaagacaacccugucccuugacuaugccuggaaaaccacagccaugguccugagcauugugucucucuuuccucugugucucuccaccacaagccagaagacgaccuggcugccgguucuucugggaucuuucggcugcaaaccccugacaauguuucucaucaccgagaacaagaucuggggcagaaaguccuggccucugaaugaggggauuauggcuaucggaauugugagcauccuucugucuucccuccugaaaaacgaugucccccucgccggcccucugauugcugggggaaugcuuaucgccuguuacgugaucagcggcuccagcgcggaccugucucuggaaaaggccgcugagguuagcugggaacaggaggccgaacacuccggggcuucucauaauauucucguggagguccaagaugacggaacaaugaaaaucaaggaugaggaacgggacgauacccugacgauucuucugaaagccacccuccuggccgugagcggcgucuaucccauguccaucccugcuacacucuucgugugguacuucuggcagaagaaaaagcagcgcucuggcguucugugggacacccccagcccgccugagguggaaagagcgguccuugaugacgggauuuaucggauccugcagcgcggacugcucggcagaucccaaguggggguuggaguguuucaggauggcgucuuccacacaauguggcaugugaccagaggggcugugcugauguaccagggaaagagacuugagcccucuugggcuagcguuaaaaaggaccugaucuccuacggcggcggguggcgcuuucagggaagcuggaacacaggcgaggaaguccaagugauugccguggagccugggaaaaaucccaagaacguccagacgaccccgggaacauucaaaaccccugaaggcgaggugggggccaucgcucucgacuuuaagcccggaaccucuggcuccccuauuguuaaucgggaaggcaagaucguggggcuguauggaaacggcgucgugacaacgagcgggaccuacguuucugccauugcgcaggcuaaagccucccaagagggaccccuccccgagaucgaagaugagguguucaagaaaagaaaucugacaauuauggaccuucacccuggcagcgggaagacccgccgguaucugccggccaucgucagagaagcuaucaaacgcaagcugcggacacucauucuggcccccaccagagugguugcguccgagauggcugaagcccuuaagggcaugccuauccgcuaccagacgacagccgugaaaucugagcacaccggacgggagauugucgaucugaugugccaugcuaccuuuacaaugagacuccugagccccgugcgggugccuaacuauaauaugaucauuauggacgaagcccacuucaccgaucccgcuuccaucgccgcgcgcggcuacaucagcacaagagucgggaugggagaggccgcugccauuuuuaugaccgcuacgccuccgggcucuguugaagccuucccccaguccaacgccgugauccaggacgaggaacgggauauuccugagcgcagcuggaacucuggguaugacuggaucacagauuuucccggaaagaccgugugguucgucccuagcauuaaauccggcaacgacaucgcuaauugucugagaaagaacgggaaacgggugauccaacucucuagaaagacauucgauaccgaguaccagaagacgaaaaacaaugacugggacuacguugugaccacagauauuagcgaaaugggcgcgaacuuucgcgccgaccgggucaucgaucccagacgcugccuuaagccggugauucugaaagacggaccugagcggguuauccuggcuggccccaugcccgugaccgucgccuccgccgcucagagacgcgggcggauuggaagaaaucagaacaaggaaggcgaucaauauguguacauggggcagccucucaauaacgacgaggaucaugcccacuggacagaggcgaaaaugcugcuugacaauaucaacacccccgaaggaauuaucccugcucuguucgagccggaacgcgagaagucugccgccaucgauggcgaauauagacucagaggggaagcucgcaagacauuugucgagcugaugagacggggcgaccugcccguguggcucagcuacaaaguugccuccgaaggauuccaguauagcgaucgcagauggugcuuugacggcgagcggaauaaccaggugcuugaagagaauauggauguggaaauuuggaccaaggagggggagcgcaagaaacugcgcccucgguggcuggacgcgagaacguacucugacccccucgcccugcgcgaguucaaagaguuugcugccggacggagauccgucagcggcgaucuuauccuggaaauugggaaacucccucaacaucugacacugcgggcucagaacgcccucgacaaucuuguuaugcugcacaacuccgagcagggaggcaaggcuuaucgccacgccauggaggaacugcccgauaccaucgagacccucaugcugcuugcgcugauugccgugcucacaggcggggugacccuguucuuucugucuggaaagggccucgggaagacaagcaucggacuucugugugucacggcuuccucugcccugcucuggauggcuagcguggaaccgcauuggaucgccgccuccauuauccuggaguucuuucuuaugguucugcucauuccugaacccgacagacagcggaccccucaagauaaucagcuggcuuacguggucaucggccuccuguucaugauucuuacaguggcggccaacgagauggggcugcuggagaccaccaaaaaggaccucggaaucggcuacgucgcugccgaaaaccaccagcaugccaccaugcuggauguggaccuucaccccgcuagcgccuggacgcuguaugcgguugccaccacagugaucaccccuaugaugcgccacacaauugagaauaccacggcuaacaucucucucacagccauugcuaaucaagccgcgauccugaugggccuggauaaaggguggcccauuuccaagauggacaucggagucccgcuccuugcccugggcugcuacagccaggugaacccucugacccucacagcugccguucugaugcuuguggcucauuaugccauuaucgggcccggacugcaggcuaaagccaccagagaagcgcagaagcggaccgccgcuggcaucaugaagaaucccacagucgaugggauuguggccaucgaccucgauccugugguuuacgacgcuaaauuugagaagcaacugggacagauuaugcugcucauccuuuguacgucucagauucugcugaugcgcaccacaugggcccucugcgaauccaucacccuggccacaggcccgcuuaccacgcugugggagggcagccccgggaaauucuggaacacaaccaucgcggucucuauggcuaauauuuucagaggaagcuaucucgccggcgcugggcuggccuuuucccugaugaagucucucggaggcgggcggcgcggaaccggcgcccagggcgagacacuuggggaaaaauggaagagacaacugaaccagcugagcaaguccgaguucaauaccuacaaacggagcggaaucauggaaguggacagauccgaggcuaaggaaggccucaaacgcggggagacaacgaagcacgccgugucucggggaaccgcgaaacugagaugguuugucgagcgcaaccuuguuaagccugaaggcaaggugauugaucugggguguggacggggcggcuggagcuauuacugcgccgggcucaaaaaggugacagaggucaaaggauacaccaagggcgggcccggacaugaggaaccuauccccauggcuacauauggcuggaaucuggugaaacugcacuccgggaaggacguuuucuuuaugccuccggaaaaaugugauacccuccuuugcgacauuggagagucuagccccaacccuacgaucgaggaaggcagaacccugcgcgugcugaagauggucgagcccuggcuccggggcaaucaguucuguaucaagauucugaacccuuacaugcccuccgugguugaaacacuugagcagaugcaaagaaaacaugggggaaugcuggugcgcaauccgcucucucggaacagcacccacgagauguauugggucuccugcggcacagggaauaucgugagcgccgugaacaugaccucuagaaugcugcugaaccgcuuuacaauggcucaccggaagccuaccuacgaaagagaugucgaccucggagccggcacgcgccauguugcgguggagcccgaaguggccaaucuggauauuaucgggcagagaauugagaacaucaaaaaugaacacaaguccacauggcauuaugacgaggauaaccccuacaaaaccugggcuuaucacggaagcuacgaggucaagccuucuggcuccgccagcucuauggugaauggcguugugcggcuucugaccaagcccugggacgucauuccuauggugacacagaucgcuaugacggauaccacaccguucgggcaacagcgcguuuuuaaagaaaagguggacaccagaacaccccgggccaaaagaggaaccacacagaucauggaggucaccgcuaaguggcucuggggcuuccugucccggaacaaaaagccucgcauuuguacgagagaagaguuuacccggaaggugcgcagcaaugccgcgaucggggccguuuucguggacgaaaaccaguggaacuccgcuaaagaggccgucgaggaugaaagauuuugggaccuugugcaccgggagcgcgaacugcauaagcaaggaaaaugcgcuacaugcgucuacaacaugaugggcaagagagagaaaaagcucggggaguucggcaaggccaaaggaagccgggccauuugguauauguggcugggcgcgcgcuuccuggaguuugaggcucucggguucaugaaugaagaucacugguuuucuagagagaacagccuguccggaguggaaggcgaggggcuucauaagcugggauacauccuccgggacauuucuaaaauccccggcgggaauauguaugccgaugacaccgccggcugggauacacgcaucaccgaggacgaucugcagaacgaagcuaagauuacggacaucauggagccugaacacgcccuucuggcuacaagcauuuucaaacucaccuaccagaauaagguugugagaguccagcggcccgccaaaaacggaacagugauggaugugaucucccgcagagaccaacggggcucugggcagguuggaaccuauggccugaacacguuuaccaauauggaggugcagcugauuagacagauggaaagcgaggggaucuuccucccguccgagcuggaaacaccuaaccuugcggagcgcgcccuggauuggcucgaaaagcauggagcugagcggcugaagagaauggccaucucuggcgacgacugugucgugaaacccauugaugaccgcuuugcuaccgcccuuacagcgcugaaugauauggggaagguucggaaagacaucccucaaugggaacccagcaagggcuggaacgauuggcaacaggugccuuucugcucccaccacuuucaucagcucauuaugaaagacggaagagagaucgucgugcccugucgcaaucaagaugagcuggucggccgggccagagugagccagggggcuggauggucucugcgcgaaaccgccugccucggcaaguccuacgcucagauguggcaacugauguauuuccaccggagagaccuucgccuggccgcuaacgccauuuguagcgcgguuccgguggauugggucccuacaucucggaccacgugguccauccaugcccaccaccaguggaugacaaccgaggacaugcucagcguguggaauagaguuuggaucgaagagaaccccuggauggaagauaagacccauguguccucuugggaggagguccccuaccuggggaaacgggaagaccaguggugcggaagccuuauuggccugacagcuagagccaccugggccacaaauauccagguggcuauuaaccaagugcgccggcucaucgggaaugagaacuaccuggacuauaugacguccaugaagagauuuaaaaaugaaagcgauccugagggcgcccugugguga

SEQ ID NO: 18815 - RNA, 9879 nt, Artificial Sequence
  derived and/or modified CDS sequence (opt5) from DENV-1__GQ868601__SS-prME
agcgugaccaugcugcucaugcugcuucccacagcccuggcuuuccaccucacgaccagaggcggggagccucauaugaucgucuccaagcaggaacggggaaaaucucugcuuuuuaagacaagcguuggcgugaacaugugcacccugauugccauggaccucggggagcugugugaagauacaaugaccuacaaaugcccgcgcaucacagaggcggaacccgacgauguggacuguuggugcaaugcuaccgauacgugggucaccuauggaacauguucccaaaccggcgagcacagacgggacaagcgcucuguggcccuggccccucauguugggcucggacuggagacaagaaccgaaacguggaugagcuccgagggcgcuuggaaacagauucagaagguggaaacaugggcccuucggcaccccggcuucaccgucaucgcucuguuucucgcccaugcgauugggacaucuaucacccagaagggaaucauuuucauccugcuuaugcuggugaccccuagcauggccaugcgcugcguuggcauugggaacagagauuuuguggagggacucuccggcgcuacaugggucgacguggugcuggagcacgggagcugugucacgaccauggccaaaaauaagcccacacuggauaucgaacuccugaaaaccgagguuacaaacccugcugugcuucggaagcugugcauugaagccaaaaucucuaauaccacgacagacucccgcuguccgacccaaggagaggcgacccucguggaagagcaggaugccaacuucgucugcagacggacauuuguggaccgcggcuggggcaauggguguggacuguucggcaaggggagccuucugaccugcgcuaaguuuaaaugcguuacaagacucgagggaaagauugugcaguacgaaaaccugaaauauucugucaucgugacgguucacaccggcgaucagcaucaaguggggaaugagacaaccgaacacggaacaaucgccaccauuacgccccaggcuccuaccuccgagauccagcugacagacuacggcgcccucacccuggacuguagcccccggacaggccuugauuucaacgaaaugguccugcucaccaugaaggagaaaucuuggcuggugcauaagcagugguuucuugaccugccucuccccuggacguccggggccagcacaucccaagagaccuggaaucgccaggaucugcuggucacauucaaaaccgcucacgcgaagaagcaggaagugguugugcucggaucucaagagggcgccaugcacaccgcucugacaggggccacggaaauucagaccagcggaacaaccacaaucuuugccggccaucuuaaaugcagacugaagauggacaaacucacccugaaggggauguccuaugucauguguacgggcagcuucaaacuggagaaggaaguggcugagacacagcacggaaccguucuugugcaggucaaguacgagggcaccgaugccccgugcaaaauuccuuuccucacacaagacgaaaagggggugacccagaacggacggcugaucacagcgaaucccaucgugacggauaaagagaagccuguuaacauugaaaccgagccccccuuuggcgagucuuauaucgucgugggggcuggagaaaaagcccugaagcucuccugguucaagaaaggcagcucuauugggaagauguuugaggccacagcuagaggcgcccgccggauggcuauccugggagacaccgccugggauuucggcagcauugggggacuuuuuacauccgugggcaaacugauccaucaggucuucgggaccgcguacggagugcucuuuucuggcguuagcuggacgaugaagaucgggauuggcauccugcugaccuggcuuggacucaauuccagaagcacaucucuguccaugaccuguauugccgugggcauggucacacuguaccucggggugaugguucaggcugacagcggaugcgugaucaacuggaaaggccgcgaacugaagugugggucuggaauuuucgucaccaacgaggugcacacauggaccgaacaauauaaguuucaggccgauuccccuaaacggcuuagcgcugccaucggcaaggcgugggaggaggggguuugcggcauuagauccgccacgcgccuggaaaauaucauguggaaacagaucucuaacgagcucaauuacauucugcuggaaaacgacaugaaguucacaguggucgugggagacgcuaauggcauccuugcccaggggaaaaagaugauucggccgcaacccauggagcauaaauauagcuggaaguccuggggaaaggcuaaaaucauuggcgccgauauccagaacaccaccuuuaucauugacgggccugauacacccgaauguccugacgaucagagagccuggaauaucugggagguggaggacuacggauucggcauuuuuaccacgaacaucuggcucaagcugcgcgauucuuauacacagaugugcgaccaccggcugaugagcgcugcgauuaaagauuccaaggccguccacgcugacaugggcuacuggaucgaaagcgagaaaaaugaaaccuggaagcucgccagagccucuuucaucgagguuaagacauguauuuggcccaaaucccauacccuguggagcaacggggugcuugaaucugagaugaucauuccgaagaucuauggaggcccuauuucccaacacaauuaccgccccggguacuucacacagaccgcuggaccuuggcaucugggcaaacucgagcuggauuuugaccugugcgaagggacgaccguggucguggaugagcacugcggauaucggggccccagccuuagaacaaccacaguuaccggcaagaucauccacgaaugguguugccggucuuguacgcucccuccccugcgcuucagaggggaggacggaugcugguacggcauggagauucggccggugaaagaaaaggaggaaaaccuggucagaagcaugguguccgccgggagcggagagguugacucuuuuucccucggcauccugugugugagcauucuuaucgaagaggucaugcgcucccgguggucuagacgcaugcugaugacagggacccucgcgguguuccugcugcuuauuaugggacagcugacauggaaugaucucaucagacugugcauuaugguuggcgcuaacgccagcgaccggaugggcauggggaccaccuaucucgcccugauggcuacauuuaagaugcgcccuauguucgccgugggacuucuguuuagacggcucacgucccgcgagguccugcugcuuaccaucggccugucucucguggcgagcguggaacugcccaauucccucgaggaacugggggauggacuugcuaugggcaucaugaugcugaaacuccugacagacuuccaaccccaucagcuguggaccacacuucugucucucaccuuuauuagaacgacacugagccucgauuacgccuggaagaccauggccauggcucuguccaucgucagccuuuucccucugugucugucuaccacaucccagaaaaccacauggcucccgguucugcuugggagcuuuggaugcaagccccugacgauguuccucauuaccgagaacaaaaucuggggccggaagucuuggccuauuaacgaaggcaucauggccguggggaucguguccauucugcucagcucucugcuuaagaaugacgucccccuggcuggaccucugaucgccggcgggaugcucauugcguguuaugugaucuccggaagcuccgccgaucugagccuugagaaagcugccgagguuucuugggaagaggaagcugagcacagcggcacaucccauaacauucugguggaaguccaggacgaugggaccaugaagaucaaagacgaggagcgcgaugacacacucaccauccugcucaaggccacgcugcuugccgugucuggaguuuaccccaugagcauuccugcuacccuguuugugugguauuucuggcaaaaaaagaaacagagauccggcguccugugggauacacccucuccgccugaaguggagcgggcgguccucgacgacggcaucuaccgcauucugcagagagggcuucugggacggagccaggugggcguugggguguuccaagauggagucuuucacaccauguggcaugugacaagaggcgccguucucauguaccaggggaagcgccuggaacccuccugggcuucugugaagaaagaccucaucagcuauggaggcggcuggcgguuccagggguccuggaauaccggagaggagguccaggugauugccguggaaccuggcaagaaccccaaaaauguucaaacaacgccggggaccuuuaagacaccugagggagaagucggcgccaucgcucuggauuucaaacccgggaccagcggaucuccuauugugaacagagagggcaagaucgugggccuuuacgggaauggagucgugaccacauccggcacguauguuagcgccaucgcgcaggcuaaggccucucaggaagggccccugcccgagauugaggacgaaguguuuaaaaagcgcaaccugaccaucauggaucuccacccuggauccggcaaaacacggagauaccugccggccauuguccgcgaggcuaucaagcggaaacuuagaacccugauucucgcccccacacgcgugguugcgagcgaaauggcugaggcccugaaggggaugccuauccgguaucaaaccacggccgugaaguccgaacacacaggcagagagaucgucgaccugaugugccaugcuaccuucaccaugcggcuccuuucucccgugcgcguuccuaauuacaacaugauuaucauggaugaggcccacuuuacagaccccgcuagcauugccgcgagaggauauaucuccacccgggugggcaugggggaagccgcugccauuuucaugacagcuaccccuccgggaagcgucgaggccuuuccccagucuaaugccgugauccaggaugaagagcgcgacaucccugaaagauccuggaacagcggcuacgauuggauuacggacuuccccgggaaaacagugugguuugucccuucuaucaagagcggaaaugacauugcuaacugucugcggaaaaauggcaagagaguuauccagcugucccgcaaaaccuucgauacagaguaccaaaagaccaagaacaacgacugggauuauguggugacgaccgacauuucugagaugggggcgaauuuccgggccgauagagucaucgacccccgccggugccucaaaccggugauucugaaggauggcccugaaagaguuauccuugcuggacccaugcccgugacagucgccagcgccgcucagcgccggggcagaaucgggcgcaaccagaauaaagagggagaccaguacauuuauaugggccaaccucugaacaaugaugaagaccaugcccacuggaccgaggcgaagaugcuccuggauaacaucaauacacccgaggggauuaucccugcucuguuugaaccggagagagaaaaauccgccgccauugacggagaguaccggcuccgcggcgaagcuagaaagaccuucguggagcuuaugcggcgcggggaucugcccguuuggcugucuuauaagguggccagcgagggcuuucaguacuccgacagacgguggugcuucgacggagaaagaaacaaucagguccucgaggaaaacauggauguggagaucuggacaaaagaaggcgagcgcaagaaacugcggccuagauggcuugacgcgcgcaccuauagcgauccccuggcccuccgggaguuuaaggaauucgcugccgggagacggucugucuccggagaccugauccuggagauuggcaaacucccucagcaucuuacgcugcgcgcucaaaaugcccuggauaaccucgugaugcugcacaauagcgaacaggggggaaaggcuuacagacacgccauggaggaacuucccgacacaaucgagacccugaugcuccuggcgcugauugccguucucaccggcggcgugacacuuuuuuuccuguccgggaaaggacugggcaagaccucuaucgggcuccugugugugauggcuagcuccgcccuucuguggauggcuucugucgagccgcauuggauugccgccagcaucauccucgaauuuuuccugaugguucugcucauuccugagcccgaucggcagcgcacaccucaggacaaccaacuugcuuacguggugaucggacugcuguuuaugauucucacggucgcggccaaugaaaugggccugcuugagaccacaaagaaagaucuggggaucggacacguggcugccgagaaccaucaccacgccaccaugcucgacguugaucugagacccgcuuccgccuggacacuguaugcgguggccaccacggucauuaccccuaugaugcggcauacaaucgaaaacaccacagcuaauauuagccucaccgccaucgcuaaccaggccgcgauccuuaugggccuggacaagggcuggcccauuucuaaaauggauaucggggugccgcugcucgcccugggaugcuacucccaggucaauccucuuacgcugacagcugccgugcucaugcugguugcucacuaugccauuaucggccccgggcugcaagcuaaggccacccgcgaggcgcagaaaagaacagccgcuggaauuaugaagaaccccaccguggacggcaucgucaccaucgaccucgauccugugguuuacgacgccaaguucgaaaaacagcuugggcagauuaugcugcugauccucuguacaagccaaauucugcuuaugcggacgaccugggcucugugcgagucuaucacacucgccaccggaccgcugacaacccugugggaaggcucccccggcaaguuuuggaauacgacaauugccgugagcauggcgaacaucuuccgcgggucuuaucucgcuggagccggccuugcuuucagccugaugaaaucccuggggggaggcagacgggggaccggagcccagggcgagacccucggcgagaaguggaaaagacagcugaaucagcuuucuaagagcgaauuuaacacauacaagcgcuccgggaucauggaggucgaucggagcgaagccaaagagggacugaagagaggcgaaaccacaaaacaugcugugucccgcgggacggccaagcuccggugguucguggagagaaaucugguuaaaccugagggaaaggucauugaccugggcugugggcgcggaggcuggucuuauuacugcgcgggccucaagaaagugaccgaagugaagggguacacaaaaggaggccccgggcacgaggaaccuauccccauggccaccuauggauggaaccuugucaagcugcauagcggcaaagauguuuuuuucacaccuccggagaagugugacacccugcucugcgauauuggggaauccucucccaauccuacgaucgaggagggacggacccugagagugcuuaaaaugguggaacccuggcugcgcggcaaccaauuuuguauuaagauccucaauccuuacaugcccagcgucguggagacacuggaacagaugcagcggaagcacggcgggaugcugguuagaaacccgcucucccgcaauucuacccacgagauguauugggugagcugcggaacaggcaacauugucuccgcugugaauaugaccagccggaugcugcuuaacagauucacaauggcccaucgcaaaccuaccuacgagagagacguugaucugggggcuggaacgcggcacguggccgucgaacccgagguggcgaaccucgacaucaucggccagcgcauugaaaauaucaagaacgagcauaaaucuacauggcacuaugaugaagacaaucccuacaagaccugggccuaucacggguccuacgaggugaaaccuagcggaucugcuuccagcauggucaacggcguugugagacugcuuaccaagcccugggacgugauuccuauggucacacaaaucgccaugacggauaccacaccguuuggccagcagcggguguucaaggagaaaguugacaccagaacaccccgggcuaagcgcgggaccgcccaaauuauggaagugacagcuaaauggcuguggggauuucucucuagaaauaagaaaccucggaucuguacccgcgaggaauucacgagaaagguccgguccaacgccgcgaucggcgccguguuuguugaugagaaucaguggaacagcgcuaaggaagccguggaggacgagcgcuucugggaucugguccauagagaacgggagcugcacaaacaggggaagugcgcuaccugcguguacaauaugaugggaaaacgcgaaaagaaacucggcgaguuugggaaggccaagggcuccagagccauuugguauauguggcugggagcgcgguuccuugaauucgaggcucugggcuuuaugaacgaggaccauugguucagccgcgaaaauucucucagcgggguugagggagaaggccugcacaaacuuggguacauccugagagauauuuccaagauccccggaggcaacauguaugccgacgauacagccgggugggacacccggauuacagaggaugaccuccagaaugaggcuaaaaucaccgauaucauggaaccugagcaugcccugcuggcuacgucuauuuuuaagcucacauaccaaaacaaagugguccgcgugcagagacccgccaagagcggcaccgucauggacgugaucucccggagagaccagcgcggaucuggccagguugggacauauggacugaauaccuucacgaacauggaagugcaacuuauucggcagauggagagcgaaggcaucuuuuccccgucugagcuggagaccccuaaccucgcgaaaagaguccuggauuggcuugaaaagcagggggccgagcgccugaagcggauggcuauuagcggagacgauuguguggugaaacccaucgacgauagauucgccacagcucucaccgcccugaaugacaugggcaagguucgcaaagauaucccucagugggaacccuccaagggguggaacgacuggcaacaggugccuuuuugcagccaccacuuccaucagcugauuaugaaagauggccgggagaucgucgugcccuguagaaaucaggacgaacucguuggacgcgcgcgggugucucaaggcgccggguggucccugagagagacagcuugccuuggaaagagcuacgcccagauguggcagcugauguauuuucaccgccgggaucucagacuggcugccaacgcuauuuguucugccgucccgguggacugggucccuaccucccggacaaccuggagcauccaugcgcaccaccaauggaugacgacagaggacaugcuuuccguguggaauagaguuuggauugaagagaaccccuggauggaagauaagacccaugugucuagcugggaggaaguccccuaccugggcaaacgcgaggaccaguggugcgggucccucaucggacugaccgcccgggcuacaugggccaccaauauucagguggccaucaaccagguuagacgccugaucggcaaugagaacuaccucgauuauaugacaagcaugaagagauucaaaaaugaaucugacccugagggggcucugugguga

SEQ ID NO: 18816 - RNA, 9879 nt, Artificial Sequence
  derived and/or modified CDS sequence (opt5) from DENV-1__EU660390__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagagcaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccccccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaagcucacaguuauugugggagaugucgcuggcauccuggggcagggacggaaaaugauuagaccgcaacccauggaguacaaguauucuuggaaaagcuggggcaaggccaagaucaucggggccgacgcucagaauaccaccuucauuaucgauggaccuaacacacccgaauguccugacgaucagcgcgcguggaauauuugggagguggaggacuacggcuuuggcaucuucaccacgaacauuuggcugaaacuucgggauuccuauacacaggugugcgaccacagacucaugagcgccgcuaucaaggauucuaaagccguccacgccgacaugggguacuggaucgaauccgagaagaaugaaaccuggaaacuggcucgcgccagcuuuauugagguuaagacauguaucuggcccaagucucauacccugugguccaacggagugcucgaaagcgagaugauuaucccgaaaauuuauggcgggccuaucucucaacacaauuaccggcccggauacuucacacagaccgcgggcccuuggcaucuggggaagcuugagcuggauuucgaccucugcgaaggaacgaccguggucguggaugagcacugcggcaacagaggccccagccugcggacaaccacaguuaccgggaaaaucauucacgaaugguguugccgcuccuguacgcugccuccccuuagauuucggggagaggacggcugcugguaugggauggagaucagaccggugaaggaaaaagaggaaaaucucgucaagagcauggugucugcuggauccggcgagguugacagcuucucccuggggcugcucuguauuucuaucaugauugaagaggugaugcgcagccggugguccagaaagaugcugaugacaggaacccuugccgucuuuuuccugcucaucaugggccagcugacauggaacgaucugauucgccuuugcaucauggugggcgccaaugcuucugacagaauggggaugggaaccaccuaccuggcccucauggcgacauuuaaaaugcggccuauguucgcuguuggccugcucuuucgcagacugacgagccgggaggugcuucugcucaccaucgggcugucccuggucgccucuguggaacuucccaacagccuggaggaacucggagauggccuggccauggggauuaugauccucaagcugcuuacagacuuccaaucccaucagcugugggcuacccuccugagccugacauuuauuaaaaccacguucucucuucacuaugccuggaagacaauggcuauggugcuguccaucgucagccucuuuccccugugucucucuaccaccucccagaaaacaaccuggcugccuguucuucugggaagccugggcugcaagccgcucacaauguuccugauugccgagaauaagaucuggggccgcaaaucuuggccccuuaacgaagggaucauggcggugggaauuguguccauccugcucagcucccugcucaagaacgaugucccucuggccggcccccuuguggcugggggaaugcugauugccuguuacguuaucagcggcucuagcgcugaccugucccucgagaaagccgccgaggugucuugggaagaggaagcugagcauagcggggcgucccacaauauucuggucgaagugcaggaugacggaacgaugaagaucaaagaugaggagagagacgauacccuuacaauccugcucaaggccacccugcucgcuguuucuggcguguauccucugagcauucccgccacacuuuuugucugguacuucuggcaaaaaaagaagcagcgguccggcgugcugugggacaccccuucucccccggaagucgagcgcgccgugcuggaugacgggaucuauagaauuaugcagcggggacuccugggccgcagccagguuggggugggagucuuccaagaaaacguguuucauacgauguggcacguuaccagaggcgcugugcuuauguaccaggggaaacggcuggagccuuccugggccagcgucaagaaagaccucaucucuuacggaggcggcuggagacugcgcggguccuggaauacaggagaggaagugcaggugauugcgguugagcccggcaagaacccuaaaaauguccagaccgcucccgggacauucaagaccccggaaggagaggugggcgccaucgcccucgauuuuaagccugggacaagcggaucucccauugugaaccgggaaggcaaaaucgucggccuguaugggaauggagugguuacgaccuccggcacauacgugagcgcuaucgcccaagcgaaggcuucccaggaggggccucuucccgagauugaagacgaggucuucagaaaacgcaaccugaccaucauggaucugcaccccggaucuggcaagacccggagauaucucccugccauugugcgcgaagccaucaaacggaagcugagaacacuuauucuggcuccgacgcgcguuguggccagcgagauggcugaagcccucaaggggaugcccauccgguaccagaccacagcggucaaauccgagcauaccggcaaggagaucguggaccugaugugccacgccacauuuaccaugagacugcucagcccuguucgggugcccaauuauaacaugauuaucauggaugaagcucauuucacggacccuucuuccauugccgcucgcggauacaucagcacaagagucggcaugggggaggccgccgcuauuuuuaugaccgcgacccccccuggaucuguggaagccuucccgcaaagcaaugcugugauccaggaugaggaacgggacauccccgagcgcuccuggaacucuggcuaugaguggauuacagauuuuccugggaaaaccgucugguucguucccagcaucaaguccggaaaugacauugccaacugucuuagaaaaaauggcaagcgggugauccagcugucuagaaagacauuugauaccgaauaccagaaaacgaagaacaacgacugggacuacguggucacaaccgauauuagcgagaugggggccaauuuccgcgcugaccgggugaucgauccuagacgcugccugaaacccguuauucucaaggacggcccggaacgggugauccuggccggaccuaugcccgucacaguggcguccgcugcccaaagacgcggccggaucgggagaaaccacaauaaagagggagaucaguauauuuacaugggccagccccuuaacaaugacgaggaucaugcccacuggaccgaagcuaagaugcugcucgacaacaucaauacgccugaggggauuauccccgcccuguucgaaccugagcgcgaaaagagcgcggccguugauggagaguauagacugcggggcgaggcucgcaaaaccuuuguggaacucaugagacggggggaccuuccggucuggcugucuuacaagguggccuccgagggcuuccaguauagcgaucgcagauggugcuuugacggagaacggaacaaucaaguccuggaggaaaacauggauguggagauuuggacaaaagagggcgaaagaaagaaacuccgcccccgguggcuggacgcuagaaccuacuccgacccucuugcccugcgcgaguucaaggaauuugcugccgggcggagaucuguuagcggagaucucauccuggagaucggcaaacugccccagcaccucacacagcgggcgcagaaugcccuugacaaccuggugaugcugcauaauuccgaacaagggggacgcgcuuauagacacgccauggaggagcucccugauaccauugaaacacugaugcuucuggcucucaucgccgugcugaccggcggcgucacgcuguucuuucucucugggcggggacuuggcaagacaagcauugggcugcuguguguuauggccuccagcgugcuccuguggauggcuucuguggagccccauuggaucgcggccuccauuauccuugaauucuuucugaugguccuccugaucccggagccugaccgccagagaaccccccaggauaaccagcuggcuuacgugguuauuggacuccuuuucaugauccugaccguggccgccaaugagaugggccugcucgaaacaaccaagaaagaccuggggauuggacacgucgcuguggagaaccaccaucacgccgcgaugcuugaugucgaccugcauccugccagcgcuuggacacucuacgccguggcuacgaccaucauuacacccaugaugcggcacaccaucgaaaacacaaccgccaauauuucucugacggcgaucgccaaccaagcugccauccugaugggccucgauaagggcuggccuauuuccaaaauggacaucgggguuccccuucuggcucugggaugcuauagccaggugaauccgcucacccugacagccgcuguccuuaugcugguggcccauuacgcgauuaucggcccugggcuccaggccaaggcuacccgcgaggcccaaaaaagaacagcugccggaauuaugaagaaccccaccguugauggcaucguggccaucgaccuggaucccgucguguaugacgcgaaguuugaaaaacagcuggggcagauuaugcuccuuauccuguguacgucucagauucugcucaugcggacaaccugggcucugugcgagagcaucacacuugccaccggaccucugaccacacucugggagggcuccccgggcaaguucuggaauacgaccauugcugugucuauggccaacaucuuucgcgggagcuaccuggccggagcuggccuggccuucucccucaugaaaagccuugggggaggcagacgggggacaggagcgcaaggcgaaacccugggcgagaaguggaaaagacagcugaaucagcucuccaagucugaauucaacacauauaagcgcagcgggaucauggagguugaccgguccgaagccaaagagggacugaagagaggcgagaccacgaaacacgcugucucucgcgggacagccaagcuucggugguuuguggaaagaaaucuggugaaacccgagggaaaggucauugaucucggcugugggcgcggaggcuggagcuacuauugcgcuggccugaagaaaguuaccgaagugaagggguacaccaaaggaggcccugggcacgaggaacccaucccuauggccacauacggauggaaccuggugaagcuccauuccggcaaagacgucuucuuuauucccccugagaagugugauacccuucugugcgacaucggggagucuagcccgaaucccacaauugaagagggacggacgcugagagugcucaaaaugguugaaccuuggcugcgcggcaaccaguucuguaucaagauucuuaaucccuauaugccuuccguggucgagacccuggagcaaaugcagcggaagcacggcgggaugcucgugagaaacccccugagccgcaauucuacacaugaaauguacuggguuuccugcggaaccggcaacaucgugagcgcggucaauaugacaucucggaugcugcucaacagauuuaccauggcccaccgcaaaccgacguaugagagagauguggaccuggggaccggaacacggcacguggcugucgaaccugagguugccaaccuugauaucauuggccagcgcaucgaaaauauuaagcaugagcacaaauccaccuggcauuacgacgaggauaaccccuauaagacaugggcuuaccacgggagcuaugaagugaaacccucuggauccgccagcuccauggugaauggcgucgugaagcugcucaccaagccuugggacguuauccccauggugacacagauugcuaugaccgauacgacaccuuucggccaacagagagucuuuaaagagaagguggacacccggaccccgaaagccaagagagggacagcgcagaucauggaaguuacggcccgguggcuguggggauuccuuagccgcaacaaaaagcccagaaucuguacccgggaggaauuuacacgcaaggugagaucuaaugcugccauuggcgcugucuucguggacgagaaccaauggaauagcgccaaagaggccguugaagaugagcgguuuugggaccuggugcaucgcgaaagagagcuccacaagcaggggaaaugcgcgaccugcgucuacaacaugaugggaaagcgggaaaaaaagcugggcgaguucgggaaggcuaaaggcucccgcgccaucugguacauguggcugggagccagauuucucgaguucgaagcucugggcuucaugaaugaggaucacugguuuucucgggaaaacagccuuuccgggguggagggagagggccugcauaagcucggguauauucugcgcgacaucucuaaaauuccuggaggcaauauguacgccgaugacacagcugggugggauaccagaaucacagaagacgaucuucagaacgaggccaagaucaccgacauuauggaacccgagcacgcgcugcucgccaaagcuaucuucaagcugacguaucagaauaaagucgugcggguucaacgcccugccaagaacggcaccgugauggaugucauuagcagacgggaccagagaggauccggccagguggggacauacggacugaauaccuuuacaaacauggaagcucagcucauccgccaaauggagucugagggcauuuucagccccuccgaacuggagaccccgaaccuugccgaacgggcgcuggauuggcucgagaaguaugggguggaaagacugaaacgcauggccaucagcggagacgacuguguugugaagccuaucgaugaccgguuugcuacggcccuuacagcucugaaugauaugggcaaagucagaaaggacauuccccagugggagccuucuaaaggguggaacgauuggcagcaggugcccuucugcucccaucacuuucaccaacucaucaugaaggacggccgcgagauuguugugccuugucggaaucaggaugaacuggucggaagagcccgcgugagccagggcgcuggguggucucugcgggagaccgccugccucggaaaguccuacgcgcagauguggcaacugauguauuuccauagacgcgaccuucggcuggccgcuaacgccaucuguagcgccguccccguggauuggguuccgacauccagaaccacguggucuauucacgcucaucaccaguggaugaccacagaagacaugcucagcguguggaaucgggucuggaucgaggaaaacccuuggauggaggauaaaacccauauuuccagcugggaggacgugcccuaccugggcaagagagaagaccaguggugcgggucucuuaucggacugacagcccgcgcgaccugggcuacaaauauccaaguugccauuaaccaggugcggagacucaucggcaaugagaacuaccuggauuauaugaccuccaugaaacgcuuuaagaaugaaagcgaccccgagggggcccugugguga

SEQ ID NO: 18817 - RNA, 9879 nt, Artificial Sequence
  derived and/or modified CDS sequence (opt5) from DENV-1__EU660391__SS-prME
agcgugacaaugcugcugaugcugaugcccacagcccuugcuuuccaccugacgaccagaggcggggagccucauaugaucgucuccaagcaggaacggggaaaaucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgcaaagaccuucuggugacauuuaagaccgcgcacgccaagaaacaggaagucgugguucucggaucccaggagggcgcuaugcacaccgcccugacaggggccacggaaauucaaaccagcggaacaaccacaaucuucgcuggccaucugaagugcagacucaaaauggauaagcugacccuuaaagggaugucuuaugugauguguacgggcuccuucaagcuggagaaggaagucgccgagacacagcacggaaccgugcucguucagauuaaauacgagggcaccgacgcgccgugcaagaucccuuuuagcacacaggaugaaaaaggggugacccaaaacggacggcugaucacagcuaaucccauugucacggacaaggagaaaccugugaacaucgaagccgagccgcccuucggcgagucuuauauugugaucggggccggagaaaaggcucugaaacuuagcugguuuaaaaagggcuccucuauugggaaaauguucgaggccaccgcuagaggcgcccgccggauggcgauccucggagauacagccugggacuuuggcagcaucgggggaguuuucaccuccgucggcaagcuggugcaucagauuuuugggacagcuuacggagugcuguucagcggcgucucuuggaccaugaaaaucgggauuggcgugcuccugacguggcuuggacucaauuccagaagcaccucucucuccaugacauguaucgccguuggccuggugacccuguaccuuggggucauggugcaggcugauagcggaugcguuauuaacuggaagggccgcgaacucaaguguggguccggaaucuuugugacaaaugagguccacaccuggacagaacaguauaaauuccaagccgacucuccuaagcggcugagcgcggccauuggcaaggcuugggaggagggggugugcggcaucagauccgccacccgccuggaaaacaucauguggaagcagauuucuaacgagcucaaucauauccugcuugaaaacgacaugaaauuuacgguuguggucggagauguggcuggcauucuggcccaggggaagaaaaugauccggccgcagcccauggaguacaaguauagcuggaaguccuggggaaaagccaagauuaucggcgcugacgugcaaaauacaaccuucaucauugaugggccuaacacccccgaauguccugacgaucagagagcguggaauaucugggaggucgaggacuacggauuuggcauuuucacaaccaacaucuggcucaaacugcgcgauagcuauacgcagguuugcgaccaccggcugaugucugccgcuauuaaggauuccaaagccgugcacgccgacaugggcuacuggaucgaaagcgagaagaaugaaacauggaaacuugcuagagccucuuucaucgaggugaaaaccuguauuuggcccaagucccauacacucuggagcaacgggguccuggaaucugagaugaucauuccgaaaaucuauggaggcccuauuagccagcacaauuaccgccccggguacuuuacccaaacagcgggaccuuggcaucugggcaagcucgagcuggauuucgaccuuugcgaagggaccacggugguuguggaugagcacugcggaaaccggggccccucccugagaaccacaaccgucacaggcaaaaucauccacgaaugguguugccggagcuguacccucccuccccugcgcuuuaagggggaggacggaugcugguauggcauggagauuagaccggugaaggaaaaagaggaaaaucugguuaagucuaugguguccgcugggagcggagaggucgacuccuucucucuuggccuccuguguaucagcauuaugaucgaagaggugaugcgguccagauggucucgcaaaaugcugaugacggggacacucgccgucuuuuuccugcuuauuaugggacagcugaccuggaacgaucucauccggcugugcauuauggugggcgccaaugcuagcgacagaaugggcauggggacaaccuaccuggcccuuauggcgaccuuuaagaugcgcccuauguucgcugucggacugcucuuuagacggcugacaucccgcgaggugcuccugcuuacgaucggccugucucucguggccagcgucgaacugcccaacucccuggaggaacuuggggauggacuggccaugggcaucaugauucucaaacugcucaccgacuuccagagccaucaacugugggcuacacuucugucucucaccuuuaucaagacaaccuucucccugcacuaugccuggaagacgauggcuaugguucugagcauugugucucuuuuuccccugugucucuccacaaccagccagaaaaccacauggcugccugugcuccuggggucucuuggaugcaagccgcugaccauguuccugaucgccgagaauaaaauuuggggcagaaaguccuggccccucaacgaaggcaucauggcggucgggaucgugagcauucugcuuuccagccugcucaaaaacgauguuccucuggccggaccccucaucgcuggcgggaugcugauugccuguuacgugaucucuggaagcuccgcugaccuuucucuggagaaggccgccgaggucagcugggaagaggaagcugagcauuccggcgcgucucacaauauucugguggaaguucaggaugacgggacaaugaaaaucaaggaugaggagcgggacgauacgcucaccauccugcuuaaggccacacugcucgcugugagcggagucuauccucuguccauucccgccacccucuucgugugguacuuuuggcagaaaaagaaacaacgcucuggcguccugugggacacaccuuccccucccgaaguggagagagccguucuugaugacggcaucuaucggauuaugcagcgcgggcugcugggaagaucccaggugggcgucgggguguuccaggaaaacguuuuucauaccauguggcacgugacgcggggagcuguccucauguaccaaggcaagcgccuggagcccagcugggccucugugaaaaaggaccuuaucuccuacgggggaggcuggagacugcagggcagcuggaauaccggggaggaagugcagguuauugcggucgagcccggaaagaacccuaaaaaugugcagacagcucccggcaccuucaagacaucugaaggggaggugggagccaucgcccucgauuuuaaaccgggcaccuccgggagcccuauugucaaccgggaaggaaagaucgugggccuguauggcaaugggguugugacaacguccggaaccuacgucucugcuaucgcccaagcgaaagcuagccaggacggcccccucccugagauugaggaugaaguguucagaaagcgcaaccugacaaucauggaccuucaccccggguccggaaagacccggagauaucugcccgccauuguucgcgaggccaucaaacggaagcugagaacccucauucuggcuccuacacgcguggucgccagcgaaauggcugaggcccuuaaaggcaugccgauccgguaccagacgaccgcggugaagucugaacauacagggaaagagaucguugaucugaugugccacgccaccuuuacaaugagacuccugucccccgugcgcgucccuaauuauaacaugauuaucauggacgaggcucauuucaccgaucccagcucuauugccgcucggggcuacaucagcacgagagugggaaugggcgaagccgccgcuauuuuuaugacagcgaccccucccggguccguggaggccuucccucaaucuaaugcugucauccaggacgaagaacgggauaucccggaacgcagcuggaacuccggauaugaguggauuaccgacuuucccggcaagacaguuugguucgugccuucuaucaagagcgggaaugauauugccaacugucugcgcaagaauggaaagcgggugauccagcucucccgcaaaaccuucgacacagaguaccagaagaccaaaaacaacgacugggauuacgucgugacgacagacauuagcgaaaugggcgccaauuuuagagcugaucggguuaucgaccccagacgcugccuuaagccugugauucugaaggaugggcccgagcgggucauccuggccggcccgaugccugugaccguugcgucugcugcccaaagacgcggacggaucggcagaaaccacaauaaagaaggggaccaguauauuuacaugggacagccccucaacaaugaugaggaccaugcccacuggacagaggcuaagaugcugcuugauaacaucaauacccccgaaggcauuaucccugcccuguucgagcccgaacgcgagaaauccgcggccauugacggggaauaucggcucagaggagaggcucgcaagacguuuguggagcugaugagacggggcgaucugccugucuggcucagcuacaaaguggccuccgaaggguuccaguauucugaccgcagauggugcuuugauggcgagcggaacaaucaaguccuugaagagaacauggacguggaaaucuggaccaaggagggagagcgcaaaaagcugagaccgcgguggcuggacgcuagaacauacagcgauccccucgcccugcgcgaguucaaggaguuugcugccggccggagauccguuucuggggaccuuauccuggaaauuggaaaacucccucagcaccugacccagcgcgcgcagaaugcccuggauaaccucgugaugcuucauaauagcgagcaaggcgggcgggcuuauagacacgccauggaggaacugcccgacacaaucgagacccugaugcuccuggcucuuauugccgugcugacaggaggcgucacccucuucuuucuguccggccgggggcugggaaagacgagcaucggccuccuuuguguuauggccucuuccgugcugcuguggauggcuagcguggaaccucauuggauugcggccucuaucauccucgaguucuuucugaugguccuucugauucccgaaccggaucgccagagaacaccucaggacaaccagcucgcuuacgugguuaucgggcugcuguucaugauucucaccguggccgccaaugagaugggacuucuggagaccaccaagaaggaucugggcaucgggcacgucgcuguggaaaaccaccaucacgccgcgaugcucgacgucgaucugcaucccgccuccgcuuggacccuuuacgccguggcuacaacgauuaucaccccuaugaugcggcacacaauugagaacaccacagccaauaucagccugaccgcgaucgccaaccaagcugccauucucaugggacuggacaaaggcuggcccaucucuaagauggauauuggcguuccucugcucgcucuugggugcuauagccaggugaauccccugacgcugaccgccgcuguccucaugcugguggcccauuacgcgaucauuggaccgggccuucaggccaaggcuacacgcgaagcccagaagagaaccgcugccgggaucaugaagaacccuacaguugacggaaucguggccauugaucuggaccccgucguguaugacgcgaaauuugagaagcagcucggccagaucaugcugcugauucucuguaccucccagauccuucugaugcggacgacaugggcucugugcgaaucuauuacccucgccacagggccccugaccacccuuugggagggaagcccuggcaaauucuggaauacaacgaucgcuguguccauggccaacaucuuccgcggcagcuaccuggccggggcuggacucgccuuuucccugaugaagucucugggcgggggaagacggggcaccggggcgcaaggagagacacucggcgaaaaguggaaacgccagcuuaaucagcugagcaaguccgaguucaacaccuauaaaagaucuggcauuauggaaguugaucggagcgaggccaaggaagggcugaaaagaggagagacaaccaagcacgcugucucccgcggcacggccaagcuccggugguuuguggagagaaaucuggugaaaccggaagggaaggucaucgaccuuggauguggccgcgggggauggucuuacuauugcgcuggccugaaaaagguuacagaggugaaaggcuacaccaaagggggacccggccacgaggaaccuauucccauggccaccuacggguggaaccucgugaaacugcauagcggaaaggaugucuucuuuaucccucccgaaaagugugacacacugcucugcgauauuggcgaguccagcccuaauccgaccaucgaggaagggcggacacuuagagugcugaaaaugguugagcccuggcugcgcggaaaccaguucuguauuaagauccucaauccuuauaugcccucuguggucgaaacgcuggagcaaaugcagcggaaacacggcggcaugcuugugagaaacccucugucccgcaauagcacccaugagauguacuggguuucuugcgggacaggaaacaucguguccgcggucaauaugaccagccggaugcuccugaacagauuuacaauggcccaccgcaagcccaccuaugaacgggacguggaucugggcgcugggacgagacacguggccgucgagccggaaguugcuaaccucgacauuaucggacagcgcauugagaauaucaaauacgaacauaagucuaccuggcacuaugaugaggacaacccuuacaagacaugggccuaucauggcuccuacgaggugaaacccagcggguccgcuagcucuauggugaauggagucgugaagcugcuuaccaaacccugggauguuauuccuauggugacacagaucgccaugaccgacacaacccccuucggccaacagagagucuuuaaggaaaaaguggacacgcggacaccuaaggcgaagcgcggcaccgcccagaucauggagguuaccgcuaaauggcuguggggguuccucagcagaaacaagaaaccgcggauuuguacaagagaagaguuuacgcggaaggugcgcuccaaugccgcuaucggagccgucuucguggaugaaaaccaauggaacucugccaaagaggcgguugaggacgaaagauuuugggaucuggugcaccgggagcgcgaacuucauaagcagggcaagugcgcuaccugcgucuacaacaugauggggaaaagagagaagaaacugggagaguucggcaaggccaaagggagccgggccauuugguauauguggcucggcgcucgcuuccuggaguuugaggcccugggauucaugaaugaagaccacugguuuuccagagagaacucucucagcggcguggaaggggagggacugcacaaacuuggcuacauccugcgggauauuuccaaaauccccgggggaaauauguaugcugacgauacagccggcugggacacccgcaucacagaggaugaccuccagaacgaagcgaagauuaccgauaucauggagccugaacaugcccugcuugcuaagucuauuuucaaacugacauaccagaauaaggucgugagaguucaacggcccgccaaaaacgggaccgugauggacgucaucagccgcagagaucagcggggcuccggacaggugggcacguaugggcucaauaccuuuacaaacauggaggcucagcugauucgccaaauggaaagcgagggaaucuucucuccuuccgagcuggaaacccccaaccucgccggcagagugcuggacuggcuugagaagcacgggguugaacggcugaaaagaauggcgaucagcggagacgauuguguggucaagccgauugacgaucgcuuugccacagcucucaccgcccugaaugacaugggcaaggugcggaaagauaucccucagugggagcccucuaagggguggaacgacuggcagcagguuccuuucugcucccaucacuuucaccaacuuauuaugaaagauggcagagaaaucgugguccccugucgcaaucaggacgagcuggugggacgggcuagagucagccagggcgccggguggucccuccgcgagacggcuugccugggaaagucuuacgcccagauguggcaacugauguauuuccaucggagagaucuccgccuggcggccaacgcuauuuguagcgccgugccuguugacugggugcccacaucccggaccacauggagcauccacgcccaucaccaguggaugaccacggaagauaugcuuucugucuggaauagaguguggauugaggaaaacccguggauggaggacaaaacccauaucuccagcugggaagacguuccuuaccugggcaagcgcgaggaucaguggugcgggucucucaucggacugacagcucgggccaccugggcgacaaauauucaaguggcuaucaaccaggucagacggcuuauuggcaaugagaacuaccuggacuauaugaccagcaugaagagauuuaaaaaugaauccgaucccgagggggcccucugguga

SEQ ID NO: 18818 - RNA, 9879 nt, Artificial Sequence
  derived and/or modified CDS sequence (opt5) from DENV-1__EU660393__SS-prME
agcgugaccaugcugcucaugcugaugcccacagcccuugcuuuccaccugacgaccagaggcggggaaccucauaugaucgucuccaagcaggaacggggaaaaucucuccuguuuaagacaagcgccggcguuaacaugugcacccuuaucgcgauggaccugggggaacucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaaggggaucacgcagagcggacggcugauuaccgcgaaccccaucgugacagacaaagagaagccugucaauauugaagcugagccgcccuuuggcgagucuuauaucauuaucggggccggagaaaaagcccuuaagcucagcugguucaagaaaggcuccucuaucgggaagauguuugaggcuaccgccagaggcgcucgccggauggccauucugggagauacagcgugggacuucggcagcaucgggggaguguuuaccuccgugggcaaacugguucaucagauuuucgggacggccuacggaguccucuuuagcggcgugucuuggaccaugaagaucgggauuggcgugcugcuuacauggcugggacucaacuccagaagcaccucucuguccaugacauguaucgcugucggccuggugacccuuuaccucgggguuauggugcaggccgauagcggaugcgucauuaauuggaaaggccgcgaacugaaguguggguccggaaucuucgugacaaacgagguucacaccuggacggaacaauauaaguuucaggcugacucuccuaaacggcugagcgccgcgaucggcaaggccugggaggagggggugugcggcauuagauccgcuacacgccucgaaaauaucauguggaaacagauuucuaacgagcugaaccauauccuucuggaaaaugacaugaaguucaccgucgugguuggagauguggccggcauucucgcucaggggaaaaagaugauccggccgcaacccauggaguacaaauauagcuggaaguccuggggaaaggccaaaaucauuggcgccgacguccagaacaccacauuuaucauugaugggccuaauacccccgaauguccugacgaucagagagcuuggaacaucugggagguggaggacuacggauucggcauuuuuacgacaaauaucuggcugaagcugcgcgauagcuauacccaggugugcgaccaccggcuuaugucugcggccaucaaagauuccaaggcuguccacgccgacaugggcuacuggauugaaagcgagaaaaacgaaacauggaagcucgccagagcuucuuucaucgagguuaagaccuguauuuggcccaaaucccauacacuguggagcaauggggugcuggaaucugagaugaucauuccgaagaucuauggaggcccuaucagccaacacaacuaccgccccggguacuucacccagacggccggaccuuggcaucucggcaaacuggagcuugauuuugaccugugcgaagggaccacaguggucguggaugagcacugcggaaaucggggccccucccucagaaccacaaccguuacgggcaagauuauccacgaaugguguugccggagcuguacacugccuccccugcgcuucagaggggaggacggaugcugguauggcauggagauucggccggugaaagaaaaggaggaaaaccuugucaagucuaugguguccgcggggagcggagagguugacuccuuuucucucggccugcuguguaucagcauuaugaucgaagaggugaugagaucccgcuggucucggaaaaugcucaugaccgggacacuggcugucuucuuucuucugauuaugggacagcucaccuggaaugaucugaucagacugugcaucauggugggcgccaacgccagcgaccgcaugggcauggggaccacauaccuugcucugauggccacguucaagaugagaccuauguuugcgguuggacuccuguuccggcgccucaccuccagagaggugcugcuucugacaauuggccucucucuggucgcuagcguggaacugcccaauucccuugaggaacugggggauggacucgccaugggcaucaugauucugaaacuccugaccgacuuucaaagccaucagcuuugggccacacugcucucucugaccuucaucaagacgacauuuucccugcacuaugcuuggaaaaccauggccauggugcuuagcauugucucucuguucccccucugucuguccaccacaagccagaagaccacauggcucccuguucugcuugggucucugggaugcaagccgcugacgauguuucucaucgcugagaacaaaaucuggggccggcgcuccuggccccugaaugaaggcauuauggccguggggaucgugagcauucuucuguccagccuccugaagaacgaugucccucucgcgggaccccugaucgccggcgggaugcuuauugcuuguuacgugaucucuggaagcuccgccgaccugucucuggagaaagcugccgagguuagcugggaagaggaagccgagcauuccggcgcuucucacaacauccucguggaaguccaggaugacgggaccaugaagauuaaagaugaggagagagacgauacacugaccauccuucugaaggcgacacuccuggccgugagcggaguuuauccucucuccauucccgcuacccuguucgugugguacuucuggcagaagaagaagcagcggucuggcguccuuugggacacgccuagcccucccgaaguggagcgcgccguccuggaugacggcaucuauagaauuaugcagcgggggcugcucggacgcucccaggugggcguugggguguuucaagaaaaugucuuccauaccauguggcacgugacaagaggagccguucugauguaccagggcaaacggcuugagcccagcugggcuucugugaagaaagaccugaucuccuacgggggaggcuggagacuccagggcagcuggaacaccggggaggaaguccaggugauugccguggagcccggaaagaauccuaaaaacguucaaacagcgcccggcaccuuuaagacaccggaaggggaggucggagcuaucgcccuggauuucaagccuggcacgucugggucccccaucgugaaucgcgaaggaaaaauugugggccucuauggcaacggggucgugaccacaagcggaaccuacguuuccgccaucgcucaggccaaggcgucucaggagggcccucugcccgagauugaagacgagguguuucggaaaagaaaucuuaccaucauggaucugcaccccgggagcggaaagacacgccgguaucugccugcuauugucagagaagccaucaaacgcaagcuccggacgcugauccuugccccgaccagagugguugcuuccgagauggccgaagcucugaagggcaugcccauucgcuaccaaacaaccgccgugaaaagcgagcauacagggaaggagaucgucgaccucaugugccacgcgaccuucacgaugcggcugcugucuccugugagaguucccaacuauaauaugauuaucauggaugaagcccauuuuacagacccuuccagcauugcugcccggggcuacaucucuacccgcgugggaaugggcgaggcugccgccaucuucaugaccgcuacacccccugggagcgucgaagcguuuccgcaguccaacgccgugauucaggaugaggaaagagacauccccgagcggucuuggaauagcggauaugaguggauuaccgauuucccuggcaaaacagugugguuuguccccuccaucaagucugggaacgacauugcuaauugucuccgcaaaaacggaaagagaguuauccagcuuagccggaagaccuucgauacggaauaccagaaaaccaagaauaacgacugggacuacguggugaccacagauauuuccgagaugggcgccaacuucagagccgaccgcgucaucgauccucggagaugccugaaacccgugauccugaaggacgggccggaacgcguuauucucgcuggcccuaugcccgugaccgucgccagcgcggcucagcggagaggacgcaucggccggaaucacaacaaagagggggaucaguauauuuacaugggacagccccugaauaacgacgaggaucaugcccacuggacggaagccaagaugcuucuggacaauaucaacaccccugagggcauuauccccgcucucuuugaaccugagagagaaaagucugccgcgaucgauggggaguaucgccugagaggagaggcccggaaaacauucguggaacugaugcgcagaggcgaccucccgguuuggcuuuccuacaagguggcuagcgagggguuucaauauuccgaucggcgcuggugcuucgacggcgaaagaaauaaccagguccuggaggaaaauauggauguggagauuuggaccaaagagggagaacggaagaaacugagaccccgcuggcucgacgcccggacauacucugacccucuggcucuuagagaguuuaaggaguucgccgcuggccgccggagcgucuccggggaucugauccucgagauuggaaaacugccccagcaccugacccagagagcccaaaacgcgcucgacaaucuugugaugcugcauaacucugaacagggcgggcgggccuaucgccacgcuauggaggagcugccugauacaaucgaaacccucaugcugcuugcccugauugcuguucucacgggaggcgugacacuguuuuuccugagcggcagagggcucggaaagaccuccaucggccuucugugugugauggccagcucuguccugcucuggauggccuccguugagccccauuggaucgcugcgagcauuauccuggaauuuuuccuuauggugcugcucauuccggagccugaccggcagcgcacaccccaggauaaucaacuggccuacguggucaucgggcugcucuuuaugauucuuacaguggcugccaacgagaugggacugcuggaaaccacaaagaaagaccucggcaucgggcacguugccguggagaaucaccaucacgcugccaugcuggaugucgaccuucauccugcgucugccuggacgcuguacgcuguggccaccacaauuaucacccccaugaugagacacacaaucgaaaacaccacggcuaacauuucccucaccgccaucgcgaaucaggccgcuauucugaugggacuggauaagggcuggccuaucagcaaaauggacauuggcgucccccuccuugcccuggggugcuauucucaggugaacccgcugacacucaccgcugccguucugaugcuuguggcucauuacgccaucaucggaccuggccugcaagcgaaggccacacgggaggcucagaaacgcaccgccgcugggauuaugaagaaucccacggucgauggaaucguggccauugaccucgaucccguuguguaugacgccaaguucgaaaaacagcugggccagaucaugcugcucauucuuuguacaagccaaauccugcugaugagaaccacaugggcgcucugcgaguccaucacccuggcuaccgggccucuuacaacgcugugggagggaucuccgggcaaguuuuggaacaccacaauugccgucagcauggcuaauaucuuccggggcuccuaccucgccggggccggacuggcuuucagccugaugaaaucccucggcgggggacgcagaggcaccggggcccagggagaaacacuuggcgagaaguggaaacggcagcugaaccagcugucuaagagcgaauuuaauaccuauagacgcuccggcauuauggagguggaccggucugaagcgaaggaggggcucaaaagaggagagacgacaaagcacgccgugagccgcggcaccgcuaaacugcggugguucguugaaagaaaccuugucaagcccgaggggaaagugaucgaucugggauguggccgcgggggaugguccuacuauugcgccggccucaagaaggugaccgaagucaaaggcuacacaaaagggggaccuggccacgaggaacccauuccuauggcuaccuacggguggaaucugguuaaacugcauucuggaaaggacguguuuuucauucccccugagaaaugugauacacuccuuugcgacauuggcgagagcuccccgaaccccacgaucgaagaggggcggacccugagagugcugaagauggucgaaccuuggcuccgcggaaaucaauuuuguaucaaaauucugaaccccuauaugccuagcgugguugagacacuugagcagaugcagcggaagcacggcggcaugcuggugagaaauccccucucucgcaacuccacccaugaaauguacugggucagcugcgggacaggaaauaucgugucugccguuaacaugaccucccggaugcugcugaauagauucacgauggcgcaccgcaagccgaccuaugagagagauguggaccucggcgccgggacacggcacgucgcuguggaaccugagguggccaaccuggauauuaucggacagcgcauugaaaacaucaaacaugagcacaagagcaccuggcauuacgacgaggauaaucccuauaaaacaugggcuuaccacggcucuuaugaagucaagcccuccgggagcgccuccagcaugguuaacggaguggugaaacuucugaccaagccuugggacgucauccccauggugacacaaauugcuaugaccgauacgacaccuuuuggccagcagagaguuuucaaggagaaaguggacacccggaccccgaaggccaaaagaggcacagcgcaaaucauggaagucacggccaaguggcucuggggguuucugucucggaauaaaaagccccgcauuuguaccagagaggaguucacacggaaggugcgcagcaacgcugccaucggagcuguuuuuguggacgagaaucaguggaacuccgccaaagaggccgucgaagaugagagauucugggaccuugugcaucgggaacgcgagcugcacaagcagggcaaaugcgcgaccugcguuuacaauaugauggggaagagagagaaaaagcucggagaguuuggcaaggcuaaagggucucgggccauuugguacauguggcugggcgcccgcuuccuggaguucgaagcucucggauuuaugaacgaggaucacugguucagcagagaaaauucccugucuggcguggagggggagggacuucauaagcugggcuauauccuccgggacaucagcaaaauuccugggggaaacauguacgccgaugacacagcuggcugggauacccgcaucacagaagacgaucugcagaaugaggccagaauuaccgacaucauggaacccgagcacgcgcuucuggccaaguccauuuuuaaacucacguaucaaaacaaggucgugcggguccagcgcccugcuaaaaaugggaccgugauggauguuaucucuagacgggaccagagaggcagcggacaggugggcacauacgggcugaacaccuucacaaauauggaagcccaacugauccgccagauggaguccgagggaauuuuuagccccucugaacucgagaccccgaaccuggcugaacggguccuugauuggcuggagaaguauggcguggaaagacucaagcgcauggccaucuccggggacgacugugugguuaaaccuauugaugaccgguucgcgacggcccugacagcucuuaacgauaugggaaaggugagaaaagacaucccccagugggagccuagcaagggcuggaaugauuggcagcaaguccccuuuugcucucaucacuuccaccagcugauuaugaaagacgggcgcgagaucgugguuccuugucggaaccaggaugaacucgugggcagagcccgcgucucccagggagcuggcuggagccugcgggagaccgccugccuggggaaguccuacgcucaaauguggcagcucauguauuuucauagacgcgaccugcggcuugccgcgaaugccauuuguucugcugugcccgucgauuggaucccgacaagcagaaccacgugguccauccacgcccaucaccaguggaugaccacagaagacaugcugagcguguggaaccggguuuggauugaggaaaauccuuggauggaggauaagacccauaucucuuccuggggagacgugcccuaccucggcaaaagagaggaccaauggugcgggagccugauuggacuuacagcccgcgcuaccugggccacaaacauccaggucgcgauuaaucaggugcggagacugaucggcaacgaaaauuaccucgauuauaugaccucuaugaagcgcuucaaaaacgagagcgaccccgaaggggcucugugguga

SEQ ID NO: 18819 - RNA, 9879 nt, Artificial Sequence
  derived and/or modified CDS sequence (opt5) from DENV-1__EU660401__SS-prME
agcgugaccaugcugcucaugcugaugcccacagcccuugcuuuccaccugacgaccagaggcggggaaccucauaugaucguguccaagcaggaacgggggaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauuaucauuggggccggagaaaaagcccuuaagcucucuugguucaagaaaggcagcuccaucgggaagauguuugaggcuaccgccagaggcgcucgccggauggccauccugggagauacagcgugggacuucggcucuauugggggaguguuuaccagcguuggcaaacugguccaucagaucuucgggacggccuacggagugcucuuuuccggcgugagcuggaccaugaagauugggaucggcguccugcuuacauggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcugucugccgcgaucggcaaggccugggaggagggggucugcggcaucagaagcgcuacacgccucgaaaacauuauguggaaacagaucuccaacgagcugaaucauauucuucuggaaaacgacaugaaguucaccgugguugugggagaugucgccggcauccucgcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaagcugcgcgauucccacacccaggucugcgaccaccggcuuaugagcgcggccaucaaagauucuaaggcuguucaugccgacaugggcuauuggaucgaauccgagaaaaaugaaacauggaagcucgccagagcuagcuucauugaggugaagaccuguaucuggcccaaaucucacacacugugguccaacggggugcuggaaagcgagaugauuaucccgaagauuuacggaggcccuaucucucaacauaauuaucgccccggguacuucacccagacggccggaccuuggcaccucggcaaacuggagcuugauuuugaccugugcgaagggaccacagucgugguugaugagcacugcggaaaccggggccccagccucagaaccacaaccgugacgggcaagaucauucaugaaugguguugccgguccuguacacugccuccccugcgcuucagaggggaggacggaugcugguacggcauggagauccggccggucaaagaaaaggaggaaaaucuugucaagagcaugguuucugcgggguccggagagguggacagcuuuucccucggccugcuguguauuucuaucaugauugaagaggucaugagaagccgcuggucccggaaaaugcucaugaccgggacacuggcuguguucuuucuucugaucaugggacagcucaccuggaacgaucugauuagacugugcaucaugguuggcgccaaugccucugaccgcaugggcauggggaccacauaucuugcucugauggccacguucaagaugagaccuauguuugcggugggacuccuguuccggcgccucaccagcagagagguccugcuucugacaaucggccucucccugguggcuucuguggaacugcccaacagccuugaggaacugggggauggacucgccaugggcauuaugauccugaaacuccugaccgacuuucaaucccaccagcuuugggccacacugcucagccugaccuucauuaagacgacauuuucucugcauuacgcuuggaaaaccauggccaugguccuuuccaucguuagccuguucccccucugucugucuaccacaucccagaagaccacauggcucccugugcugcuugggagccugggaugcaagccgcugacgauguuucucauugcugagaauaaaaucuggggccggcgcucuuggccccugaacgaaggcaucauggccguggggauugucuccauccuucugagcucccuccugaagaacgaugugccucucgcgggaccccugauugccggcgggaugcuuaucgcuuguuauguuauuagcggaucuagcgccgaccugucccuggagaaagcugccgaggugucuugggaagaggaagccgagcacagcggcgcuucccauaauauccucgucgaagugcaggaugacgggaccaugaagaucaaagaugaggagagagacgauacacugaccauucuucugaaggcgacacuccuggccguuucuggaguguacccucucagcauccccgcuacccuguucgucugguauuucuggcagaagaagaagcagcgguccggcgugcuuugggacacgccuucucccccggaagucgagcgcgccgugcuggaugacggcauuuacagaaucaugcagcgggggcugcucggacgcagccagguuggcgugggggucuuucaagaaaacguguuccacaccauguggcacguuacaagaggagccgugcugauguaucagggcaaacggcuugagccuuccugggcuagcgucaagaaagaccugauuucuuacgggggaggcuggagacuccagggcuccuggaauaccggggaggaaguccaggugaucgccguugagcccggaaagaacccuaaaaauguccaaacagcgcccggcaccuuuaagacaccggaaggggaggugggagcuauugcccuggauuucaagccuggcacgagcgggucucccaucgugaaccgcgaaggaaaaaucgucggccucuacggcaauggggugguuaccacauccggaaccuaugugagcgccauugcucaggccaaggcgucccaggagggcccucugcccgagaucgaagacgaggucuuucggaaaagaaaccuuaccauuauggaucugcaucccgggucuggaaagacacgccgguaccugccugcuaucgugagagaagccauuaaacgcaagcuccggacgcugauccuugccccgaccagaguuguggcuagcgagauggccgaagcucugaagggcaugcccauccgcuaucaaacaaccgccgucaaauccgagcacacagggaaggagauuguggaccucaugugccaugcgaccuucacgaugcggcugcugagcccuguuagagugcccaauuacaacaugaucauuauggaugaagcccacuuuacagacccuucuuccaucgcugcccggggcuauauuagcacccgcgucggaaugggcgaggcugccgccaucuucaugaccgcuacacccccugggucuguggaagcguuuccgcagagcaaugccgugauccaggaugaggaaagagacauucccgagcgguccuggaacucuggauacgaguggaucaccgauuucccuggcaaaacagucugguuuguucccagcauuaaguccgggaaugacaucgcuaacugucuccgcaaaaauggaaagagagugauucagcuuucucggaagaccuucgauacggaauaucagaaaaccaagaacaacgacugggacuacguggucaccacagauaucagcgagaugggcgccaauuucagagccgaccgcgugauugauccucggagaugccugaaacccguuauccugaaggacgggccggaacgcgugauccucgcuggcccuaugcccgucaccguggccuccgcggcucagcggagaggacgcauuggccggaaccauaauaaagagggggaucaguacaucuauaugggacagccccugaacaaugacgaggaucacgcccacuggacggaagccaagaugcuucuggacaacauuaauaccccugagggcaucauucccgcucucuuugaaccugagagagaaaagagcgccgcgaucgauggggaguaccgccugagaggagaggcccggaaaacauucguugaacugaugcgcagaggcgaccucccgguguggcuuucuuauaaggucgcuuccgagggguuucaauacagcgaucggcgcuggugcuucgacggcgaaagaaacaaucaggugcuggaggaaaacauggaugucgagaucuggaccaaagagggagaacggaagaaacugagaccccgcuggcucgacgcccggacauauuccgacccucuggcucuuagagaguuuaaggaguucgccgcuggccgccggucugugagcggggaucugauucucgagaucggaaaacugccccagcaucugacccagagagcccaaaaugcgcucgacaaccuuguuaugcugcacaauuccgaacagggcgggcgggccuaccgccaugcuauggaggagcugccugauacaauugaaacccucaugcugcuugcccugaucgcugugcucacgggaggcgugacacuguuuuuccugucuggcagagggcucggaaagaccagcauuggccuucugugugucauggccuccagcguucugcucuggauggccucuguggagccccacuggaucgcugcguccaucauucuggaauuuuuccuuauggugcugcucaucccggagccugaccggcagcgcacaccccaggauaaccaacuggccuaugucgugauugggcugcucuuuaugauccuuacaguugcugccaaugagaugggacugcuggaaaccacaaagaaagaccucggcauugggcacguggccgucgagaaccaucaccaugcugccaugcuggauguggaccuucacccugcgagcgccuggacgcuguacgcugucgccaccacaaucauuacccccaugaugagacauacaaucgaaaacaccacggcuaauaucucucucaccgccauugcgaaccaggccgcuauccugaugggacuggauaagggcuggccuauuuccaaaauggacaucggcgugccccuccuugcccuggggugcuacagccagguuaauccgcugacacucaccgcugccgugcugaugcuugucgcucacuaugccauuaucggaccuggccugcaagcgaaggccacacgggaggcucagaaacgcaccgccgcugggaucaugaagaaccccacgguggauggaauuguugccaucgaccucgaucccguggucuacgacgccaaguucgaaaaacagcugggccagauuaugcugcucauccuuuguacaucucaaauucugcugaugagaaccacaugggcgcucugcgagagcaucacccuggcuaccgggccucuuacaacgcugugggagggauccccgggcaaguuuuggaauaccacaaucgccgugucuauggcuaacauuuuccggggcagcuaucucgccggggccggacuggcuuucucccugaugaaaagccucggcgggggacgcagaggcaccggggcccagggagaaacacuuggcgagaaguggaaacggcagcugaaucagcuguccaagucugaauuuaacaccuacaagagaagcggcaucauggagguggaccgcuccgaagcgaaagaggggcucaagcggggagagacgacaaaacacgccguuucuagaggcaccgcuaagcugcgcugguucgucgaacggaaucuugugaaacccgaggggaaggugauugaucugggauguggcagagggggauggagcuauuacugcgccggccucaagaaagucaccgaaguuaagggcuauacaaaagggggaccuggccaugaggaacccaucccuauggcuaccuacggguggaaccuggugaagcugcacuccggaaaagacguguuuuucauucccccugagaagugugauacacuccuuugcgacaucggcgagucuagcccgaaucccacgauugaagaggggcgcacccugcggguccugaaaaugguggaaccuuggcucagaggaaaccaauuuuguaucaagauccugaaucccuacaugccuuccguuguggagacacuugagcagaugcagcgcaagcauggcggcaugcugguccggaacccccucagcagaaauucuacccacgaaauguauuggguguccugcgggacaggaaacauuguuagcgccgugaauaugaccucucgcaugcugcugaaccgguucacgauggcgcacagaaaaccgaccuacgagcgcgaugucgaccucggcgccgggacaagacauguggcuguggaaccugaggucgccaaccuggauaucauuggacagcggaucgaaaauauuaagcacgagcauaaauccaccuggcacuaugacgaggauaaccccuacaagacaugggcuuaucauggcagcuacgaaguuaaacccucuggguccgccagcuccauggugaauggaguggucaaacuucugaccaagccuugggacgugauccccaugguuacacaaaucgcuaugaccgauacgacaccuuuuggccagcagcgcguguucaaagagaaggucgacaccagaaccccgaaagccaagcggggcacagcgcaaauuauggaagugacggccaaauggcucuggggguuucugagcagaaacaagaagccccggaucuguacccgcgaggaguucacaagaaaaguucggucuaaugcugccauuggagcuguguuugucgacgagaaccaguggaauagcgccaaggaggccguggaagaugagcgcuucugggaccuuguucacagagaacgggagcugcacaaacagggcaagugcgcgaccugcguguauaacaugauggggaaacgcgaaaagaagcucggagaguuuggcaaagcuaagggguccagagccaucugguacauguggcugggcgcccgguuccuggaguucgaagcucucggauuuaugaaugaggaucauugguucucucgcgaaaacagccuguccggcgucgagggggagggacuucacaaacugggcuacauucucagagacaucucuaagaucccugggggaaauauguaugccgaugacacagcuggcugggauacccggauuacagaagacgaucugcagaacgaggcccgcaucaccgacauuauggaacccgagcaugcgcuucuggccaaaagcaucuuuaagcucacguaccaaaauaaaguggucagagugcagcggccugcuaagaacgggaccguuauggaugugauuucccgcagagaccagcggggcucuggacaggucggcacauaugggcugaauaccuucacaaacauggaagcccaacugaucagacagauggagagcgagggaaucuuuucccccagcgaacucgagaccccgaaccuggcugaacgcgugcuugauuggcuggagaaguacggcguggaacggcucaaaagaauggccauuucuggggacgacuguguugugaagccuaucgaugaccgcuucgcgacggcccugacagcucuuaaugauaugggaaaaguccggaaggacauuccccagugggagccuuccaaaggcuggaacgauuggcagcaagugcccuuuugcagccaccacuuccaucagcugaucaugaaggacgggagagagauuguugugccuugucgcaaucaggaugaacucgucggccgggccagagugucucagggagcuggcuggucccugcgcgagaccgccugccugggaaagagcuaugcucaaauguggcagcucauguacuuucaccggagagaccugcgccuugccgcgaacgccaucuguuccgcuguccccguggauuggauuccgacaucucggaccacguggagcauccaugcccaccaucaguggaugaccacagaagacaugcuguccguuuggaauagaguguggaucgaggaaaacccuuggauggaggauaaaacccacauuagcucuuggggagacguccccuaucucggcaagcgggaggaccaauggugcgggucccugaucggacuuacagccagagcuaccugggccacaaauauucagguggcgaucaaccagguucgccggcugauuggcaaugaaaacuaccucgauuacaugaccagcaugaaaagauucaagaaugagggggaccccgaaggcgcucugugguga

SEQ ID NO: 18820 - RNA, 9879 nt, Artificial Sequence
  derived and/or modified CDS sequence (opt5) from DENV-1__FJ373305__SS-prME
uccgugaccaugcugcucaugcugaugcccacagcccuugcuuuccaccugacgaccagaggcggggaaccucauaugaucgucuccaagcaggaacggggaaaaucucuccuguuuaagacaagcgccggcguuaauaugugcacccuuauugcgauggaccugggggagcucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuuccugacacaagaugaaaagggggugacgcagaacggacggcuuaucaccgcgaaucccauugucacagacaaagagaagccugugaacaucgaagcugagccgcccuuuggcgaguccuauauuaucauuggggccggagaaaaagcccucaagcugagcugguucaagaaaggcucuagcaucgggaagauguuugaggcuaccgccagaggcgcucgccggauggccauccugggagauacagcgugggacuucggcuccauugggggaguguuuaccucuguuggcaaacucguccaucagaucuucgggacggccuacggagugcuguuuagcggcguguccuggaccaugaagauugggaucggcguccuucugacauggcucggacugaauagcagaucuaccucccugagcaugacauguauugcugugggccuuguuacccucuaccugggggugaugguccaggccgauucuggaugcgugaucaacuggaaaggccgcgaacugaaguguggguccggaauuuucguuacaaaugaggugcacaccuggacggaacaauauaaguuucaggcugacagcccuaaacggcucuccgccgcgaucggcaaggccugggaggagggggucugcggcaucagaucugcuacacgccuggaaaacauuauguggaaacagaucagcaacgagcuuaaucauauucugcucgaaaacgacaugaaguucaccgugguugugggagaugucgccggcauccuggcucaggggaaaaagaugauucggccgcaacccauggaguacaaauauuccuggaagucuuggggaaaggccaaaaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaaacuucgcgauagcuauacccaggucugcgaccaccggcucauguccgcggccaucaaagauagcaaggcuguucacgccgacaugggcuacuggaucgaaucugagaaaaaugaaacauggaagcuggccagagcuuccuucauugaggugaagaccuguaucuggcccaaaagccauacacuguggucuaacggggugcucgaauccgagaugauuaucccgaagauuuauggaggcccuaucagccaacacaauuaccgccccggguacuucacccagacggccggaccuuggcaucugggcaaacuugagcuggauuuugaccucugcgaagggaccacagucgugguugaugagcacugcggaaaccggggccccucucugagaaccacaaccgugacgggcaagaucauucacgaaugguguugccggagcuguacacugccuccccuucgcuucagaggggaggacggaugcugguauggcauggagauccggccggucaaagaaaaggaggaaaaucucgugaaguccaugguuagcgcggggucuggagagguggacuccuuuagccugggccugcucuguauuuccaucauuaucgaagaggucaugagaucucgcuggagccggaaaaugcugaugaccgggacacuugcuguguucuuucugcucauuaugggacagcugaccuggaacgaucugaucagacuuugcaucaugguuggcgccaaugccuccgaccgcaugggcauggggaccacauaccuggcucucauggccacguucaagaugagaccuauguuugcggugggacuccuguuccggcgccugaccucuagagagguccuucugcucacaauuggccugagccugguggcuuccguggaacuucccaacucucuggaggaacucggggauggacuggccaugggcaucaugauucucaaacugcuuaccgacuuucaaagccaucagcugugggccacacuccugucccugaccuucaucaagacgacagucagccuucacuaugcuuggaaaaccauggccaugguucugucuauugugucccucuuuccccugugucucagcaccacaucucagaagaccacauggcugccugugcuucuggggucccugggaugcaagccgcucacgauguuccugaucgcugagaauaaaaucuggggccggcgcagcuggccccuuaacgaaggcauuauggccgucgggaucgugucuauucugcucuccagccugcucaagaacgauguuccucuggcgggaccccuuaucgccggcgggaugcugauugcuuguuacgugaucuccggaagcucugccgaccugagccucgagaaagcugccgaggucuccugggaagaggaagccgagcauucuggcgcuagccacaauauccugguggaaguucaggaugacgggaccaugaagauuaaagaugaggagagagacgauacacuuaccauccugcucaaggcgacacugcucgccguguccggagucuauccucugucuauucccgcuacccuuuuugugugguacuucuggcagaagaagaagcagcggagcggcguccugugggacacgccuagcccucccgaaguggagcgcgccguucuggaugacggcaucuauagaauuaugcagcgggggcuccugggacgcucucaggugggcgucgggguguuccaagaaaacguuuuucauaccauguggcacgugacaagaggagccguccuuauguaccagggcaaacggcuggagcccagcugggcuuccgugaagaaagaccucaucagcuacgggggaggcuggagacugcagggcucuuggaauaccggggaggaagugcagguuauugccgucgagcccggaaagaacccuaaaaaugugcaaacagcgcccggcaccuucaagacaccggaaggggaggugggagcuaucgcccucgauuuuaagccuggcacguccgggagccccaucgucaaccgcgaaggaaaaauugugggccuguauggcaaugggguugugaccacaucuggaaccuacgucuccgccaucgcucaggccaaggcgagccaggagggcccucuucccgagauugaagacgagguguuccggaaaagaaaccugaccaucauggaucugcaccccggguccggaaagacacgccgguaucucccugcuauuguuagagaagccaucaaacgcaagcugcggacgcuuauccuggccccgaccagaguggucgcuucugagauggccgaagcucucaagggcaugcccauucgcuaccaaacaaccgccgugaaaagcgagcauacagggaaggagaucguugaccugaugugccacgcgaccuuuacgaugcggcugcucuccccugugagaguccccaauuauaacaugauuaucauggaugaagcccauuucacagacccuagcucuauugcugcccggggcuacaucuccacccgcgugggaaugggcgaggcugccgccaucuuuaugaccgcuacacccccugggagcguggaagcguucccgcagucuaaugccgucauucaggaugaggaaagagacauccccgagcggagcuggaacuccggauaugaguggauuaccgauuuuccuggcaaaacaguuugguucgugcccucuaucaagagcgggaaugacauugcuaacugucuucgcaaaaauggaaagagagugauccagcugucccggaagaccuuugauacggaauaccagaagaccaagaacaacgacugggacuacgucgugaccacagauauuucugagaugggcgccaauuucagagccgaccgcguuaucgauccucggagaugccugaaacccgugauccucaaggacgggccggaacgcgucauucuggcuggcccuaugcccgugaccguugccagcgcggcucagcggagaggacgcaucggccggaaccacaauaaagagggggaucaguauauuuacaugggacagccccuuaacaaugacgaggaucaugcccacuggacggaagccaagaugcugcucgacaacaucaauaccccugagggcauuauccccgcucuguucgaaccugagagagaaaaguccgccgcgaucgauggggaguaucgccugagaggagaggcccggaaaacauuuguggaacucaugcgcagaggcgaccuuccggucuggcugagcuacaagguggcuucugagggguuccaauauuccgaucggcgcuggugcuuugacggcgaaagaaacaaucagguccuggaggaaaacauggauguggagauuuggaccaaagagggagaacggaagaaacucagaccccgcuggcuggacgcccggacauacagcgacccucuugcucugagagaguucaaggaauuugccgcuggccgccgguccguuucuggggaucucauccuggagauuggaaaacugccccagcaccucacccagagagcccaaaaugcgcuugacaaccuggugaugcugcauaauagcgaacagggcgggcgggccuaucgccacgcuauggaggagcucccugauacaaucgaaacccugaugcuucuggcccucauugcugugcugacgggaggcgucacacuguucuuucucuccggcagagggcuuggaaagaccucuaucggccugcuguguguuauggccagcuccgugcuccuguggauggccagcguggagccccauuggaucgcugcgucuauuauccuugaguucuuucugaugguccuccugauuccggagccugaccggcagcgcacaccccaggauaaccaacuggccuacgugguuaucgggcuccuuuucaugauucugacaguggcugccaaugagaugggacugcucgaaaccacaaagaaagaccugggcaucgggcacgucgccguggagaaccaccaucacgcugccaugcuugaugucgaccugcauccugcguccgccuggacgcucuacgcuguggccaccacaauuaucacccccaugaugagacacacaaucgaaaacaccacggcuaauauuagccugaccgccaucgcgaaccaggccgcuauucugaugggacucgauaagggcuggccuaucucuaaaauggacauuggcguuccccuucuggcccuggggugcuauucccaggugaauccgcucacacugaccgcugccguccuuaugcugguggcucauuacgccaucaucggaccuggccuccaagcgaaggccacacgggaggcucagaaacgcaccgccgcugggauuaugaagaaccccacgguugauggaaucguggccauugaccuggaucccgucguguaugacgccaaguuugaaaaacagcugggccagaucaugcuccuuauucuguguacaagccaaauccugcucaugagaaccacaugggcgcugugcgagucuaucacccuugcuaccgggccucugacaacgcucugggagggaagcccgggcaaguucuggaauaccacaauugccguguccauggcuaacaucuuucggggcucuuaccuggccggggccggacuggcuuucagccucaugaaaucccuuggcgggggacgcagaggcaccggggcccagggagaaacacugggcgagaaguggaaacggcagcugaaucagcucagcaaguccgaguucaacaccuauaagagaucuggcauuauggagguugaccgcagcgaagcgaaagaggggcugaagcggggagagacgacaaaacacgccgucuccagaggcaccgcuaaacuucgcugguuuguggaacggaaucuggugaaacccgaggggaaggucaucgaucucggauguggcagagggggauggucuuacuauugcgccggccugaagaaaguuaccgaagugaagggcuacacaaaagggggaccuggccacgaggaacccauuccuauggcuaccuacggguggaaccuggugaagcuccauagcggaaaagacgucuucuuuauucccccugagaagugugauacacuucugugcgacaucggcgaguccucuccgaaucccacgaucgaagaggggcgcacccugcgggugcucaaaaugguugaaccuuggcugagaggaaaccaauucuguaucaagauucuuaaucccuauaugccuagcguggucgagacacuggagcagaugcagcgcaagcacggcggcaugcucgugcggaacccccuguccagaaauagcacccaugaaauguacuggguuucuugcgggacaggaaacaucguguccgccgucaauaugaccagccgcaugcugcucaaccgguuuacgauggcgcacagaaaaccgaccuaugagcgcgauguggaccugggcgccgggacaagacacguggcugucgaaccugagguugccaaccuugauauuaucggacagcggauugaaaauaucaagcaugagcacaaaucuaccuggcauuacgacgaggauaaccccuauaagacaugggcuuaccacggcuccuaugaagugaaacccagcgggucugccuccagcauggugaauggagucgugaagcugcucaccaagccuugggacguuauccccauggugacacaaauugcuaugaccgauacgacaccuuucggccagcagcgcgucuuuaaagagaagguggacaccagaaccccgaaagccaagcggggcacagcgcaaaucauggaaguuacggccaaauggcuguggggguuccuuuccagaaacaagaagccccggauuuguacccgcgaggaauuuacaagaaaagugcggagcaaugcugccaucggagcugucuucguggacgagaaccaguggaacucugccaaggaggccguugaagaugagcgcuuuugggaccuggugcauagagaacgggagcuccacaaacagggcaagugcgcgaccugcgucuacaacaugauggggaaacgcgaaaagaagcugggagaguucggcaaagcuaaggggagcagagccauuugguacauguggcugggcgcccgguuucucgaguucgaagcucugggauucaugaaugaggaucacugguuuucccgcgaaaacucucuuagcggcguggagggggagggacugcauaaacucggcuauauccugagagacaucuccaagauuccugggggaaauauguacgccgaugacacagcuggcugggauacccggaucacagaagacgaucuucagaacgaggcccgcauuaccgacaucauggaacccgagcacgcgcugcucgccaaaucuauuuucaagcugacguaucaaaauaaagucgugagaguucagcggccugcuaagaacgggaccgugauggaugucaucagccgcagagaccagcggggcuccggacaggugggcacauacgggcugaauaccuuuacaaacauggaagcccaacucaucagacagauggagucugagggaauuuucagccccuccgaacuggagaccccgaaccuugcugaacgcgugcuggauuggcucgagaaguauggcguugaacggcugaaaagaauggccaucagcggggacgacuguguggucaagccuauugaugaccgcuuugcgacggcccuuacagcucugaaugauaugggaaaagugcggaaggacaucccccagugggagccuucuaaaggcuggaacgauuggcagcaaguucccuucugcucccaucacuuucaccagcucauuaugaaggacgggagagagaucguggucccuugucgcaaucaggaugaacuggugggccgggccagagucagccagggagcuggcuggucucugcgcgagaccgccugccucgggaaguccuacgcucaaauguggcagcugauguauuuccaucggagagaccuucgccuggccgcgaacgccauuuguagcgcugugcccguugauuggaucccgacaucccggaccacguggucuauccacgcccaucaccaguggaugaccacagaagacaugcucagcguguggaauagagucuggauugaggaaaacccuuggauggaggauaaaacccauaucuccagcuggggagacgugcccuaccugggcaagcgggaggaccaauggugcgggucucuuauuggacugacagccagagcuaccugggccacaaauauccagguugcgauuaaccaggugcgccggcucaucggcaaugaaaacuaccuggauuauaugaccuccaugaaaagauuuaagaaugagggggaccccgaaggcgcucugugguga

SEQ ID NO: 18821 - RNA, 9879 nt, Artificial Sequence
  derived and/or modified CDS sequence (opt5) from DENV-1__EU660402__SS-prME
uccgugaccaugcugcugaugcugaugcccacagcccuugcuuuccaccugacgaccagaggaggggaaccucauaugauugucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaucgacgcgccgugcaaaaucccuuuuagcacccaagaugaaaagggggugacacagaacggacggcugauuaccgcuaaucccaucgucacagacaaagagaagccugugaacauugaagccgagccgcccuucggcgagucuuauaucgugauuggggccggagaaaaagcucugaaacuuagcugguuuaagaaaggcuccucuaucgggaagauguucgaggccacggcuagaggcgcccgccggauggcgauccucggagauaccgccugggacuuuggcagcauugggggaguuuucacauccgucggcaaacuggugcaucagaucuuugggaccgcuuacggagugcuguucagcggcgucucuuggacaaugaagauugggaucggcgugcuccugaccuggcuuggacucaauuccagaagcacgucucucuccaugaccuguauugccguuggccuggugacacuguaccuuggggucauggugcaggcugauagcggaugcguuaucaacuggaaaggccgcgaacucaaguguggguccggaauuuuugugaccaaugagguccacacauggaccgaacaauauaaguuccaggccgacucuccuaaacggcugagcgcggccaucggcaaggcuugggaggagggggugugcggcaucagauccgccacacgccuggaaaacauuauguggaaacagaucucuaacgagcucaaucauauucugcuugaaaacgacaugaagcugaccguuguggucggagauguggcuggcauccucgcccaggggaaaaagaugauucggccgcaacccauggaguacaaauauagcuggaagaucuggggaaaggccaaaaucauuggcgcugacgugcagaauacgacauuuaucauugaugggccuaacacccccgaauguccugacgaucagagagcguggaauaucugggaggucgaggacuacggauucggcauuuuuaccacaaacaucuggcugaagcugcgcgauuccuauacccagguuugcgaccaccggcuuaugagcgccgcuaucaaagauucuaaggccgugcacgccgacaugggcuacuggauugaauccgagaaaaaugaaacguggaagcucgcuagagccagcuucaucgaggugaagacauguauuuggcccaaaucucauacccugugguccaacgggguccuggaaagcgagaugaucauuccgaagaucuauggaggcccuaucucucaacacaauuaccgccccggguacuucacacagaccgcgggaccuuggcaucucggcaaacuggagcuugauuuugaccugugcgaagggacaaccgugguuguggaugagcacugcggaaaccggggccccagccucagaacgaccacagucaccggcaagauuauccacgaaugguguugccgguccuguacacugccuccccugcgcuucaaaggggaggacggaugcugguauggcauggagauuagaccggugaaggaaaaggaggaaaaucuuguuaaaagcauggugucugcuggguccggagaggucgacagcuuuucccucggccugcuguguaucucuauuaugaucgaagaggugaugcggagcagauggucccgcaagaugcucaugaccgggacgcuggccguuuucuuucuucugauuaugggacagcucacauggaacgaucugauccggcugugcaucauggugggcgccaaugcuuacgacagaaugggcauggggaccacauaucuugcccugauggcgaccuucaaaaugcgcccuauguuugcugucggacuccuguucagacggcucaccucucgcgaggugcugcuucugacaauuggccucagccugguggccuccgucgaacugcccaacucucuugaggaacugggggauggacucgccaugggcaucaugauucugaagcuccugacggacuuucaaagccaucagcuuugggcuacccugcucucccugacauucaucagaaccacauuuagccugcacuacgccuggaaaaccauggcuaugguucuuucuauugugucccuguucccccucugucugagcacgacaucucagaagaccaccuggcucccugugcugcuugggucccugggaugcaagccgcugacaauguuucucaucgccgagaauaaaaucuggggccggaaauccuggccccugaacgaaggcauuauggcggucgggaucgugucuauucuucuguccagccuccugaaaaacgauguuccucucgccggaccccugaucgcuggcgggaugcuuauugccuguuaugugaucuccggaagcucugcugaccugagccuggagaaggccgccgaggucuccugggaagaggaagcugagcauucuggcgcgagccacaauauccucguggaaguucaggaugacgggaccaugaaaauuaaggaugaggagcgcgacgauacacugacgauccuucugaaagccacccuccuggcuguguccggagucuacccucucucuauucccgccacacuguucgugugguauuucuggcaaaagaagaaacagagaagcggcguccuuugggacaccccuagcccucccgaaguggagcgggccguucuggaugacggcaucuaccgcauuaugcagagagggcugcucggacggucucaggugggcgucgggguguuucaagaaaacguuuuccauacaauguggcacgugacccgcggagcuguccugauguaccagggcaagagacuugagcccagcugggccuccgugaaaaaggaccugaucagcuaugggggaggcuggcggcuccagggcucuuggaauacgggggaggaagugcagguuauugcggucgagcccggcaagaacccuaagaaugugcaaaccgcucccggcacauuuaagaccuccgaaggggaggugggagccaucgcccuggauuucaaaccgggcacaagcgggucuccuaucgucaacagagaaggaaagauugugggccucuacggcaaugggguugugaccacauccggaacguaugucagcgcuaucgcccaggcgaaggcuucccaggagggcccccugccugagauugaagacgagguguuucgcaagcggaaccuuaccaucauggaucugcaccccgggucuggaaaaacaagacgcuaccugcccgccauuguucgggaagccaucaagagacgccuccggacccugauccuugcuccuaccagaguggucgccagcgagauggcugaagcccugaagggcaugccgauucgcuaucaaacaacggcggugaaauccgagcauaccgggaaggagaucguugaccucaugugccacgccacauucaccaugcggcugcugagccccgugagagucccuaauuacaacaugauuaucauggaugaagcucauuuuacagaccccucuuccauugccgcucggggcuauaucagcacccgcgugggaaugggcgaggccgccgcuaucuucaugacggcgacaccucccgggucuguggaagccuuuccucagagcaaugcugucauucaggaugaggaaagagacaucccggagcgguccuggaacucuggauacgaguggauuaccgauuuccccggcaaaaccguuugguuugugccuagcaucaaguccgggaaugacauugccaacugucuccgcaaaaauggaaagagagugauccagcuuucucggaagacauucgauaccgaauaccagaagacaaagaacaacgacugggacuaugucgugaccacggauauuagcgagaugggcgccaauuucagagcugaccgcguuaucgauccccggagaugccugaaaccugugauccugaaggacgggcccgaacgcgucauucucgccggcccgaugccugugacaguugcguccgcugcccagcggagaggacgcaucggccggaaccacaauaaagagggggaucaguacauuuauaugggacagccccugaacaaugacgaggaucaugcccacuggaccgaagcuaagaugcuucuggacaacaucaauacacccgagggcauuaucccugcccucuuugaacccgagagagaaaagagcgcggccaucgauggggaguaccgccugagaggagaggcucggaaaaccuucguggaacugaugcgcagaggcgaccucccugucuggcuuucucacaagguggccuccgagggguuucaauauagcgaucggcgcuggugcuucgacggcgaaagaaacaaucagguccuggaggaaaacauggauguggagauuuggacgaaagagggagaacggaagaaacugagaccgcgcuggcucgacgcucggaccuacuccgacccccuggcccuuagagaguuuaaggaguucgcugccggccgccggucuguuagcggggaucugauccucgagauuggaaaacugccucagcaucugacacagagagcgcaaaaugcccucgacaaccuugugaugcugcacaauuccgaacagggcgggcgggcuuaucgccaugccauggaggagcugcccgauaccaucgaaacacucaugcugcuugcucugauugccgugcucaccggaggcgucaugcuguuuuuccugucuggcagagggcucggaaagacaagcaucggccuucuguguguuauggccuccagcgugcugcucuggauggcuucuguggagccucacuggaucgcggccuccauuauccuggaauuuuuccuuaugguccugcucauucccgagccggaccggcagcgcaccccucaggauaaccaacuggcuuacgugguuaucgggcugcucuuuaugauucuuacgguggccgccaaugagaugggacugcuggaaacaaccaagaaagaccucggcaucgggcacgucgcuguggagaaccaucaccaugccgcgaugcuggaugucgaccuucaccccgccagcgcuuggacccuguacgccguggcuacaaccauuaucacaccuaugaugagacauacgaucgaaaacaccacagccaauauuucucucaccgcgaucgccaaccaggcugccauucugaugggacuggauaagggcuggcccaucuccaaaauggacauuggcguuccucuccuugcucuggggugcuauagccaggugaauccccugacacucaccgccgcuguccugaugcuuguggcccacuacgcgaucaucggaccgggccugcaagccaaggcuacgcgggaggcccagaaacgcaccgcugccgggauuaugaagaacccuacaguugauggaaucguggccauugaccucgaucccgucguguaugacgcgaaguucgaaaaacagcugggccagaucaugcugcucauucuuuguaccucucaaauccugcugaugagaacaaccugggcucucugcgagagcaucacgcuggccacagggccccuuaccacacugugggagggauccccuggcaaguuuuggaauaccaccauugcugugucuauggccaacaucuuccggggcagcuaccucgccggggcuggacuggccuucucccugaugaaaagccucggcgggggacgcagaggcacaggggcgcagggagaaacgcuuggcgagaaguggaaacggcagcugaaucagcuguccaagucugaauuuaacaccuauaagagaagcggcauuauggagguugaccgcuccgaagccaaagaggggcucaagcggggagagacaaccaaacacgcugucucuagaggcacagccaagcugcgcugguucguggaacggaaucuugugaaaccggaggggaaggucaucgaucugggauguggcagagggggauggagcuacuauugcgcuggccucaagaaaguuaccgaagugaagggcuacacgaaagggggacccggccaugaggaaccuauucccauggccacauacggguggaaccuggugaagcugcacuccggaaaagacgucuuuuucaucccucccgagaagugugauacccuccuuugcgacauuggcgagucuagcccuaauccgaccaucgaagaggggcgcacacugcgggugcugaaaaugguugaacccuggcucagaggaaaccaauuuuguaucaagauucugaauccuuauaugcccuccguggucgagacccuugagcagaugcagcgcaagcauggcggcaugcuggugcggaacccucucagcagaaauucuacacacgaaauguacuggguuuccugcgggacgggaaacaucgugagcgcggucaauaugaccucucgcaugcugcugaaccgguucacaauggcccacagaaaacccaccuaugagcgcgauguggaccucggcgcugggacaagacauguggccgucgaaccggagguugcuaaccuggauauuaucggacagcggauugaaaauaucaagcacgagcauaaauccaccuggcacuacgacgaggauaacccuuauaagacgugggccuaccauggcagcuaugaagugaaacccucuggguccgcuagcuccauggugaauggagucgugaaacuucugaccaagcccugggacguuaucccuauggugacacaaauugccaugaccgauacaacccccuuuggccagcagcgcgucuucaaagagaagguggacacaagaaccccuaaagcgaagcggggcacggcccaaaucauggaaguuacagcuaaauggcucuggggguuucugagcagaaacaagaagccgcggauuuguacccgcgaggaguucaccagaaaagugcggucuaaugccgcuaucggagccgucuuuguggacgagaaccaguggaauagcgccaaggaggcgguugaagaugagcgcuucugggaccuugugcacagagaacgggagcugcacaaacagggcaagugcgcuacaugcgucuacaacaugauggggaaacgcgaaaagaagcucggagaguuuggcaaagccaagggguccagagccauuugguacauguggcugggcgcucgguuccuggaguucgaagcccucggauuuaugaaugaggaucauugguucucucgcgaaaacagccuguccggcguggagggggagggacuucacaaacugggcuauauccucagagacaucucuaagauucccgggggaaauauguacgcugaugacacggccggcugggauacccggaucacagaagacgaucugcagaacgaggcgaaaauuaccgacaucauggaaccugagcaugcccuucuggcuaagagcauuuuuaaacucacauaucaaaauaaggucgugcgcguucagagacccgccaagaacgggaccgugauggaugucaucucccggcgcgaccagagaggcucuggacaggugggcacauacgggcugaauaccuucacgaacauggaagcucaacugauccggcagauggagagcgagggaaucuuuuccccuagcgaacucgagacccccaaccuggccggcagagugcuugauuggcuggaaaaacacgggguugagcgccucaagcggauggcgaucucuggagacgacuguguggucaaaccgauugaugacagauucgccacagcucugaccgcccuuaaugauaugggcaaggugcgcaaagacaucccucagugggaacccuccaagggguggaacgauuggcagcaaguuccuuuuugcagccaccauuuccaccagcugauuaugaaggacggccgggagaucgugguccccuguagaaaucaggaugagcucgugggacgcgcucgggucucucagggcgccggguggucccugagagaaacagcuugccugggaaaaagcuaugcccaaauguggcagcucauguacuuucaucgccgggaccugagacuugcggccaacgcuauuuguuccgccgugccuguugauugggugcccaccucucgcacgacauggagcauccacgcccaucaccaguggaugaccacagaggacaugcuguccgucuggaaucggguguggaucgaagagaacccguggauggaagauaagacccacguuagcucuuggggcgacgugccuuaucucgggaaaagagaggaccaauggugcggaucccugauuggccuuacggcucgggccaccugggcgacaaauauccaggucgcuauuaaccaggugagacgccugcucgggaaugagaacuaccuggauuacaugaccagcaugaagcgguucaaaaaugaaucugaccccgagggcgcccugugguga

SEQ ID NO: 18822 - RNA, 9879 nt, Artificial Sequence
  derived and/or modified CDS sequence (opt5) from DENV-1__EU660403__SS-prME
uccgugaccaugcugcucaugcugaugcccacagcccuugcuuuccaccugacgaccagaggcggggaaccucauaugaucguguccaagcaggaacggggaaaaucucuccuguuuaagacaagcgccggcguuaauaugugcacccuuauugcgauggaccugggggagcucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuuccugacacaagaugaaaagggggugacgcagaacggacggcuuaucaccgcgaaucccauugucacagacaaagagaagccugugaacaucgaagcugagccgcccuuuggcgaguccuauauuaucauuggggccggagaaaaagcccucaagcugagcugguucaagaaaggcucuagcaucgggaagauguuugaggcuaccgccagaggcgcucgccggauggccauccugggagauacagcgugggacuucggcuccauugggggaguguuuaccucuguuggcaaacucguccaucagaucuucgggacggccuacggagugcuguuuagcggcguguccuggaccaugaagauugggaucggcguccuucugacauggcucggacugaauagcagaucuaccucccugagcaugacauguauugcugugggccuuguuacccucuaccugggggugaugguccaggccgauucuggaugcgugaucaacuggaaaggccgcgaacugaaguguggguccggaauuuucguuacaaaugaggugcacaccuggacggaacaauauaaguuucaggcugacagcccuaaacggcucuccgccgcgaucggcaaggccugggaggagggggucugcggcaucagaucugcuacacgccuggaaaacauuauguggaaacagaucagcaacgagcuuaaucauauucugcucgaaaacgacaugaaguucaccgugguugugggagaugucgccggcauccuggcucaggggaaaaagaugauucggccgcaacccauggaguacaaauauuccuggaagucuuggggaaaggccaaaaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaaacuucgcgauagcuauacccaggucugcgaccaccggcucauguccgcggccaucaaagauagcaaggcuguucacgccgacaugggcuacuggaucgaaucugagaaaaaugaaacauggaagcuggccagagcuuccuucauugaggugaagaccuguaucuggcccaaaagccauacacuguggucuaacggggugcucgaauccgagaugauuaucccgaagauuuauggaggcccuaucagccaacacaauuaccgccccggguacuucacccagacggccggaccuuggcaucugggcaaacuugagcuggauuuugaccucugcgaagggaccacagucgugguugaugagcacugcggaaaccggggccccucucugagaaccacaaccgugacgggcaagaucauucacgaaugguguugccggagcuguacacugccuccccuucgcuucagaggggaggacggaugcugguauggcauggagauccggccggucaaagaaaaggaggaaaaucucgugaaguccaugguuagcgcggggucuggagagguggacuccuuuagccugggccugcucuguauuuccaucauuaucgaagaggucaugagaucucgcuggagccggaaaaugcugaugaccgggacacuugcuguguucuuucugcucauuaugggacagcugaccuggaacgaucugaucagacuuugcaucaugguuggcgccaaugccuccgaccgcaugggcauggggaccacauaccuggcucucauggccacguucaagaugagaccuauguuugcggugggacuccuguuccggcgccugaccucuagagagguccuucugcucacaauuggccugagccugguggcuuccguggaacuucccaacucucuggaggaacucggggauggacuggccaugggcaucaugauucucaaacugcuuaccgacuuucaaagccaucagcugugggccacacuccugucccugaccuucaucaagacgacauuuagccuucacuaugcuuggaaaaccauggccaugguccugucuauuguuucccucuucccccugugucucagcaccacaucucagaagaccacauggcugccugugcuucuggggucccugggaugcaagccgcucacgauguuucugaucgcugagaauaaaaucuggggccggcgcagcuggccccuuaacgaaggcauuauggccguggggaucgucucuauucugcucuccagccugcucaagaacgaugugccucuggcgggaccccuuaucgccggcgggaugcugauugcuuguuacguuaucuccggaagcucugccgaccugagccucgagaaagcugccgagguguccugggaagaggaagccgagcauucuggcgcuagccacaauauccuggucgaagugcaggaugacgggaccaugaagauuaaagaugaggagagagacgauacacuuaccauccugcucaaggcgacacugcucgccguuuccggaguguauccucugucuauucccgcuacccuuuucgucugguacuucuggcagaagaagaagcagcggagcggcgugcugugggacacgccuagcccucccgaagucgagcgcgccgugcuggaugacggcaucuauagaauuaugcagcgggggcuccugggacgcucucagguuggcgugggggucuuucaagaaaacguguuccauaccauguggcacguuacaagaggagccgugcuuauguaccagggcaaacggcuggagcccagcugggcuuccgucaagaaagaccucaucagcuacgggggaggcuggagacugcagggcucuuggaauaccggggaggaaguccaggugauugccguugagcccggaaagaacccuaaaaauguccaaacagcgcccggcaccuuuaagacaccggaaggggaggugggagcuaucgcccucgauuucaagccuggcacguccgggagccccaucgugaaccgcgaaggaaaaauugucggccuguauggcaauggggugguuaccacaucuggaaccuacguguccgccaucgcucaggccaaggcgagccaggagggcccucuucccgagauugaagacgaggucuuucggaaaagaaaccugaccaucauggaucugcaccccggguccggaaagacacgccgguaucucccugcuauugugagagaagccaucaaacgcaagcugcggacgcuuauccuggccccgaccagaguuguggcuucugagauggccgaagcucucaagggcaugcccauucgcuaccaaacaaccgccgucaaaagcgagcauacagggaaggagaucguggaccugaugugccacgcgaccuucacgaugcggcugcucuccccuguuagagugcccaauuauaacaugauuaucauggaugaagcccauuuuacagacccuagcucuauugcugcccggggcuacaucuccacccgcgucggaaugggcgaggcugccgccaucuucaugaccgcuacacccccugggagcguggaagcguuuccgcagucuaaugccgugauucaggaugaggaaagagacauccccgagcggagcuggaacuccggauaugaguggauuaccgauuucccuggcaaaacagucugguuuguucccucuaucaagagcgggaaugacauugcuaacugucuucgcaaaaauggaaagagagugauccagcugucccggaagaccuucgauacggaauaccagaagaccaagaacaacgacugggacuacguggucaccacagauauuucugagaugggcgccaauuucagagccgaccgcgugaucgauccucggagaugccugaaacccguuauccucaaggacgggccggaacgcgugauucuggcuggcccuaugcccgucaccguggccagcgcggcucagcggagaggacgcaucggccggaaccacaauaaagagggggaucaguauauuuacaugggacagccccuuaacaaugacgaggaucaugcccacuggacggaagccaagaugcugcucgacaacaucaauaccccugagggcauuauccccgcucuguuugaaccugagagagaaaaguccgccgcgaucgauggggaguaucgccugagaggagaggcccggaaaacauucguugaacucaugcgcagaggcgaccuuccgguguggcugagcuacaaggucgcuucugagggguuucaauauuccgaucggcgcuggugcuucgacggcgaaagaaacaaucaggugcuggaggaaaacauggaugucgagauuuggaccaaagagggagaacggaagaaacucagaccccgcuggcuggacgcccggacauacagcgacccucuugcucugagagaguuuaaggaguucgccgcuggccgccgguccgugucuggggaucucauccuggagauuggaaaacugccccagcaccucacccagagagcccaaaaugcgcuugacaaccugguuaugcugcauaauagcgaacagggcgggcgggccuaucgccacgcuauggaggagcucccugauacaaucgaaacccugaugcuucuggcccucauugcugugcugacgggaggcgugacacuguuuuuccucuccggcagagggcuuggaaagaccucuaucggccugcugugugucauggccagcuccguucuccuguggauggccagcguggagccccauuggaucgcugcgucuauuauccuugaauuuuuccugauggugcuccugauuccggagccugaccggcagcgcacaccccaggauaaccaacuggccuacgucgugaucgggcuccuuuuuaugauucugacaguugcugccaaugagaugggacugcucgaaaccacaaagaaagaccugggcaucgggcacguggccgucgagaaccaccaucacgcugccaugcuugauguggaccugcauccugcguccgccuggacgcucuacgcugucgccaccacaauuaucacccccaugaugagacacacaaucgaaaacaccacggcuaauauuagccugaccgccaucgcgaaccaggccgcuauucugaugggacucgauaagggcuggccuaucucuaaaauggacauuggcgugccccuucuggcccuggggugcuauucccagguuaauccgcucacacugaccgcugccgugcuuaugcuggucgcucauuacgccaucaucggaccuggccuccaagcgaaggccacacgggaggcucagaaacgcaccgccgcugggauuaugaagaaccccacgguggauggaaucguugccauugaccuggaucccguggucuaugacgccaaguucgaaaaacagcugggccagaucaugcuccuuauucuguguacaagccaaauccugcucaugagaaccacaugggcgcugugcgagucuaucacccuugcuaccgggccucugacaacgcucugggagggaagcccgggcaaguuuuggaauaccacaauugccguguccauggcuaacaucuuccggggcucuuaccuggccggggccggacuggcuuucagccucaugaaaucccuuggcgggggacgcagaggcaccggggcccagggagaaacacugggcgagaaguggaaacggcagcugaaucagcucagcaaguccgaauuuaacaccuauaagagaucuggcauuauggagguggaccgcagcgaagcgaaagaggggcugaagcggggagagacgacaaaacacgccguuuccagaggcaccgcuaaacuucgcugguucgucgaacggaaucuggugaaacccgaggggaaggugaucgaucucggauguggcagagggggauggucuuacuauugcgccggccugaagaaagucaccgaaguuaagggcuacacaaaagggggaccuggccacgaggaacccauuccuauggcuaccuacggguggaaccuggugaagcuccauagcggaaaagacguguuuuucauucccccugagaagugugauacacuucugugcgacaucggcgaguccucuccgaaucccacgaucgaagaggggcgcacccugcggguccucaaaaugguggaaccuuggcugagaggaaaccaauuuuguaucaagauucuuaaucccuauaugccuagcguuguggagacacuggagcagaugcagcgcaagcacggcggcaugcucguccggaacccccuguccagaaauagcacccaugaaauguacugggugucuugcgggacaggaaacaucguuuccgccgugaauaugaccagccgcaugcugcucaaccgguucacgauggcgcacagaaaaccgaccuaugagcgcgaugucgaccugggcgccgggacaagacacguggcuguggaaccugaggucgccaaccuugauauuaucggacagcggauugaaaauaucaagcaugagcacaaaucuaccuggcauuacgacgaggauaaccccuauaagacaugggcuuaccacggcuccuaugaaguuaaacccagcgggucugccuccagcauggugaauggaguggucaagcugcucaccaagccuugggacgugauccccaugguuacacaaauugcuaugaccgauacgacaccuuuuggccagcagcgcguguucaaagagaaggucgacaccagaaccccgaaagccaagcggggcacagcgcaaaucauggaagugacggccaaauggcuguggggguuucuuuccagaaacaagaagccccggauuuguacccgcgaggaguucacaagaaaaguucggagcaaugcugccaucggagcuguguuugucgacgagaaccaguggaacucugccaaggaggccguggaagaugagcgcuucugggaccugguucauagagaacgggagcuccacaaacagggcaagugcgcgaccugcguguacaacaugauggggaaacgcgaaaagaagcugggagaguuuggcaaagcuaaggggagcagagccauuugguacauguggcugggcgcccgguuccucgaguucgaagcucugggauuuaugaaugaggaucacugguucucccgcgaaaacucucuuagcggcgucgagggggagggacugcauaaacucggcuauauccugagagacaucuccaagauuccugggggaaauauguacgccgaugacacagcuggcugggauacccggaucacagaagacgaucuucagaacgaggcccgcauuaccgacaucauggaacccgagcacgcgcugcucgccaaaucuauuuuuaagcugacguaucaaaauaaaguggucagagugcagcggccugcuaagaacgggaccguuauggaugugaucagccgcagagaccagcggggcuccggacaggucggcacauacgggcugaauaccuucacaaacauggaagcccaacucaucagacagauggagucugagggaauuuuuagccccuccgaacuggagaccccgaaccuugcugaacgcgugcuggauuggcucgagaaguauggcguggaacggcugaaaagaauggccaucagcggggacgacuguguugugaagccuauugaugaccgcuucgcgacggcccuuacagcucugaaugauaugggaaaaguccggaaggacaucccccagugggagccuucuaaaggcuggaacgauuggcagcaagugcccuuuugcucccaucacuuccaccagcucauuaugaaggacgggagagagaucguugugccuugucgcaaucaggaugaacuggucggccgggccagagugagccagggagcuggcuggucucugcgcgagaccgccugccucgggaaguccuacgcucaaauguggcagcugauguauuuucaucggagagaccuucgccuggccgcgaacgccauuuguagcgcuguccccguggauuggaucccgacaucccggaccacguggucuauccacgcccaucaccaguggaugaccacagaagacaugcucagcguuuggaauagaguguggauugaggaaaacccuuggauggaggauaaaacccauaucuccagcuggggagacguccccuaccugggcaagcgggaggaccaauggugcgggucucuuauuggacugacagccagagcuaccugggccacaaauauccagguggcgauuaaccagguucgccggcucaucggcaaugaaaacuaccuggauuauaugaccuccaugaaaagauucaagaaugagggggaccccgaaggcgcucugugguga

SEQ ID NO: 18823 - RNA, 9879 nt, Artificial Sequence
  derived and/or modified CDS sequence (opt5) from DENV-1__EU660397__SS-prME
agcgugaccaugcugcucaugcugaugcccaccgcccuugcuuuccaccugacgaccagaggaggggaaccucauaugaucgucuccaagcaggaacggggaaaaucucuccuguuuaagacaagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugcgggggaugagcuaugugauguguaccggcucuuucaagcucgagaaagaagucgcugagacccagcacggaacagugcugguucagauuaaguacgagggcaccgacgccccgugcaagaucccuuucuccacacaagaugaaaaaggggugacgcagaacggaagacugaucaccgcgaaucccauugucacagacaaggagaaaccugugaacaucgaagcugagccgcccuuuggcgagagcuauauugugaucggggccggagaaaaggcccuuaaacucucuugguucaagaagggcagcuccauugggaaaauguuugaggcuaccgcccgcggcgcucggagaauggccauccugggagauacagcgugggacuucggcucuaucgggggaguuuuuaccagcgucggcaagcuggugcaucagauuuucgggacggccuacggagugcucuuuuccggcgucagcuggaccaugaaaaucgggauuggcgugcugcuuacauggcugggacucaauucucgcuccaccagccugucuaugacauguaucgcuguuggccuggugacccuuuaccucggggucauggugcaggccgauuccggaugcguuauuaacuggaagggccgggaacugaaaugugggagcggaaucuucgugacaaaugagguccacaccuggacggaacaauauaaguuucaggcugacuccccuaagagacugucugccgcgauuggcaaagccugggaggagggggugugcggcauccgcagcgcuacacggcucgaaaacaucauguggaagcagauuuccaacgagcugaaucauauccuucuggaaaacgacaugaaauucaccguuguggucggagauguggccggcauucucgcucaggggaagaaaaugaucagaccgcaacccauggaguacaaguauucuuggaaaagcuggggaaaggccaagauuaucggcgccgacgugcagaauaccacauuuaucauugaugggccuaacacccccgaauguccugacgaucagcgcgcuuggaauaucugggaggucgaggacuacggauucggcauuuuuacgacaaacaucuggcugaaacugcgggauuccuauacccagguuugcgaccacagacuuaugagcgcggccauuaaggauucuaaagcugugcacgccgacaugggcuacuggaucgaauccgagaagaaugaaacauggaaacucgcccgcgcuagcuucaucgaggugaagaccuguauuuggcccaagucucauacacugugguccaacgggguccuggaaagcgagaugaucauuccgaaaaucuauggaggcccuauuucucaacacaauuaccggcccggguacuucacccagacggccggaccuuggcaucucggcaagcuggagcuugauuuugaccugugcgaagggaccacagugguuguggaugagcacugcggaaacagaggccccagccuccggaccacaaccgucacgggcaaaaucauccacgaaugguguugccgcuccuguacacugccuccccugagauucagaggggaagacggaugcugguauggcauggagauucggccggugaaggaaaaagaggaaaaucuuguuaagagcauggugucugcgggguccggagaggucgacagcuuuucccucggccugcuguguaucucuauuaugaucgaagaggugaugcgcagccggugguccagaaagaugcucaugaccgggacacuggcuguuuucuuucuucugauuaugggacagcucaccuggaacgaucugauccgccugugcauuauggugggcgccaaugccucugacagaaugggcauggggaccacauaccuugcucugauggccacguucaaaaugcggccuauguuugcggucggacuccuguuccgcagacucaccagccgggaggugcugcuucugacaaucggccucucccugguggcuucugucgaacugcccaacagccuugaggaacugggggauggacucgccaugggcaucaugauucugaagcuccugaccgacuuucaaucccaucagcuuugggccacacugcucagccugaccuucaucaaaacgacauuuucucugcacuaugcuuggaagaccauggccaugguucuuuccauugugagccuguucccccucugucugucuaccacaucccagaaaaccacauggcucccugugcugcuugggagccugggaugcaagccgcugacgauguuucucaucgcugagaauaagauuuggggccgcagaucuuggccccugaacgaaggcaucauggccgucgggaucguguccauucuucugagcucccuccugaaaaacgauguuccucucgcgggaccccugaucgccggcgggaugcuuauugcuuguuacgugaucagcggaucuagcgccgaccugucccuggagaaggcugccgaggucucuugggaagaggaagccgagcauagcggcgcuucccacaauauucucguggaaguucaggaugacgggaccaugaaaaucaaggaugaggagcgggacgauacacugaccauccuucugaaagcgacacuccuggccgugucuggagucuauccucucagcauucccgcuacccuguucgugugguacuucuggcaaaagaaaaagcagcgcuccggcguccuuugggacacgccuucucccccggaaguggagagagccguucuggaugacggcaucuaucggauuaugcagcgcgggcugcucggaagaagccaggugggcgucgggguguuucaagaaaacguuuuccauaccauguggcacgugacacggggagccguccugauguaccagggcaagagacuugagccuuccugggcuagcgugaaaaaggaccugaucucuuacgggggaggcuggcgccuccagggcuccuggaauaccggggaggaagugcagguuauugccgucgagcccggcaagaacccuaagaaugugcaaacagcgcccggcaccuuuaaaacaccggaaggggaggugggagcuaucgcccuggauuucaagccuggcacgagcgggucucccauugucaaccgggaaggaaagaucgugggccucuauggcaaugggguugugaccacauccggaaccuacgucagcgccaucgcucaggccaaagcgucccaggagggcccucugcccgagauugaagacgagguguuuagaaagcgcaaccuuaccaucauggaucugcaccccgggucuggaaaaacacggagauaucugccugcuauuguucgcgaagccaucaagcggaaacucagaacgcugauucuugccccgacccgcguggucgcuagcgagauggccgaagcucugaagggcaugcccauccgguaccaaacaaccgccgugaaguccgagcauacagggaaagagaucguugaccucaugugccacgcgaccuucacgaugagacugcugagcccugugcggguccccaauuauaacaugauuaucauggaugaagcccauuuuacagacccuucuuccauugcugcccgcggcuacaucagcaccagagugggaaugggcgaggcugccgccauuuucaugaccgcuacacccccugggucuguggaagcguuuccgcagagcaaugccgucauccaggaugaggaacgggacauccccgagcgcuccuggaacucuggauaugaguggauuaccgauuucccuggcaagacaguuugguuugugcccagcaucaaauccgggaaugacauugcuaacugucucagaaagaauggaaaacgggugauccagcuuucuagaaagaccuucgauacggaauaccaaaagaccaagaacaacgacugggacuacgucgugaccacagauauuagcgagaugggcgccaauuuccgcgccgaccggguuaucgauccuagacgcugccugaagcccgugauucugaaagacgggccggaacgggucauccucgcuggcccuaugcccgugaccguugccuccgcggcucagagacgcggacggaucggcagaaaccacaauaaggagggggaucaguauauuuacaugggacagccccugaacaaugacgaggaucaugcccacuggacggaagccaaaaugcuucuggacaacaucaauaccccugagggcauuauccccgcucucuuugaaccugagcgcgaaaagagcgccgcgauugauggggaguauagacugcggggagaggcccgcaagacauucguggaacugaugagacggggcgaccucccggucuggcuuucuuacaaaguggcuuccgagggguuucaauauagcgaucgcagauggugcuucgacggcgaacggaacaaucagguccuggaggaaaacauggauguggagaucuggaccaaggagggagaacgcaaaaagcugcgcccccgguggcucgacgccagaacauacuccgacccucuggcucuuagagaguuuaaagaguucgccgcuggccggagaucuguuagcggggaucugauccucgagauuggaaagcugccccagcaccugacccagcgggcccaaaaugcgcucgacaaccuugugaugcugcauaauuccgaacagggcgggcgcgccuauagacacgcuauggaggagcugccugauacaaucgaaacccucaugcugcuugcccugauugcugugcucacgggaggcgucacacuguuuuuccugucuggccgggggcucggaaaaaccagcaucggccuucuguguguuauggccuccagcgugcugcucuggauggccucuguggagccccauuggauugcugcguccaucauccuggaauuuuuccuuaugguccugcucauuccggagccugaccgccagagaacaccccaggauaaccaacuggccuacgugguuaucgggcugcucuuuaugauucuuacaguggcugccaaugagaugggacugcuggaaaccacaaagaaggaccucggcaucgggcacgucgccguggagaaccaccaucacgcugccaugcuggaugucgaccuucauccugcgagcgccuggacgcuguacgcuguggccaccacaauuaucacccccaugaugcggcacacaauugaaaacaccacggcuaauaucucucucaccgccaucgcgaaccaggccgcuauucugaugggacuggauaaaggcuggccuaucuccaagauggacauuggcguuccccuccuugcccuggggugcuauagccaggugaauccgcugacacucaccgcugccguccugaugcuuguggcucauuacgccaucauuggaccuggccugcaagcgaaagccacacgcgaggcucagaagagaaccgccgcugggaucaugaaaaaccccacgguugauggaaucguggccauugaccucgaucccgucguguaugacgccaaguucgaaaagcagcugggccagaucaugcugcucauucuuuguacaucucaaauccugcugaugcggaccacaugggcgcucugcgagagcauuacccuggcuaccgggccucuuacaacgcugugggagggauccccgggcaaauuuuggaauaccacaaucgccgugucuauggcuaacaucuuccgcggcagcuaccucgccggggccggacuggcuuucucccugaugaaaagccucggcgggggaagacggggcaccggggcccagggagaaacacuuggcgagaaauggaagagacagcugaaucagcuguccaaaucugaauuuaacaccuauaagcgcagcggcauuauggagguugaccgguccgaagcgaaggaggggcucaaaagaggagagacgacaaagcacgccgucucucgcggcaccgcuaaacugcggugguucguggaaagaaaucuugugaagcccgaggggaaagucaucgaucugggauguggccgcgggggauggagcuacuauugcgccggccucaagaagguuaccgaagugaaaggcuacacaaaaggcgggccugggcacgaggaacccauuccuauggcuaccuacggguggaaccuggugaaacugcauuccggaaaggacgucuuuuucauucccccugagaaaugugauacacuccuuugcgacauuggcgagucuagcccgaaucccacgaucgaagaggggcggacccugagagugcugaagaugguugaaccuuggcuccgcggaaaccaauuuuguauuaaaauccugaaucccuauaugccuuccguggucgagacacuugagcagaugcagcggaagcacggcggcaugcuggugagaaacccccucagccgcaauucuacccaugaaauguacuggguuuccugcgggacaggaaacaucgugagcgccgucaauaugaccucucggaugcugcugaacagauucacgauggcgcaccgcaagccgaccuaugagagagauguggaccucggcgccgggacacggcacguggcugucgaaccugagguugccaaccuggauauuaucggacagcgcauugaaaauaucaaacaugagcacaaguccaccuggcauuacgacgaggauaaccccuauaaaacaugggcuuaccacggcagcuaugaagugaagcccucuggguccgccagcuccauggugaauggagucgugaaacuucugaccaagccuugggacguuauucccauggugacacaaaucgcuaugaccgauacgacaccuuuuggccagcagagagucuucaaggagaaaguggacacccggaccccgaaggccaaaagaggcacagcgcaaaucauggaaguuacggccaaguggcucuggggguuucugagccggaacaaaaagccccgcauuuguaccagagaggaguucacacggaaggugcgcucuaaugcugccaucggagcugucuuuguggacgagaaccaguggaauagcgccaaagaggccguugaagaugagagauucugggaccuugugcaucgggaacgcgagcugcacaagcagggcaaaugcgcgaccugcgucuacaacaugauggggaagagagagaaaaagcucggagaguuuggcaaggcuaaagggucccgggccauuugguacauguggcugggcgcccgcuuccuggaguucgaagcucucggauuuaugaaugaggaucacugguucucuagagaaaacagccuguccggcguggagggggagggacuucauaagcugggcuauauccuccgggacauuucuaaaaucccugggggaaauauguacgccgaugacacagcuggcugggauacccgcaucacagaagacgaucugcagaacgaggccagaauuaccgacaucauggaacccgagcacgcgcuucuggccaagagcauuuuuaaacucacguaucaaaauaaggucgugcggguucagcgcccugcuaaaaacgggaccgugauggaugucaucuccagacgggaccagagaggcucuggacaggugggcacauacgggcugaauaccuucacaaacauggaagcccaacugauucgccagauggagagcgagggaaucuuuucccccagcgaacucgagaccccgaaccuggcugaacgggugcuugauuggcuggagaaguauggcguugaaagacucaagcgcauggccaucucuggggacgacuguguggucaaaccuauugaugaccgguucgcgacggcccugacagcucuuaaugauaugggaaaggugagaaaagacaucccccagugggagccuuccaagggcuggaacgauuggcagcaaguucccuuuugcagccaucacuuccaccagcugauuaugaaagacgggcgcgagaucguggucccuugucggaaucaggaugaacucgugggcagagcccgcgucucucagggagcuggcuggucccugcgggagaccgccugccugggaaagagcuacgcucaaauguggcagcucauguauuuucauagacgcgaccugcggcuugccgcgaacgccauuuguuccgcugugcccguugauuggaucccgacaucuagaaccacguggagcauucacgcccaucaccaguggaugaccacagaagacaugcuguccguguggaaucgggucuggaucgaggaaaacccuuggauggaggauaagacccauaucagcucuuggggagacgugcccuaccucggcaaaagagaggaccaauggugcgggucccugauuggacuuacagcccgcgcuaccugggccacaaauauccagguugcgauuaaccaggugcggagacugaucggcaaugaaaacuaccucgauuauaugaccagcaugaagcgcuucaaaaaugagucugaccccgaaggggcucugugguga

SEQ ID NO: 18824 - RNA, 9879 nt, Artificial Sequence
  derived and/or modified CDS sequence (opt5) from DENV-1__EU687247__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagagcaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguuccccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgccaggaccuucuggugacauuuaaaaccgcgcacgccaagaagcaggaagucgugguucucggaucccaagagggcgcuaugcacaccgcccugacaggggccacggaaauucagaccagcggaacaaccacaaucuucgcuggccaucugaaaugcagacucaagauggauaaacugacccuuaaggggaugucuuaugugauguguacgggcuccuucaaacuggagaaggaagucgccgagacacagcacggaaccgugcucguucagauuaaguacgagggcaccgacgcgccgugcaaaaucccuuuuagcacacaagaugaaaagggggugacccagaacggacggcugaucacagcuaaucccauugucacggacaaagagaagccugugaacaucgaagccgagccccccuucggcgagucuuauauugugaucggggccggagaaaaagcucugaagcuuagcugguuuaagaaaggcuccucuauugggaagauguucgaggccaccgcuagaggcgcccgccggauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacugaauuccagaagcaccucucucuccaugacauguaucgccguuggccuggugacccuguaccuuggggucauggugcaggcugauagcggaugcguuauuaacuggaaaggccgcgaacucaaguguggguccggaaucuuugugacaaaugagguccacaccuggacagaacaauauaaguuccaggccgacucuccuaaacggcugagcgcggccauuggcaaggcuugggaggagggggugugcggcaucagauccgccacccgccuggaaaacaucauguggaaacagauuucuaacgagcucaaucauauccugcuugaaaacgacaugaagcugacgguuguggucggagauguggcuggcauucucgcccaggggaaaaagaugauccggccgcaacccauggaguacaaauauagcuggaagauuuggggaaaggccaaaaucaucggcgcugacgugcagaauacaaccuuuauuaucgaugggccuaacacccccgaauguccugacgaucagagagcguggaauauuugggaggucgaggacuacggauucggcaucuuuacaaccaacauuuggcugaagcugcgcgauuccuauacgcagguuugcgaccaccggcuuaugagcgccgcuaucaaagauucuaaggccgugcacgccgacaugggcuacuggaucgaauccgagaaaaaugaaacauggaagcucgcuagagccagcuucauugaggugaagaccuguaucuggcccaaaucucauacacugugguccaacgggguccuggaaagcgagaugauuaucccgaagauuuauggaggcccuaucucucaacacaauuaccgccccggguacuucacccagacagcgggaccuuggcaucucggcaaacuggagcuugauuuugaccugugcgaagggaccacggugguuguggaugagcacugcggaaaccggggccccagccucagaaccacaaccgucacaggcaagaucauucacgaaugguguugccgguccuguacccugccuccccugcgcuucaaaggggaggacggaugcugguauggcauggagaucagaccggugaaggaaaaggaggaaaaucuuguuaaaagcauggugucugcuggguccggagaggucgacagcuuuucccucggccugcuguguauuucuaucaugauugaagaggugaugcggagcagauggucccgcaagaugcucaugacggggacacuggccguuuucuuucuucugaucaugggacagcucaccuggaacgaucugauucggcugugcaucauggugggcgccaaugcuucugacagaaugggcauggggacaaccuaccuugcccugauggcgaccuucaaaaugcgcccuauguuugcugucggacuccuguucagacggcucacaagccgcgaggugcugcuucugacgaucggccucucccugguggccucugucgaacugcccaacagccuugaggaacugggggauggacucgccaugggcauuaugauccugaagcuccugaccgacuuucaaucccaucagcuuugggcuacacugcucagccugaccuucauuagaacaaccuuuucucugcacuaugccuggaaaacgauggcuaugguucuuuccaucgugagccuguucccccucugucugucuacaaccucccagaagaccacauggcucccugugcugcuugggagccugggaugcaagccgcugaccauguuucucauugccgagaauaaaaucuggggccggaagucuuggccccugaacgaaggcaucauggcggucgggauuguguccauccuucugagcucccuccugaaaaacgauguuccucucgccggaccccugauugcuggcgggaugcuuaucgccuguuacgugauuagcggaucuagcgcugaccugucccuggagaaggccgccgaggucucuugggaagaggaagcugagcauagcggcgcgucccacaauauccucguggaaguucaggaugacgggacaaugaaaaucaaggaugaggagcgcgacgauacgcugaccauucuucugaaagccacacuccuggcugugucuggagucuauccucucagcauccccgccacccuguucgugugguacuucuggcaaaagaagaaacagagauccggcguccuuugggacacaccuucucccccggaaguggagcgggccguucuggaugacggcauuuaucgcaucaugcagagagggcugcucggacggagccaggugggcgucgggguguuucaagaaaacguuuuccauaccauguggcacgugacgcgcggagcuguccugauguaccagggcaagagacuugagccuuccugggccagcgugaaaaaggaccugauuucuuacgggggaggcuggcggcuccagggcuccuggaauaccggggaggaagugcagguuaucgcggucgagcccggaaaaaacccuaagaaugugcaaacagcucccggcaccuuuaagacaagcgaaggggaggugggagccauugcccuggauuucaaaccgggcaccucuggguccccuaucgucaacagagaaggaaagaucgugggccucuauggcaaugggguugugacaacgagcggaaccuacgucuccgcuauugcccaggcgaaagcuucucaggagggcccccugccugagaucgaagacgagguguuucgcaagcggaaccuuacaauuauggaucugcaccccgggagcggaaaaaccagacgcuaucugcccgccaucguucgggaagccauuaagagacgccuccggacccugauccuugcuccuacaagaguggucgccuccgagauggcugaagcccugaagggcaugccgauccgcuaccaaacgaccgcggugaaaagcgagcauacagggaaggagauuguugaccucaugugccacgccaccuucacaaugcggcugcugucucccgugagagucccuaauuauaacaugaucauuauggaugaagcucauuuuaccgaccccuccagcaucgccgcucggggcuacauuucuacgcgcgugggaaugggcgaggccgccgcuaucuucaugacagcgaccccucccgggagcguggaagccuuuccucaguccaaugcugucauccaggaugaggaaagagacauuccggagcggucuuggaacagcggauaugaguggaucaccgauuuccccggcaaaacaguuugguuugugccuuccauuaagucugggaaugacaucgccaacugucuccgcaaaaauggaaagagagugauucagcuuagccggaagaccuucgauacagaauaccaaaaaaccaagaacaacgacugggacuacgucgugacgacagauaucuccgagaugggcgccaauuucagagcugaccgcguuauugauccccggagaugccugaaaccugugauccugaaggacgggcccgaacgcgucauccucgccggcccgaugccugugaccguugcgagcgcugcccagcggagaggacgcauuggccggaaccacaauaaagagggggaucaguauaucuacaugggacagccccugaacaaugacgaggaucaugcccacuggacagaagcuaagaugcuucuggacaacauuaauacccccgagggcaucauuccugcccucuuugaacccgagagagaaaagucugcggccaucgauggggaguaucgccugagaggagaggcucggaaaacguucguggaacugaugcgcagaggcgaccucccugucuggcuuuccuacaagguggccagcgagggguuucaauauuccgaucggcgcuggugcuucgacggcgaaagaaacaaucagguccuggaggaaaacauggauguggagaucuggaccaaagagggagaacggaagaaacugagaccgcgcuggcucgacgcucggacauacucugacccccuggcccuuagagaguuuaaggaauucgcugccggccgccggagcguuuccggggaucugauucucgagaucggaaaacugccucagcaccugacccagagagcgcaaaaugcccucgacaaccuugugaugcugcauaauucugaacagggcgggcgggcuuaucgccacgccauggaggagcugcccgauacaauugaaacccucaugcugcuugcucugaucgccgugcucacaggaggcgucacccuguuuuuccugagcggcagagggcucggaaagacguccauuggccuucuguguguuauggccagcucugugcugcucuggauggcuuccguggagccucauuggaucgcggccagcaucauucuggaauuuuuccuuaugguccugcucauccccgagccggaccggcagcgcacaccucaggauaaccaacuggcuuacgugguuauugggcugcucuuuaugauccuuaccguggccgccaaugagaugggacugcuggaaaccacaaagaaagaccucggcauugggcacgucgcuguggagaaccaccaucacgccgcgaugcuggaugucgaccuucaucccgccucugcuuggacccuguacgccguggcuacaacgaucauuaccccuaugaugagacacacaaucgaaaacaccacagccaauaucucccucaccgcgauugccaaccaggcugccauccugaugggacuggauaagggcuggcccauuagcaaaauggacaucggcguuccucuccuugcucuggggugcuauucucaggugaauccccugacgcucaccgccgcuguccugaugcuuguggcccauuacgcgauuaucggaccgggccugcaagccaaggcuacacgggaggcccagaaacgcaccgcugccgggaucaugaagaacccuacaguugauggaauuguggccaucgaccucgaucccgucguguaugacgcgaaguucgaaaaacagcugggccagauuaugcugcucauccuuuguaccagccaaauucugcugaugagaacgacaugggcucucugcgaguccaucacccuggccacagggccccuuaccacccugugggagggaucuccuggcaaguuuuggaauacaacgaucgcugugagcauggccaacauuuuccggggcuccuaccucgccggggcuggacuggccuucagccugaugaaaucccucggcgggggacgcagaggcaccggggcgcagggagaaacacuuggcgagaaguggaaacggcagcugaaucagcugucuaagagcgaauuuaacaccuauaagagauccggcaucauggagguugaccgcucugaagccaaagaggggcucaagcggggagagacaaccaaacacgcugucagcagaggcacggccaagcugcgcugguucguggaacggaaucuugugaaaccggaggggaaggucauugaucugggauguggcagagggggaugguccuacuauugcgcuggccucaagaaaguuacagaagugaagggcuacaccaaagggggacccggccacgaggaaccuauccccauggccaccuacggguggaaccuggugaagcugcauucuggaaaagacgucuuuuucauuccucccgagaagugugauacacuccuuugcgacaucggcgagagcuccccuaauccgaccauugaagaggggcgcacacugcgggugcugaaaaugguugaacccuggcucagaggaaaccaauuuuguaucaagauccugaauccuuauaugcccagcguggucgagacgcuugagcagaugcagcgcaagcacggcggcaugcuggugcggaacccucucucuagaaauuccacccaugaaauguacuggguuagcugcgggacaggaaacauugugucugcggucaauaugaccucccgcaugcugcugaaccgguucacaauggcccacagaaaacccaccuaugagcgcgauguggaccucggcgcugggacgagacacguggccgucgaaccggagguugcuaaccuggauaucauuggacagcggaucgaaaauauuaagcaugagcacaaaagcaccuggcauuacgacgaggauaacccuuauaagacaugggccuaccacggcucuuaugaagugaaacccuccgggagcgcuuccagcauggugaauggagucgugaagcuucugaccaagcccugggacguuaucccuauggugacacaaaucgccaugaccgauacaacccccuuuggccagcagcgcgucuucaaagagaagguggacacgagaacaccuaaagcgaagcggggcaccgcccaaauuauggaaguuaccgcuaaauggcucuggggguuucugucuagaaacaagaagccgcggaucuguacacgcgaggaauucacgagaaaagugcggagcaaugccgcuauuggagccgucuuuguggacgagaaccaguggaauuccgccaaggaggcgguugaagaugagcgcuucugggaccuugugcauagagaacgggagcugcacaaacagggcaagugcgcuaccugcgucuacaacaugauggggaaacgcgaaaagaagcucggagaguuuggcaaagccaaggggucuagagccaucugguacauguggcugggcgcucgguuccuggaguucgaagcccucggauuuaugaaugaggaucacugguucagccgcgaaaacucccugucuggcguggagggggagggacuucauaaacugggcuauauucucagagacaucagcaagauccccgggggaaauauguacgcugaugacacagccggcugggauacccggauuacagaagacgaucugcagaacgaggcgaaaaucaccgacauuauggaaccugagcacgcccuucuggcuaaguccaucuuuaaacucacauaucaaaauaaggucgugcgcguucagagacccgccaagaacgggaccgugauggaugucauuucucggcgcgaccagagaggcagcggacaggugggcacguacgggcugaauaccuucacaaacauggaagcucaacugauccggcagauggaguccgagggaaucuuuagcccuucugaacucgagacccccaaccuggccggcagagugcuuaauuggcuggaaaaacaugggguugagcgccucaagcggauggcgauuuccggagaugacuguguggucaaaccgaucgacgauagauucgccacagcucugaccgcccuuaacgacaugggcaaggugcgcaaagauauuccucagugggaacccagcaagggguggaaugacuggcagcaaguuccuuuuugcucucaccacuuccaucagcugaucaugaaggauggccgggagauugugguccccuguagaaaccaggacgagcucgugggacgcgcucgggucucccagggcgccggguggagccugagagaaacggcuugccugggaaaauccuaugcccaaauguggcagcucauguacuuucaccgccgggaucugagacuugcggccaaugcuaucuguucugccgugccuguugacugggugcccacaagccgcaccacaugguccauucaugcccaccaucaguggaugaccacggaggauaugcugagcgucuggaaccggguguggaucgaagagaauccguggauggaagacaagacccacguuucuuccuggggcgaugugccuuaucucgggaaaagagaggaccaauggugcggaagccugaucggccuuacagcucgggccaccugggcgacaaacauucaggucgcuaucaaucaggugagacgccugcucgggaacgagaauuaccuggacuacaugaccucuaugaagcgguucaaaaacgaaagcgaucccgagggcgcccugugguga

SEQ ID NO: 18825 - RNA, 9879 nt, Artificial Sequence
  derived and/or modified CDS sequence (opt5) from DENV-1__EU660412__SS-prME
agcgugaccaugcugcucaugcugaugcccaccgcccuugcuuuccaccugacgaccagaggaggggaaccucauaugaucguguccaagcaggaacggggaaaaucucuccuguuuaagaccagcgccggcguuaacaugugcacccuuauugcgauggaccugggggaacucugugaagauacaaugaccuacaaaugcccccgcaucacagaggcugaacccgacgauguggacuguuggugcaaugccaccgauacgugggugaccuauggaacauguucccagaccggcgagcacagacgggacaagcgcucuguggcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaagcucacaguuguggucggagauguggcuggcauucuggggcagggcaagaaaaugauccggccgcaacccauggaguacaaauauucuuggaaaagcuggggcaaggccaagauuaucggggccgacgcucagaauaccaccuucaucauugauggaccuaacacacccgaauguccugacgaucagagagcguggaauaucugggagguggaggacuacggcuuuggcauuuucaccacgaacaucuggcugaaacuucgcgauuccuauacacaggucugcgaccaccggcucaugagcgccgcuauuaaagauucuaaggccguucacgccgacaugggguacuggaucgaauccgagaaaaaugaaaccuggaagcuggcuagagccagcuuuaucgaggugaagacauguauuuggcccaaaucucauacccugugguccaacggagugcucgaaagcgagaugaucauuccgaagaucuauggcgggccuauuucucaacacaauuaccgccccggauacuucacacagaccgcgggcccuuggcaucuggggaaacuugagcuggauuucgaccucugcgaaggaacgaccgucgugguugaugagcacugcggcaaccggggccccagccugagaacaaccacagugaccgggaagaucauccacgaaugguguugccgguccuguacgcugccuccccuucgcuuuagaggagaggacggcugcugguaugggauggagauucggccggucaaagaaaaggaggaaaaucucgucaagagcaugguuucugcuggauccggcgagguggacagcuucucccuggggcugcucuguaucucuauuaugaucgaagaggucaugagaagccgcuggucccggaaaaugcugaugacaggaacccuugccguguuuuuccugcucauuaugggccagcugacauggaacgaucugaucagacuuugcauuaugguuggcgccaaugcuucugaccgcauggggaugggaaccaccuaccuggcccucauggcgacauuuaagaugagaccuauguucgcugugggccugcucuuucggcgccugacgagcagagagguccuucugcucaccaucgggcugucccugguggccucuguggaacuucccaacagccuggaggaacucggagauggccuggccauggggaucaugauucucaaacugcuuacagacuuccaaucccaucagcugugggcuacccuccugagccugacauuuaucaagaccacguucucucuucacuaugccuggaaaacaauggcuaugguccuguccauuguuagccucuuuccccugugucucucuaccaccucccagaagacaaccuggcugccugugcuucugggaagccugggcugcaagccgcucacaauguuccugaucgccgagaauaaaauuuggggccggaagucuuggccccuuaacgaagggaucauggcggugggaaucgucuccauucugcucagcucccugcucaaaaacgaugugccucuggccggcccccuuaucgcugggggaaugcugauugccuguuacguuaucagcggcucuagcgcugaccugucccucgagaaggccgccgaggugucuugggaagaggaagcugagcauagcggggcgucccacaauauucuggucgaagugcaggaugacggaacgaugaaaaucaaggaugaggagcgcgacgauacccuuacaauccugcucaaagccacccugcucgcuguuucuggcguguauccucugagcauucccgccacacuuuuugucugguacuucuggcaaaagaagaaacagagauccggcgugcugugggacaccccuucucccccggaagucgagcgggccgugcuggaugacgggaucuaucgcauuaugcagagaggacuccugggccggagccagguuggggugggagucuuccaagaaaacguguuucauacgauguggcacguuacccgcggcgcugugcuuauguaccaggggaagagacuggagccuuccugggccagcgucaaaaaggaccucaucucuuacggaggcggcuggcggcugagaggguccuggaauacaggagaggaaguccaggugauugcgguugagcccggcaaaaacccuaagaauguccagaccgcucccgggacauucaagaccccggaaggagaggugggcgccaucgcccucgauuuuaaaccugggacaagcggaucucccauugugaaccgcgaaggcaagaucgucggccuguaugggaauggagugguuacgaccuccggcacauacgugagcgcuaucgcccaagcgaaggcuucccaggaggggccucuucccgagauugaagacgaggucuuccggaagagaaaccugaccaucauggaucugcaccccggaucuggcaaaacccgccgguaucucccugccauugugagagaagccaucaagcgcaagcugcggacacuuauucuggcuccgacgagaguuguggccagcgagauggcugaagcccucaaagggaugcccauccgcuaccagaccacagcggucaaguccgagcauaccggcaaagagaucguggaccugaugugccacgccacauuuaccaugcggcugcucagcccuguuagagugcccaauuauaacaugauuaucauggaugaagcucauuucacggacccuucuuccauugccgcucggggauacaucagcacacgcgucggcaugggggaggccgccgcuauuuuuaugaccgcgacacccccuggaucuguggaagccuucccgcaaagcaaugcugugauccaggaugaggaaagagacauccccgagcgguccuggaacucuggcuaugaguggauuacagauuuuccugggaagaccgucugguucguucccagcaucaaauccggaaaugacauugccaacugucuucgcaagaauggcaagagagugauccagcugucucggaaaacauuugauaccgaauaccagaagacgaaaaacaacgacugggacuacguggucacaaccgauauuagcgagaugggggccaauuucagagcugaccgcgugaucgauccucggagaugccugaagcccguuauucucaaagacggcccggaacgcgugauccuggccggaccuaugcccgucacaguggcguccgcugcccaacggagaggccgcaucgggcggaaccacaauaaggagggagaucaguauauuuacaugggccagccccuuaacaaugacgaggaucaugcccacuggaccgaagcuaagaugcugcucgacaacaucaauacgccugaggggauuauccccgcccuguucgaaccugagagagaaaagagcgcggccguugauggagaguaucgccugagaggcgaggcucggaagaccuuuguggagcucaugcgcagaggggaccuuccggucuggcugucuuacaaaguggccuccgagggcuuccaguauagcgaucggcgcuggugcuuugacggagaaagaaacaaucaaguccuggaggaaaacauggauguggagauuuggacaaaggagggcgaacggaaaaagcucagaccccgcuggcuggacgcucggaccuacuccgacccucuugcccugagagaguucaaagaauuugcugccgggcgccggucuguuagcggagaucucauccuggagaucggcaagcugccccagcaccucacacagagagcgcagaaugcccuugacaaccuggugaugcugcauaauuccgaacaagggggacgggcuuaucgccacgccauggaggagcucccugauaccauugaaacacugaugcuucuggcucucaucgccgugcugaccggcggcgucacgcuguucuuucucucugggagaggacuuggcaagacaagcauugggcugcuguguguuauggccuccagcgugcuccuguggauggcuucuguggagccccauuggaucgcggccuccauuauccuugaguucuuucugaugguccuccugaucccggagccugaccggcagcgcacaccccaggauaaccagcuggcuuacgugguuauuggacuccuuuucaugauccugaccguggccgccaaugagaugggccugcucgaaacaaccaaaaaggaccuggggauuggacacgucgcuguggagaaccaccaucacgccgcgaugcuugaugucgaccugcauccugccagcgcuuggacacucuacgccguggcuacgaccaucauuacacccaugaugagacacaccaucgaaaacacaaccgccaauauuucucugacggcgaucgccaaccaagcugccauccugaugggccucgauaaaggcuggccuauuuccaagauggacaucgggguuccccuucuggcucugggaugcuauagccaggugaauccgcucacccugacagccgcuguccuuaugcugguggcccauuacgcgauuaucggcccugggcuccaggccaaagcuacccgggaggcccaaaagcgcacagcugccggaauuaugaagaaccccaccguugauggcaucguggccaucgaccuggaucccgucguguaugacgcgaaauuugaaaagcagcuggggcagauuaugcuccuuauccuguguacgucucagauucugcucaugagaacaaccugggcucugugcgagagcaucacacuugccaccggaccucugaccacacucugggagggcuccccgggcaaauucuggaauacgaccauugcugugucuauggccaacaucuuucgggggagcuaccuggccggagcuggccuggccuucucccucaugaaaagccuugggggaggccgcagagggacaggagcgcaaggcgaaacccugggcgagaaauggaagcggcagcugaaucagcucuccaagucugaguucaacacauauaaaagaagcgggaucauggagguugaccgcuccgaagccaaggagggacugaaacggggcgagaccacgaagcacgcugucucuagagggacagccaaacuucgcugguuuguggaacggaaucuggugaagcccgagggaaaggucauugaucucggcugugggagaggaggcuggagcuacuauugcgcuggccugaaaaagguuaccgaagugaaaggguacaccaagggaggcccugggcacgaggaacccaucccuauggccacauacggauggaaccuggugaaacuccauuccggcaaggacgucuucuuuauucccccugagaaaugugauacccuucugugcgacaucggggagucuagcccgaaucccacaauugaagagggacgcacgcugcgggugcucaagaugguugaaccuuggcugagaggcaaccaguucuguaucaagauucuuaaucccuauaugccuuccguggucgaggcgcuggagcaaaugcagcgcaaacacggcgggaugcucgugcggaacccccugagcagaaauucuacccaugaaauguacuggguuuccugcggaacaggcaacaucgugagcgccgucaauaugaccucucgcaugcugcucaaccgguuuacaauggcucacagaaagccgaccuaugagcgcgauguggaccuggggacgggaaccagacacguggccgucgaaccugagguugcuaaccuugauaucauuggccagcggaucgaaaauauuaaacaugagcacaaguccacauggcauuacgacgaggauaaccccuauaaaaccugggccuaccacgggagcuaugaagugaagcccucuggauccgcuagcuccauggugaauggcgucgugaagcugcucacaaaaccuugggacguuauccccauggugacccagauugccaugacagauaccacgccuuucggccaacagcgcgucuuuaaggagaaaguggacacaagaaccccgaaggcgaaacgggggaccgcccagaucauggaaguuacagcuagauggcuguggggauuccuuagccggaacaagaagccccgcaucuguacgagagaggaauuuacccggaaagugcgcucuaaugccgcuauuggcgccgucuucguggacgagaaccaauggaauagcgccaaggaggcgguugaagaugagagauuuugggaccuggugcaucgggaacgcgagcuccacaaacaggggaagugcgcuacaugcgucuacaacaugaugggaaaaagagaaaagaagcugggcgaguucgggaaagccaagggcucccgggccaucugguacauguggcugggagcucgcuuucucgaguucgaagcccugggcuucaugaaugaggaucacugguuuucuagagaaaacagccuuuccgggguggagggagagggccugcauaaacucggguauauucugcgggacaucucuaagauuccuggaggcaauauguacgcugaugacaccgccgggugggauacacgcaucaccgaagacgaucuucagaacgaggcgaaaaucacagacauuauggaacccgagcacgcccugcucgcuaaggccaucuucaaacugaccuaucagaauaaggucgugagaguucaacggccugcuaagaacggcacggugauggaugucauuagccgcagagaccagcggggauccggccagguggggaccuacggacugaauacauuuaccaacauggaagcccagcucaucagacaaauggagucugagggcauuuucagccccuccgaacuggagacaccgaaccuugcggaacgcgcccuggauuggcucgagaaauaugggguggaacggcugaagagaauggcuaucagcggagacgacuguguugugaaaccuaucgaugaccgcuuugccaccgcucuuacggcccugaaugauaugggcaagguccggaaagacauuccccagugggagccuucuaagggguggaacgauuggcaacaggugcccuucugcucccaucacuuucaccaacucaucaugaaggacggcagagagauuguugugccuugucgcaaucaggaugaacuggucggacgggcuagagugagccagggcgccggguggucucugcgcgagacagcgugccucggaaaauccuacgcccagauguggcaacugauguauuuccaucggagagaccuucgccuggcugccaacgccaucuguagcgcuguccccguggauuggguuccgaccucccggacaaccuggucuauucacgcccaucaccaguggaugacgaccgaagacaugcucagcguguggaauagagucuggaucgaggaaaacccuuggauggaggauaagacacauauuuccagcugggaggacgugcccuaccugggcaaacgggaagaccaguggugcgggucucuuaucggacugaccgcgagagcuacaugggccaccaauauccaaguugccauuaaccaggugcgccggcucaucggcaaugagaacuaccuggauuauaugauuuccaugaagagauuuaaaaaugaaagcgaccccgagggggcucugugguga

SEQ ID NO: 18826 - RNA, 9879 nt, Artificial Sequence
  derived and/or modified CDS sequence (opt5) from DENV-1__EU660418__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccagacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaggaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccagacggccggaccuuggcaucucggcaaacuggagcuugauuuugaccugugcgaagggaccacagugguuguggaugagcacugcggaaaccggggccccagccucagaaccacaaccgucacgggcaagaucauccacgaaugguguugccgguccuguacacugccuccccugcgcuucagaggggaggacggaugcugguauggcauggagauucggccggugaaagaaaaggaggaaaaucuuguuaagagcauggugucugcgggguccggagaggucgacagcuuuucccucggccugcuguguaucucuauuaugaucgaagaggugaugagaagccgcuggucccggaaaaugcucaugaccgggacacuggcuguuuucuuucuucugauuaugggacagcucaccuggaacgaucugaucagacugugcauuauggugggcgccaaugccucugaccgcaugggcauggggaccacauaccuugcucugauggccacguucaagaugagaccuauguuugcggucggacuccuguuccggcgccucaccagcagagaggugcugcuucugacaaucggccucucccugguggcuucugucgaacugcccaacagccuugaggaacugggggauggacucgccaugggcaucaugauucugaaacuccugaccgacuuucaaucccaucagcuuugggccacacugcucagccugaccuucaucaagacgacauuuucucugcacuaugcuuggaaaaccauggccaugguucuuuccauugugagccuguucccccucugucugucuaccacaucccagaagaccacauggcucccugugcugcuugggagccugggaugcaagccgcugacgauguuucucaucgcugagaauaaaauuuggggccggcgcucuuggccccugaacgaaggcaucauggccgucgggaucguguccauucuucugagcucccuccugaagaacgauguuccucucgcgggaccccugaucgccggcgggaugcuuauugcuuguuacgugaucagcggaucuagcgccgaccugucccuggagaaagcugccgaggucucuugggaagaggaagccgagcauagcggcgcuucccacaauauucucguggaaguucaggaugacgggaccaugaagaucaaagaugaggagagagacgauacacugaccauccuucugaaggcgacacuccuggccgugucuggagucuauccucucagcauucccgcuacccuguucguguggcauuucuggcagaagaagaagcagcgguccggcguccuuugggacacgccuucucccccggaagugggccgcgccguucuggaugacgggaucuacagaauuaugcagcggggacugcucggccgcagccaggugggggucggaguguuucaagagaacguuuuccacaccauguggcacgugacaagaggcgccguccugauguaucaggggaaacggcuugaaccuuccugggcuagcgugaagaaagaccugaucucuuacggaggcggcuggagacuccagggguccuggaauaccggagaggaggugcagguuauugccgucgaacccggcaagaacccuaaaaaugugcaaacagcgcccgggaccuuuaagacaccggagggagaagugggcgcuaucgcccuggauuucaagccugggacgagcggaucucccauugucaaccgcgagggcaaaaucgugggccucuacgggaauggaguugugaccacauccggcaccuaugucagcgccaucgcucaggccaaggcgucccaggaagggccucugcccgagauugaggacgaaguguuucggaaaagaaaccuuaccaucauggaucugcaucccggaucuggcaagacacgccgguaccugccugcuauuguuagagaggccaucaaacgcaagcuccggacgcugauucuugccccgaccagaguggucgcuagcgaaauggccgaggcucugaaggggaugcccauccgcuaucaaacaaccgccgugaaauccgaacacacaggcaaggagaucguugaccucaugugccaugcgaccuucacgaugcggcugcugagcccugugagaguccccaauuacaacaugauuaucauggaugaggcccacuuuacagacccuucuuccauugcugcccggggauauaucagcacccgcgugggcaugggggaagcugccgccauuuucaugaccgcuacacccccuggaucuguggaggcguuuccgcagagcaaugccgucauccaggaugaagagagagacauccccgaacgguccuggaacucuggcuacgaguggauuaccgauuucccugggaaaacaguuugguuugugcccagcaucaaguccggaaaugacauugcuaacugucuccgcaaaaauggcaagagagugauccagcuuucucggaagaccuucgauacggaguaucagaaaaccaagaacaacgacugggacuacgucgugaccacagauauuagcgaaaugggggccaauuucagagccgaccgcguuaucgauccucggagaugccugaaacccgugauucugaaggacggcccggagcgcgucauccucgcuggaccuaugcccgugaccguugccuccgcggcucagcggagaggccgcaucgggcggaaccauaauaaagaaggagaucaguacauuuauaugggccagccccugaacaaugacgaggaucacgcccacuggacggaggccaagaugcuucuggacaacaucaauaccccugaagggauuauccccgcucucuuugagccugaaagagaaaagagcgccgcgauugauggagaauaccgccugagaggcgaggcccggaaaacauucguggagcugaugcgcagaggggaccucccggucuggcuuucuuauaagguggcuuccgaaggcuuucaauacagcgaucggcgcuggugcuucgacggagagagaaacaaucagguccuggaagagaacauggauguggaaaucuggaccaaagagggcgagcggaagaaacugagaccccgcuggcucgacgcccggacauauuccgacccucuggcucuuagagaauuuaaggaguucgccgcugggcgccggucuguuagcggagaucugauccucgaaauuggcaaacugccccagcaucugacccagagagcccaaaaugcgcucgacaaccuugugaugcugcacaauuccgagcaagggggacgggccuaccgccaugcuauggaggaacugccugauacaaucgagacccucaugcugcuugcccugauugcugugcucacgggcggcgucacacuguuuuuccugucugggagaggacucggcaagaccagcaucgggcuucuguguguuauggccuccagcgugcugcucuggauggccucuguggaaccccacuggauugcugcguccaucauccuggaguuuuuccuuaugguccugcucauuccggaaccugaccggcagcgcacaccccaggauaaccaacuggccuaugugguuaucggacugcucuuuaugauucuuacaguggcugccaaugagaugggccugcuggagaccacaaagaaagaccucgggaucggacacgucgccguggaaaaccaucaccaugcugccaugcuggaugucgaccuucacccugcgagcgccuggacgcuguacgcuguggccaccacaauuaucacccccaugaugagacauacaauugagaacaccacggcuaauaucucucucaccgccaucgcgaaccaggccgcuauucugaugggccuggauaagggcuggccuaucuccaaaauggacauugggguuccccuccuugcccugggaugcuacagccaggugaauccgcugacacucaccgcugccguccugaugcuuguggcucacuaugccaucauuggcccugggcugcaagcgaaggccacacgggaagcucagaaacgcaccgccgcuggaaucaugaagaaccccacgguugauggcaucguggccauugaccucgaucccgucguguacgacgccaaguucgagaaacagcuggggcagaucaugcugcucauucuuuguacaucucaaauccugcugaugagaaccacaugggcgcucugcgaaagcauuacccuggcuaccggaccucuuacaacgcugugggagggcuccccgggcaaguuuuggaauaccacaaucgccgugucuauggcuaacaucuuccgggggagcuaucucgccggagccggccuggcuuucucccugaugaaaagccucgggggaggccgcagagggaccggagcccagggcgagacacuuggcgaaaaguggaaacggcagcugaaucagcuguccaagucugaguuuaacaccuacaagagaagcgggauuauggaaguugaccgcuccgaggcgaaagaaggacucaagcggggcgagacgacaaaacacgccgucucuagagggaccgcuaagcugcgcugguucguggagcggaaucuugugaaacccgaaggaaaggucaucgaucugggcugugggagaggaggcuggagcuauuacugcgccggccucaagaaaguuaccgaggugaagggguauacaaaaggaggcccugggcaugaggagcccauuccuauggcuaccuacggauggaaccuggugaagcugcacuccggcaaagacgucuuuuucauucccccugaaaagugugauacacuccuuugcgacauuggggagucuagcccgaaucccacgaucgaggaaggacgcacccugcgggugcugaaaaugguugagccuuggcucagaggcaaccaauuuuguauuaagauccugaaucccuacaugccuuccguggucgaaacacuugagcagaugcagcgcaagcauggcgggaugcuggugcggaacccccucagcagaaauucuacccacgagauguauuggguuuccugcggaacaggcaacaucgugagcgccgucaauaugaccucucgcaugcugcugaaccgguucacgauggcgcacagaaaaccgaccuacgaacgcgauguggaccucggggccggaacaagacauguggcugucgagccugaaguugccaaccuggauauuaucggccagcggauugagaauaucaagcacgaacauaaauccaccuggcacuaugacgaggauaaccccuacaagacaugggcuuaucaugggagcuacgaggugaaacccucuggauccgccagcuccauggugaauggcgucgugaaacuucugaccaagccuugggacguuauucccauggugacacaaaucgcuaugaccgauacgacaccuuuuggccagcagcgcgucuucaaagaaaagguggacaccagaaccccgaaagccaagcgggggacagcgcaaaucauggagguuacggccaaauggcucuggggauuucugagcagaaacaagaagccccggauuuguacccgcgaagaguucacaagaaaagugcggucuaaugcugccaucggcgcugucuuuguggacgaaaaccaguggaauagcgccaaggaggccguugaggaugaacgcuucugggaccuugugcacagagagcgggaacugcacaaacaggggaagugcgcgaccugcgucuauaacaugaugggaaaacgcgagaagaagcucggcgaauuugggaaagcuaagggcuccagagccauuugguacauguggcugggagcccgguuccuggaguucgaggcucucggcuuuaugaaugaagaucauugguucucucgcgagaacagccuguccgggguggaaggagagggccuucacaaacugggguacauccucagagacauuucuaauaucccuggaggcaacauguaugccgaugacacagcugggugggauacccggaucacagaggacgaucugcagaaugaagcccgcauuaccgacaucauggagcccgaacaugcgcuucuggccaagagcauuuuuaaacucacguaccaaaacaaggucgugagaguucagcggccugcuaaaaauggcaccgugauggaugucaucucccgcagagaccagcggggaucuggccagguggggacauauggacugaacaccuucacaaacauggaggcccaacugauuagacagauggaaagcgagggcaucuuuucccccagcgagcucgaaaccccgaaucuggcugagcgcgugcuugauuggcuggaaaaguacgggguugagcggcucaagagaauggccaucucuggagacgacuguguggucaaaccuauugaugaccgcuucgcgacggcccugacagcucuuaacgauaugggcaaggugcggaaagacaucccccagugggaaccuuccaagggguggaaugauuggcagcaaguucccuuuugcagccaccacuuccaucagcugauuaugaaagacggcagagagaucguggucccuugucgcaaccaggaugagcucgugggacgggccagagucucucagggcgcuggguggucccugcgcgaaaccgccugccugggaaagagcuaugcucaaauguggcagcucauguacuuucaccggagagaccugcgccuugccgcgaaugccauuuguuccgcugugcccguugauuggaucccgacaucucggaccacguggagcauucaugcccaccaucaguggaugaccacagaggacaugcuguccguguggaacagagucuggaucgaagagaauccuuggauggaagauaagacccacaucagcucuuggggcgacgugcccuaucucgggaaacgggaggaccaauggugcggaucccugauuggccuuacagccagagcuaccugggccacaaacauccagguugcgauuaaucaggugcgccggcugaucgggaacgagaauuaccucgauuacaugaccagcaugaagagauucaaaaacgaaucugaccccgagggcgcucugugguga

SEQ ID NO: 18827 - RNA, 9879 nt, Artificial Sequence
  derived and/or modified CDS sequence (opt5) from DENV-1__EU677151__SS-prME
agcgugaccaugcugcucaugcugauccccacagcccuugcuuuccaccugacgaccagaggcggggagccucauaugauugucuccaagcaggaacggggaaaaucucuccuguuuaagacaagcgccggcguuaacaugugcacccuuaucgcgauggaccugggggagcucugugaagauacaaugaccuacaaaugcccgcgcauuacagagguggaacccgacgauguggacuguuggugcaauaccacggauaccugggucacauauggaaccuguucccaaacaggcgagcacagacgggacaagcgcucuguggcucuggccccucauguugggcugggacucgagaccagagccgaaacguggaugagcuccgagggcgcuuggaaacagauccagaagguggaaacaugggcccugcggcaccccggcuucaccgucauugcucuuuuucuggcccaugcgaucgggacaucuaucacccagaagggaauuaucuucauucuccugaugcuugugaccccuagcauggccaugcgcugcguuggcaucggguccagagauuuuguggagggacugagcggcgcuacaugggucgacguggugcucgagcacgggucuugugucacgaccauggccaaagauaagcccacacuggacauugaacugcucaaaaccgagguuacaaacccugcugugcugcggaagcuuugcaucgaagccaaaauuuccaauaccacgacagauagccgcuguccgacccaaggagaggcgacccugguggaagagcaggacgccaacuucgucugcagacggacauuuguggaucgcggcuggggcaauggguguggacucuucggcaaggggucucugaucaccugcgcuaaguuuaaaugcguuacaaagcuugagggaaaaaucgugcaguacgaaaaccugaaguauuccgucauugugacgguucacaccggcgaccagcaucaaguggggaaugagagcacagaacacggaaccacagccaccaucacgccccaggcuccuaccucugagauucagcucacagacuacggcgcccugacccuggauuguucccccagaacaggccucgacuucaacgaaaugguccugcuuaccaugaaagagaagagcuggcuggugcauaaacagugguuucucgaucugccucuucccuggacguccggggccucuacaagccaagagaccuggaaucggcaggaccugcucgucacauucaagaccgcucacgcgaagaaacaggaagugguugugcugggaucccaagagggcgccaugcacaccgcucugacaggggccacggaaauccagaccagcggaacaaccacaauuuuugccggccaucucaagugccgccugaaaauggauaagcuuacccugaaagggaugucuuaugucauguguacgggcuccuucaagcucgagaaggaaguggcugagacacagcacggaaccguucuggugcagaucaaauacgagggcaccgacgccccgugcaagaucccuuucagcacacaagaugaaaaaggggucacccagaacggaagacugauuacagcgaaucccaucgugacggacaaggagaaaccugugaacauugaagcugagccccccuuuggcgagucuuauaucguuauuggggccggagaaaaggcccuuaagcucagcugguucaaaaagggcuccucuaucgggaaaauguuugaggcuaccgcccggggcgcuagacgcauggccauccugggagauacagcgugggacuucggcagcauugggggagucuuuaccuccgugggcaagcuggugcaucagaucuucgggacagccuacggaguccucuuuagcggcgugucuuggaccaugaaaauugggaucggcguucugcuuacguggcugggacucaauucccggagcaccucucuguccaugacauguauugcugugggccuggucacccuuuaccucggggugaugguucaggccgauagcggaugcgugaucaacuggaagggcagagaacugaaguguggguccggaauuuucgucacaaaugaggugcacaccuggacagaacaauauaaauuucaggcugacucuccuaagcgccugagcgccgcgaucggcaaagccugggaggaggggguuugcggcauccgguccgcuaccagacucgaaaacauuauguggcgccagaucucuaacgagcugaaucauauucuucuggaaaacgacaugaaguucacgguggucgugggagauguggucggcauccucgcccaggggaaaaagaugauucggccgcaacccauggagcacaaauacagcuggaaguccuggggaaaggcuaaaaucaucggcgccgacguucagaauacaaccuuuauuaucgaugggccuaacacccccgaauguccugacgaucagagagccuggaauauuugggagguggaggacuauggauucggcaucuuuacaaccaacauuuggcugaagcugcgcgauagcuacacgcaggugugcgaccaccggcuuaugucugcugcgaucaaagauuccaaggccguccaugcugacaugggcuauuggaucgaaagcgagaaaaaugaaacauggaagcucgccagagccucuuucauugaggugaagaccuguaucuggcccaaaucccacacacuguggagcaacgggguucuggaaucugagaugauuaucccgaagauuuacggaggcccuaucagccaacauaauuaucgccccggguacuucacccagacagcuggaccuuggcaccucggcaaacuggagcuugauuuugaccugugcgaagggaccacgguggucguggaugagcacugcggaaaccggggcgccucccucagaaccacaaccguuacaggcaagaucauucaugaaugguguugccggagcuguacccugcccccucugcgcuucaaaggggaggacggaugcugguacggcauggagaucagacccgugaaggaaaaggaggaaaaucuugucaaaucuaugguguccgcggggagcggagagguugacuccuuuucucucggccugcuguguauuagcaucaugauugaagaggugaugcgguccagauggucucgcaagaugcucaugacggggacacuggcugucuucuuucuucugaucaugggacagcucaccuggaacgaucugauucggagcugcaucauggugggcgccaaugccuccgacagaaugggcauggggacaaccuaucuggcucuuauggccaccuucaaaaugcgcccgaugguggcggucggacugcucuuuagacggcugacaucucgcgagguucuccugcuuacgaucggccugagccucguggcuuccguggaacugccuaacagccuggaggaacuuggggauggacuggccaugggcauuaugauccucaagcugcucaccgacuuccaaucuuaccagcugugggccacacuucugucccucaccuuuauuaaaacaaccuucagccugcacuaugcuuggaagacgauggccaugguccugucuaucgugucccuucugccccucugucugagcacaaccucucagaagaccacauggcuccccguucugcuugggucccugggaugcaaaccucugaccauguuucucauugcugagaauaagaucuggggcagaaaaagcuggccgcugaacgaaggcaucauggccguggggauugucuccauccuucugagcucucuccugaagaacgaugugccccucgcgggaccucugauugccggcgggaugcuuaucgcuuguuacguuauuagcggauccucugccgaccugagccuggagaaagcugccgagguguccugggaagaggaagccgagcauucuggcgcuagccacaauauccucgucgaagugcaggaugacgggacaaugaagaucaaagaugaggagcgggacgauacgcugaccauucuucugaaggcgacacuccuggccgucuccggaguguauccccucucuaucccugcuacccuguucguuugguacuuuuggcaaaagaaaaagcagcgcagcggcgugcuuugggacacacccuccccucccgaagucgagagagccgugcuggaugacggcauuuaucggaucaugcagcgcgggcugcucggaagaagccagguuggcgugggggucuuccaagaaaacguguuccauaccauguggcacgugacgcggggagccguucugauguaccagggcaaacgccuugagccgucuugggcuuccgucaagaaagaccugauuagcuacgggggaggcuggagacuccagggcucuuggaauaccggggaggaagugcaggugaucgccgucgagccuggaaagaaccccaagaaugugcaaacagcgccuggcaccuuuaaaacacccgaaggggagguuggagcuauugcccuggauuucaagccgggcaccuccgggagcccuaucgugaaccgggaaggaaaaaucgucggccucuauggcaauggggugguuacaacguccggaaccuacgugucugccauugcucaggccaaggcgagccaggagggcccccugccugagaucgaagacgaggucuuuagaaaacgcaaccuuacaauuauggaucugcaccccggguccggaaagacccggagauaucugcccgcuaucgugcgcgaagccauuaagcggaaacucagaacccugauccuugccccuacacgcguuguggcuagcgagauggccgaagcucugaagggcaugccgauccgguaccaaacgaccgccgucaaaucugagcauacagggagagagauuguggaccucaugugccacgcgaccuucacaaugcgccugcugucccccgugcgggucccuaauuauaacaugaucauuauggaugaagcccauuuuaccgaccccagcucuaucgcugccagaggcuacauuagcacgcggguuggaaugggcgaggcugccgccaucuucaugacagcuaccccucccggguccguggaagcguuuccucagucuaaugccgugauccaggaugaggaacgcgacauuccggagagaagcuggaacuccggauaugaguggaucaccgauuuccccggcaagacagucugguuugugccuucuauuaaaagcgggaaugacaucgcuaacugucuccggaagaauggaaagcgcguuauucagcuuuccagaaaaaccuucgauacagaauaccaaaagaccaaaaacaacgacugggacuacguggucacgacagauaucagcgagaugggcgccaauuuucgggccgacagagugauugauccccgccggugccugaagccuguuauccugaaagacgggcccgaaagagugauccucgcuggcccgaugccugucaccguggccucugcggcucagcgccggggaagaauuggccgcaaccacaauaaggagggggaucaguauaucuacaugggacagccccugaacaaugacgaggaucaugcccacuggacagaagccaagaugcuucuggacaacauuaauacccccgagggcaucauuccugcucucuucgaacccgagcgggaaaaauccgccgcgaucgauggggaguauagacugcgcggagaggccagaaagacguucgucgaacugaugcggcgcggcgaccucccuguguggcuuagcuacaaaguugcuuccgagggguuucaauauucugauagacgguggugcuucgacggcgaacgcaacaaucaggugcuggaggaaaacauggauguggagaucuggaccaaggagggagaaagaaaaaagcugcggccgagauggcucgacgcccgcacauacagcgacccccuggcucuucgggaguuuaaagaauucgccgcuggcagacgcuccgucucuggggaucugauucucgagaucggaaagcugccucagcaccugacccagcgggcccaaaaugcgcucgacaaccuuguuaugcugcauaauagcgaacagggcgggagagccuaucggcacgcuauggaggagcugcccgauacaauugaaacccucaugcugcuugcccugaucgcugugcucacaggaggcgugacccuguuuuuccuguccggccgcgggcucggaaagacgagcauuggccuucugugugucauggccucuuccgcccugcucuggauggcuagcguggagccucauuggaucgcggccucuaucauucuggaauuuuuccuuaugguucugcucauccccgagccggacagacagcggacaccucaggauaaccaacuggcuuacguggucauugggcugcucuuuaugauccuuaccguggccgccaaugagaugggacugcuggaaaccacaaaaaaggaccucggcauugggcacgucgcuguggagaaccaccaucacgccaccaugcuggauguugaccuucaucccgcguccgccuggacacuguacgcuguggccacgaccaucauuacaccuaugaugcgccacaccaucgaaaacacaaccgcuaauaucagccucacggccauugcgaaccaggccgcuauccugaugggacuggauaaaggcuggcccauuucuaagauggacaucggcgucccucuccuugcccuggggugcuauagccaggugaauccccugacccucacagcugccguucugaugcuuguggcucauuacgccauuaucggaccgggccugcaagcgaaagccaccagagaggcucagaagcggacagccgcugggaucaugaagaacccuaccgucgauggaauuguggccaucgaccucgaucccgugguuuaugacgccaaauucgaaaagcagcugggccagauuaugcugcucauccuuuguacgucccaaauucugcugaugcgcacaaccugggcgcucugcgagucuaucacacuggcuaccgggccccuuaccacacugugggagggaagcccuggcaaauuuuggaauacgaccaucgccgucuccauggcuaacauuuucagaggcagcuaccucgccggggccggacuggcuuuuucccugaugaagucucucggcgggggacggcgcggcacaggggcccagggagaaacccuuggcgagaaauggaagagacagcugaaucagcugagcaaguccgaauucaacacauauaaacggucuggcaucauggagguggacagaagcgaagcgaaggaggggcuccgccggggagagaccacgaaacacgccguguccagaggcacagcuaagcugcgcugguucgucgaacggaaucuuguuaaaccggaggggaaggugauugaucugggauguggcagagggggauggucuuacuauugcgccggccucaagaaagugaccgaagucaagggcuacaccaaagggggacccggccacgaggaaccuauccccauggcuacauacggguggaaccuggugaagcugcauagcggaaaagacguuuuuuucauuccucccgagaagugugauacccuccuuugcgacaucggcgaguccagcccuaauccgacaauugaagaggggcgcacgcugcgggugcugaaaauggucgaacccuggcucagaggaaaccaauuuuguaucaagauccugaauccuuauaugcccucugugguugagacccuugagcagaugcagcgcaagcacggcggcaugcuggugcggaacccucucuccagaaauagcacacaugaaauguacugggucucuugcgggaccggaaacauuguguccgccgugaauaugacaagccgcaugcugcugaaccgguucaccauggcgcacagaaaacccacguaugagcgcgaugucgaccucggcgccgggaccagacacguugcuguggaaccggagguggccaaccuggauaucauuggacagcggaucgaaaauauuaagcaugagcacaaaucuacauggcauuacgacgaggauaacccuuauaagaccugggcuuaccacggcuccuaugaagucaaacccagcggguccgccagcucuauggugaauggaguugugaagcuucugacaaagcccugggacgucaucccuauggugacccaaaucgcuaugacagauaccacgcccuuuggccagcagcgcguuuucaaagagaagguggacacaagaaccccuaaagccaagcggggcaccgcgcaaauuauggaagucacagccagauggcucuggggguuucugagccggaacaaaaagccgcgcaucuguacgagagaggaauucacccggaaggugcgcuccaaugcugccauuggagcuguuuuuguggacgagaaccaguggaauucugccaaagaggccgucgaagaugagagauucugggaccuugugcaucgggaacgcgagcugcacaagcagggcaaaugcgcgacaugcgucuacaacaugauggggaagagagaaaaaaagcucggagaguuuggcaaggcuaaagggagccgggccaucugguacauguggcugggcgcccgcuuccuggaguuugaagcucucggauucaugaaugaggaucacugguucuccagagaaaacucucugagcggcguggagggggagggacuucauaagcugggcuauauucuccgggacaucuccaaaauccccgggggaaauauguacgccgaugacaccgcuggcugggauacacgcauuaccgaagacgaucugcagaacgaggccaagaucacagacauuauggaaccugagcacgcgcuucuggccaccucuaucuuuaaacucacguaucaaaauaagguugugagaguccagcggcccgcucgcaacgggaccgugauggaugugauuagcagacgggaccagagaggcuccggacagguuggcacauacgggcugaauaccuucacaaacauggaagcccaacugauccgccagauggagagcgagggaaucuuuucuccuuccgaacucgagacccccaaccuggcugaacgggugcuugauuggcuggagaaacauggcgucgaaagacucaagcgcauggccauuagcggggacgacugugugguuaagccgaucgaugaccgguucgcgacggcccugucugcucuuaaugauaugggaaaagugagaaaggacauuccucagugggagcccuccaaaggcuggaacgauuggcagcaagucccuuuuugcagccaccacuuccaucagcugaucaugaaggacgggcgcgagauugugguccccugucggaaucaggaugaacucgugggcagagcccgcguuucccagggagcuggcuggucucugcgggagacagccugccuggggaaaagcuaugcucaaauguggcagcucauguacuuucacagacgcgaccugcggcuugccgcgaacgccaucuguuccgcugugccugucgauugggugcccaccagcagaacaaccuggucuauucaugcccaccaucaguggaugacgaccgaagacaugcuguccguuuggaaucggguguggaucgaggaaaacccguggauggaggauaagacacacaucagcucuuggggagacgucccuuaucucggcaagagagaggaccaauggugcgggagccugauuggacuuaccgcccgcgcuacaugggccaccaauauccagguggcgauuaaccaggugcggagacugaucggcaaugaaaacuaccucgauuacaugacauccaugaaacgcuucaagaaugagucugaccccgaaggggcucugugguga

SEQ ID NO: 18828 - RNA, 9879 nt, Artificial Sequence
  derived and/or modified CDS sequence (opt5) from DENV-1__EU677152__SS-prME
agcgugaccaugcugcucaugcugaugcccaccgcccuugcuuuccaccugacgaccagaggcggggaaccucauaugaucgucuccaagcaggaacggggaaagucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccagaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaauuuauggaggcccuaucagccagcacaauuaccgccccggguacuuuacacaaaccgcgggaccuuggcaucugggcaagcucgagcuggauuucgaccuuugcgaagggacgaccgugguuguggaugagcacugcggaaaccggggccccucccugagaacaaccacagucaccggcaaaauuauccacgaaugguguugccggagcuguacgcucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccgucuuuuuccugcuuaucaugggacagcugacauggaacgaucucauucggcugugcaucauggugggcgccaaugcuagcgacagaaugggcauggggaccaccuaccuggcccuuauggcgacauuuaagaugcgcccuauguucgcugucggacugcucuuuagacggcugacgucccgcgaggugcuccugcuuaccauuggccugucucucguggccagcgucgaacugcccaacucccuggaggaacuuggggauggacuggccaugggcaucaugauccucaaacugcucacagacuuccagagccaucaacugugggcuacccuucugucucucacauuuauuaagaccacguucucccugcacuaugccuggaagacaauggcuaugguucugagcaucgugucucuuuuuccccugugucucuccaccaccagccagaaaacaaccuggcugccugugcuccuggggucucuuggaugcaagccgcugacaauguuccugauugccgagaauaaaaucuggggcagaaaguccuggccccucaacgaaggcauuauggcggucgggaucgugagcauccugcuuuccagccugcucaaaaacgauguuccucuggccggaccccucauugcuggcgggaugcugaucgccuguuacgugauuucuggaagcuccgcugaccuuucucuggagaaggccgccgaggucagcugggaagaggaagcugagcauuccggcgcgucucacaauauccugguggaaguucaggaugacgggacgaugaaaauuaaggaugaggagcgggacgauacccucacaauccugcuuaaggccacccugcucgcugugagcggagucuauccucuguccauccccgccacacucuucgugugguacuuuuggcagaaaaagaaacaacgcucuggcguccugugggacaccccuuccccucccgaaguggagagagccguucuugaugacggcauuuaucggaucaugcagcgcgggcugcugggaagaucccaggugggcgucgggguguuccaggaaaacguuuuucauacgauguggcacgugacccggggagcuguccucauguaccaaggcaagcgccuggagcccagcugggccucugugaaaaaggaccuuauuuccuacgggggaggcuggagacugcagggcagcuggaauacaggggaggaagugcagguuaucgcggucgagcccggaaagaacccuaaaaaugugcagaccgcucccggcacauucaagaccucugaaggggaggugggagccauugcccucgauuuuaaaccgggcacauccgggagcccuaucgucaaccgggaaggaaagauugugggccuguauggcaaugggguugugacgaccuccggaacauacgucucugcuaucgcccaagcgaaagcuagccaggagggcccccucccugagaucgaagacgagguguucagaaagcgcaaccugaccauuauggaucuucaccccggguccggaaagacccggagauaucugcccgccaucguucgcgaagccauuaaacggaagcugagaacacucauccuggcuccuacgcgcguggucgccagcgagauggcugaagcccuuaaaggcaugccgauucgguaccagaccacagcggugaagucugagcauaccgggaaagagaucguugaccugaugugccacgccacauuuaccaugagacuccugucccccgugcgcgucccuaauuauaacaugaucauuauggaugaagcucauuucacggaccccagcucuaucgccgcucggggcuacauuagcacaagagugggaaugggcgaggccgccgcuaucuuuaugaccgcgaccccucccggguccguggaagccuucccucaaucuaaugcugucauucaggaugaggaacgggacaucccggagcgcagcuggaacuccggauaugaguggaucacagauuuucccggcaagaccguuugguucgugccuucuauuaagagcgggaaugacaucgccaacugucugcgcaagaauggaaagcgggugauucagcucucccgcaaaacauucgauaccgaauaccagaagacgaaaaacaacgacugggacuacgucgugacaaccgauaucagcgagaugggcgccaauuuuagagcugaccggguuauugaucccagacgcugccuuaagccugugauccugaaggacgggcccgaacgggucauucuggccggcccgaugccugugacaguugcgucugcugcccaaagacgcggacggaucggcagaaaccacaauaaagagggggaucaguauaucuacaugggacagccccucaacaaugacgaggaucaugcccacuggaccgaagcuaagaugcugcuugacaacauuaauacgcccgagggcaucauuccugcccuguucgaacccgagcgcgaaaaauccgcggccaucgauggggaguaucggcucagaggagaggcucgcaagaccuuuguggaacugaugagacggggcgaccugccugucuggcucagcuacaaaguggccuccgagggguuccaguauucugaucgcagauggugcuuugacggcgaacggaacaaucaaguccuugaggaaaacauggauguggagauuuggacaaaggagggagaacgcaaaaagcugagaccgcgguggcuggacgcuagaaccuacagcgacccccucgcccugcgcgaguucaaggaauuugcugccggccggagauccguuucuggggaucuuauccuggagaucggaaaacucccucagcaccugacacagcgcgcgcagaaugcccuggacaaccucgugaugcuucauaauagcgaacaaggcgggcgggcuuauagacacgccauggaggagcugcccgauaccauugaaacacugaugcuccuggcucuuaucgccgugcugaccggaggcgucacgcuguucuuucuguccggccgggggcugggaaagacaagcauuggccuccuuuguguuauggccucuuccgugcugcuguggauggcuagcguggagccucauuggaucgcggccucuauuauccucgaguucuuucugaugguccuucugauccccgagccggaccgccagagaaccccucaggauaaccagcucgcuuacgugguuauugggcugcuguucaugauccucaccguggccgccaaugagaugggacuucuggaaacaaccaaaaaggaccugggcauugggcacgcugccgucgagaaccaccaucacgcggccaugcucgauguggaccugcaucccgcuuccgccuggacacuuuacgcugucgccacgaccaucauuacaccuaugaugcggcacaccaucgaaaacacaaccgcgaauauuagccugacggccaucgcuaaccaagccgcuauccucaugggacuggauaaaggcuggcccauuucuaagauggacaucggcgugccucugcucgcccuugggugcuauagccagguuaauccccugacccugacagcugccgugcucaugcuggucgcgcauuacgccauuaucggaccgggccuucaggcuaaggccacccgcgaggcucagaagagaacagccgccgggauuaugaagaacccuaccguggauggaaucguugcgaucgaccuggaucccguggucuaugacgcuaaauuugaaaagcagcucggccagauuaugcugcugauccucuguacgucccagauucuucugaugcggacaaccugggcccugugcgagucuaucacacucgcuaccgggccccugaccacacuuugggagggaagcccuggcaaauucuggaauacgaccauugccguguccauggccaacaucuuccgcggcagcuaccuggcuggggccggacucgcguuuucccugaugaagucucugggcgggggaagacggggcacaggggcccaaggagaaacccucggcgagaaguggaaacgccagcuuaaucagcugagcaaguccgaguucaacacauauaaaagaucuggcaucauggagguggaccggagcgaagcuaaggaggggcugaaaagaggagagaccacgaagcacgccguuucccgcggcacagcuaagcuccggugguuugucgaaagaaaucuggugaaaccggaggggaaggugauugaucuuggauguggccgcgggggauggucuuacuauugcgccggccugaaaaaggucaccgaaguuaaaggcuacaccaaagggggacccggccacgaggaaccuauccccauggcgacauacggguggaaccucgugaaacugcauagcggaaaggacguguucuuuauuccucccgagaagugugauacccugcucugcgacaucggcgaguccagcccuaauccgacaauugaagaggggcggacgcuuagaguccugaaaaugguggaacccuggcugcgcggaaaccaguucuguaucaagauucucaauccuuauaugcccucuguuguggagacccuggagcaaaugcagcggaaacacggcggcaugcuugucagaaacccucugucccgcaauagcacacaugaaauguacugggugucuugcgggaccggaaacaucguuuccgccgugaauaugacaagccggaugcuccugaacagauuuaccauggcucaccgcaagcccacguaugagcgggaugucgaccugggcgccgggaccagacacguggcuguggaaccggaggucgccaaccucgauaucauuggacagcgcaucgaaaauauuaaacaugagcacaagucuacauggcauuacgacgaggauaacccuuauaagaccugggcuuaccacggcuccuaugaaguuaaacccagcggguccgccagcucuauggugaauggaguggucaagcugcuuacaaaacccugggacgugaucccuaugguuacccagauugcgaugacagauaccacgcccuucggccaacagagaguguuuaaggagaaagucgacacacggaccccuaaggccaagcgcggcaccgcucagaucauggaagugacagccaaauggcuguggggguuccucagcagaaacaagaaaccgcggaucuguacgagagaggaauuuacccggaagguucgcuccaaugcugccauuggagccguguucgucgacgagaaccaauggaacucugcgaaagaggcuguggaagaugagagauuuugggaccugguucaucgggaacgcgagcuucacaagcagggcaagugcgccacaugcguguacaacaugauggggaaaagagaaaagaaacugggagaguucggcaaggccaaagggagccgggcuaucugguacauguggcucggcgcccgcuuccuggaguuugaagcucugggauucaugaaugaggaucacugguuuuccagagaaaacucucucagcggcgucgagggggagggacugcauaaacuuggcuauauucugcgggacaucuccaaaauucccgggggaaauauguacgccgaugacaccgcgggcugggauacacgcaucaccgaagacgaucuccagaacgaggccaagaucacagacauuauggaaccugagcacgcucugcuugccaagucuaucuucaaacugaccuaucagaauaagguggucagagugcaacggcccgcuaaaaacgggacgguuauggaugugauuagccgcagagaccagcggggcuccggacaggucggcaccuacgggcucaauacauuuaccaacauggaagcccagcugauccgccaaauggagagcgagggaauuuucucuccuuccgaacuggagacacccaaccucgcgggcagagugcuggauuggcuugaaaagcaugggguggagcggcugaaaagaauggccaucagcggagacgacuguguugugaagccgaucgaugaccgcuuugcuaccgcccucacggcucugaaugauaugggcaagguccggaaagacauuccucagugggaacccucuaagggguggaacgauuggcaacaggugccuuucugcucccaccacuuucaucaacuuaucaugaaagacggcagagagauuguugugcccugucgcaaucaggaugagcuggucggacgggccagagugagccagggcgcuggguggucccuccgcgaaacagccugccugggaaagucuuaugcgcagauguggcaacugauguacuuccaccggagagaccuccgccuggccgcuaacgccaucuguagcgccgucccuguggauuggguucccaccucccggacaaccuggagcauucaugcucaccaucaguggaugacgaccgaggacaugcuuucuguguggaauagagucuggaucgaagagaacccguggauggaagauaaaacacacauuuccagcuggggcgacgugccuuaucuggggaagcgcgaggaccaguggugcggaucucucaucggccugaccgcccgggcgacaugggcuaccaauauccaaguugccauuaaccaggugagacggcuuaucgggaaugagaacuaccuggauuacaugacaagcaugaagagauuuaaaaaugaauccgaccccgagggcgcccucugguga

SEQ ID NO: 18829 - RNA, 9879 nt, Artificial Sequence
  derived and/or modified CDS sequence (opt5) from DENV-1__EU677155__SS-prME
agcgugaccaugcugcucaugcugaugcccacagcccuugcuuuccaccugacgaccagaggcggggaaccucauaugaucgucuccaagcaggaacggggaaaaucucuccuguuuaagaccagcgccggcguuaacaugugcacccuuaucgcgauggaccugggggaacucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccagacggccggaccuuggcaucucggcaaacuggagcuugauuuugaccugugcgaagggaccacagugguuguggaugagcacugcggaaaccggggccccagccucagaaccacaaccgucacgggcaagaucauccacgaaugguguugccgguccuguacacugccuccccugcgcuucagaggggaggacggaugcugguauggcauggagauucggccggugaaagaaaaggaggaaaaucuuguuaagagcauggugucugcgggguccggagaggucgacagcuuuucccucggccugcuguguaucucuauuaugaucgaagaggugaugagaagccgcuggucccggaaaaugcucaugaccgggacacuggcuguuuucuuucuucugauuaugggacagcucaccuggaacgaucugaucagacugugcauuauggugggcgccaaugccucugaccgcaugggcauggggaccacauaccuugcucugauggccacguucaagaugagaccuauguuugcggucggacuccuguuccggcgccucaccagcagagaggugcugcuucugacaaucggccucucccugguggcuucugucgaacugcccaacagccuugaggaacugggggauggacucgccaugggcaucaugauucugaaacuccugaccgacuuucaaucccaucagcuuugggccacacugcucagccugaccuucaucaagacgacauuuucucugcacuaugcuuggaaaaccauggccaugguucuuuccauugugagccuguucccccucugucugucuaccacaucccagaagaccacauggcucccugugcugcuugggagccugggaugcaagccgcugacgauguuucucaucgcugagaauaaaauuuggggccggcgcucuuggccccugaacgaaggcaucauggccgucgggaucguguccauucuucugagcucccuccugaagaacgauguuccucucgcgggaccccugaucgccggcgggaugcuuauugcuuguuacgugaucagcggaucuagcgccgaccugucccuggagaaagcugccgaggucucuugggaagaggaagccgagcauagcggcaccucccacaauauucucguggaaguucaggaugacgggacaaugaagaucaaagaugaggagagagacgauacccugacaauccuucugaaggcuacccuccuggcggugucuggagucuauccucucagcauucccgccacgcuguucgugugguacuucuggcagaagaagaagcagcgguccggcguccuuugggacaccccuucucccccggaaguggagcgcgcuguucuggaugacggcaucuauagaauuaugcagcgggggcugcucggacgcagccaggugggcgucgggguguuucaagaaaacguuuuccauacaauguggcacgugaccagaggagccguccugauguaccagggcaaacggcuugagccuuccugggccagcgugaagaaagaccugaucucuuacgggggaggcuggagacuccagggcuccuggaauacaggggaggaagugcagguuauugcugucgagcccggaaagaacccuaaaaaugugcaaaccgcccccggcacauuuaagacgccggaaggggaggugggagcgaucgcucuggauuucaagccuggcaccagcgggucucccauugucaaccgcgaaggaaaaaucgugggccucuauggcaaugggguugugacaaccuccggaaccuacgucagcgccaucgcccaggcuaaggccucccaggagggcccucugcccgagauugaagacgagguguuucggaaaagaaaccuuacaaucauggaucugcaccccgggucuggaaagacgcgccgguaucugccugcgauuguuagagaagcuaucaaacgcaagcuccggacccugauucuugccccgacaagaguggucgccagcgagauggcugaagcccugaagggcaugcccauccgcuaccaaaccacagcugugaaauccgagcauaccgggaaggagaucguugaccucaugugccacgccacguucacaaugcggcugcugagcccugugagaguccccaauuauaacaugauuaucauggaugaagcgcauuuuaccgacccuucuuccauugccgcucggggcuacaucagcacccgcgugggaaugggcgaggccgcugccauuuucaugacagccacacccccugggucuguggaggcuuuuccgcagagcaaugcggucauccaggaugaggaaagagacauccccgagcgguccuggaacucuggauaugaguggauuacagauuucccuggcaaaaccguuugguuugugcccagcaucaaguccgggaaugacauugccaacugucuccgcaaaaauggaaagagagugauccagcuuucucggaagacguucgauacagaauaccagaaaaccaagaacaacgacugggacuacgucgugacaaccgauauuagcgagaugggcgcuaauuucagagccgaccgcguuaucgauccucggagaugccugaaacccgugauucugaaggacgggccggaacgcgucauccucgccggcccuaugcccgugacgguugcuuccgccgcgcagcggagaggacgcaucggccggaaccacaauaaagagggggaucaguauauuuacaugggacagccccugaacaaugacgaggaucaugcucacuggaccgaagccaagaugcuucuggacaacaucaauacaccugagggcauuauccccgcccucuuugaaccugagagagaaaagagcgcugccauugauggggaguaucgccugagaggagaggcgcggaaaaccuucguggaacugaugcgcagaggcgaccucccggucuggcuuucuuacaagguggccuccgagggguuucaauauagcgaucggcgcuggugcuucgacggcgaaagaaacaaucagguccuggaggaaaacauggauguggagaucuggacaaaagagggagaacggaagaaacugagaccccgcuggcucgacgcucggaccuacuccgacccucuggcccuuagagaguuuaaggaguucgcugccggccgccggucuguuagcggggaucugauccucgagauuggaaaacugccccagcaccugacacagagagcucaaaaugcccucgacaaccuugugaugcugcauaauuccgaacagggcgggcgggcguaucgccacgccauggaggagcugccugauaccaucgaaacgcucaugcugcuugcucugauugccgugcucacaggaggcgucacccuguuuuuccugucuggcagagggcucggaaagaccagcaucggccuucuguguguuauggcuuccagcgugcugcucuggauggccucuguggagccccauuggauugccgcuuccaucauccuggaauuuuuccuuaugguccugcucauuccggagccugaccggcagcgcacaccccaggauaaccaacuggcguacgugguuaucgggcugcucuuuaugauucuuaccguggccgcuaaugagaugggacugcuggaaacaacgaagaaagaccucggcaucgggcacgucgccguggagaaccaccaucacgccgcuaugcuggaugucgaccuucauccugccagcgcguggacccuguacgccguggcuacaaccauuaucacacccaugaugagacacaccauugaaaacacgaccgccaauaucucucucacagcuaucgccaaccaggcggccauucugaugggacuggauaagggcuggccuaucuccaaaauggacauuggcguuccccuccuugcucuggggugcuauagccaggugaauccgcugacccucacagccgcuguccugaugcuuguggcccauuacgcuaucauuggaccuggccugcaagccaaggcgacccgggaggcccagaaacgcacggcugccgggaucaugaagaaccccacaguugauggaaucguggcuauugaccucgaucccgucguguaugacgccaaguucgaaaaacagcugggccagaucaugcugcucauucuuuguaccucucaaauccugcugaugagaacaaccugggcccucugcgagagcauuacccuggcgacagggccucuuacgacccugugggagggauccccgggcaaguuuuggaauacaaccaucgcugugucuauggccaacaucuuccggggcagcuaccucgcuggggccggacuggccuucucccugaugaaaagccucggcgggggacgcagaggcacaggggcucagggagaaacccuuggcgagaaguggaaacggcagcugaaucagcuguccaagucugaauuuaacacguauaagagaagcggcauuauggagguugaccgcuccgaagccaaagaggggcucaagcggggagagacaaccaaacacgcggucucuagaggcaccgccaagcugcgcugguucguggaacggaaucuugugaaacccgaggggaaggucaucgaucugggauguggcagagggggauggagcuacuauugcgcuggccucaagaaaguuacagaagugaagggcuacaccaaagggggaccuggccacgaggaacccauuccuauggccacauacggguggaaccuggugaagcugcauuccggaaaagacgucuuuuucauucccccugagaagugugauacgcuccuuugcgacauuggcgagucuagcccgaaucccaccaucgaagaggggcgcacacugcgggugcugaaaaugguugaaccuuggcucagaggaaaccaauuuuguauuaagauccugaaucccuauaugccuuccguggucgagacccuugagcagaugcagcgcaagcacggcggcaugcuggugcggaacccccucagcagaaauucuacacaugaaauguacuggguuuccugcgggaccggaaacaucgugagcgcugucaauaugacgucucgcaugcugcugaaccgguucaccauggcccacagaaaaccgacauaugagcgcgauguggaccucggcgcggggaccagacacguggccgucgaaccugagguugcuaaccuggauauuaucggacagcggauugaaaauaucaagcaugagcacaaauccacauggcauuacgacgaggauaaccccuauaagaccugggccuaccacggcagcuaugaagugaaacccucuggguccgcuagcuccauggugaauggagucgugaaacuucugacaaagccuugggacguuauucccauggugacccaaaucgccaugacggauacaaccccuuuuggccagcagcgcgucuucaaagagaagguggacaccagaacaccgaaagcuaagcggggcacggcccaaaucauggaaguuaccgcgaaauggcucuggggguuucugagcagaaacaagaagccccggauuuguacacgcgaggaguucaccagaaaagugcggucuaaugccgcuaucggagccgucuuuguggacgagaaccaguggaauagcgcuaaggaggccguugaagaugagcgcuucugggaccuugugcauagagaacgggagcugcacaaacagggcaagugcgccacaugcgucuacaacaugauggggaaacgcgaaaagaagcucggagaguuuggcaaagcgaagggguccagagcuauuugguacauguggcugggcgcccgguuccuggaguucgaagcccucggauuuaugaaugaggaucacugguucucucgcgaaaacagccuguccggcguggagggggagggacuucauaaacugggcuauauccucagagacauuucuaagaucccugggggaaauauguacgcugaugacaccgccggcugggauacacggaucaccgaagacgaucugcagaacgaggcucgcauuacggacaucauggaacccgagcacgcccuucuggcggggagcauuuuuaaacucaccuaucaaaauaaggucgugagaguucagcggccugccaaaaacggcacagugauggaugucaucucccgcagagaccagcggggaucuggccagguggggaccuacggacugaauacauucaccaacauggaagcucaacugauuagacagauggagagcgagggcaucuuuucccccagcgaacucgagacgccgaaccuggccgaacgcgugcuugauuggcuggagaaguaugggguugaacggcucaagagaauggcuaucucuggagacgacuguguggucaaaccuauugaugaccgcuucgccacagcgcugaccgcccuuaaugauaugggcaaggugcggaaagacaucccccagugggagccuuccaagggguggaacgauuggcagcaaguucccuuuugcagccaucacuuccaccagcugauuaugaaagacggcagagagaucguggucccuugucgcaaucaggaugaacucgugggacgggcuagagucucucagggcgccggguggucccugcgcgagacagcuugccugggaaagagcuacgcccaaauguggcagcucauguauuuucaucggagagaccugcgccuugcugccaacgcgauuuguuccgccgugcccguugauuggaucccgaccucucggacgaccuggagcauucacgcucaucaccaguggaugacaaccgaagacaugcuguccguguggaauagagucuggaucgaggaaaacccuuggauggaggauaagacacauaucagcucuuggggcgacgugcccuaccucgggaaacgggaggaccaauggugcggaucccugauuggccuuaccgccagagccacaugggcuaccaauauccagguugccauuaaccaggugcgccggcugaucgggaaugaaaacuaccucgauuauaugacgagcaugaagagauucaaaaaugagucugaccccgaaggcgcgcugugguga

SEQ ID NO: 18830 - RNA, 9879 nt, Artificial Sequence
  derived and/or modified CDS sequence (opt5) from DENV-1__EU677157__SS-prME
agcgugaccaugcugcugaugcugaugcccacagcccuugcuuuccaccugacgaccagaggcggggaaccucauaugaucguguccaagcaggaacggggaaaaucucuccuguuuaagacaagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcacccucgucgauagaggcuggggcaauggguguggacuguuuggcaaagggucucuuauuacaugcgcuaaguucaagugcgugacgaaacuggagggaaagaucguucaguacgaaaaccucaaauauuccgugaucgucaccgugcacacaggcgaccagcaucaaguugggaaugagagcaccgaacacggaacaaccgccacgauuacaccccaagcuccuaccaccgagauccagcugacagacuacggcgcccugacccucgauuguucuccccggacgggccuggacuuuaacgaaauggugcuucugacaaugaaggagaaauccuggcucguccauaagcagugguuccuggaucuuccucugcccuggaccagcggggccuccacaucucaagagaccuggaaucgccaggaccuccuggugaccuuuaaaacagcucacgcgaagaagcaggaagucgugguucugggaagccaagagggcgccaugcacacggcucucaccggggccacagaaauucagaccuccggaacaaccacgaucuucgccggccaucugaaaugcagacuuaagauggauaaacugacacucaaggggaugagcuaugugauguguaccggcucuuuuaaacuggagaaggaacuggcugagacccagcacggaacaguccuugugcagauuaaguacgagggcaccgacgccccgugcaaaaucccuuucuccacacaagaugaaaaggggguuacgcagaacggacggcucaucaccgcgaaucccauugugacagacaaagagaagccugucaacaucgaagcugagccgcccuucggcgagagcuauauugugaucggggccggagaaaaagcccugaagcugucuugguuuaagaaaggcagcuccauugggaagauguucgaggcuaccgccagaggcgcucgccggauggccauccucggagauacagcgugggacuuuggcucuaucgggggaguguucaccagcguuggcaaacugguccaucagauuuuugggacggccuacggagugcuuuucuccggcgugagcuggaccaugaagaucgggauuggcguccugcucacauggcugggacucaauucuagauccaccagccuuucuaugacauguaucgcugugggccucguuacccuguaccugggggugaugguccaggccgauuccggaugcgugauuaacuggaaaggccgcgaacucaagugugggagcggaaucuuuguuacaaaugaggugcacaccuggacggaacaauauaaguuccaggcugacuccccuaaacggcugucugccgcgauuggcaaggccugggaggagggggucugcggcaucagaagcgcuacacgccuugaaaacaucauguggaaacagauuuccaacgagcugaaucauauccuccuggaaaacgacaugaaguuuaccgugguugugggagaugucgccggcauucuggcucaggggaaaaagaugauccggccgcaacccauggaguacaaauauucuuggaaaagcuggggaaaggccaagauuaucggcgccgacgugcagaauaccacauucaucauugaugggccuaacacccccgaauguccugacgaucagagagcuuggaauaucugggagguggaggacuacggauuuggcauuuucacgacaaacaucuggcuuaagcuccgcgauuccuauacccaggucugcgaccaccggcugaugagcgcggccauuaaagauucuaaggcuguucacgccgacaugggcuacuggaucgaauccgagaaaaaugaaacauggaagcuggccagagcuagcuuuaucgaggugaagaccuguauuuggcccaaaucucauacacucugguccaacggggugcuggaaagcgagaugaucauuccgaagaucuauggaggcccuauuucucaacacaauuaccgccccggguacuucacccagacggccggaccuuggcaucuuggcaaacuggagcucgauuucgaccugugcgaagggaccacagucgugguugaugagcacugcggaaaccggggccccagccugagaaccacaaccgugacgggcaagaucauccacgaaugguguugccgguccuguacacuuccuccccuccgcuuuagaggggaggacggaugcugguauggcauggagauucggccggucaaagaaaaggaggaaaaucuggucaagagcaugguuucugcgggguccggagagguggacagcuucucccugggccuccuguguaucucuauuaugaucgaagaggucaugagaagccgcuggucccggaaaaugcuuaugaccgggacacuggcuguguuuuuccuccugauuaugggacagcugaccuggaacgaucuuaucagacugugcauuaugguuggcgccaaugccucugaccgcaugggcauggggaccacauaccucgcucugauggccacguuuaagaugagaccuauguucgcggugggacuccuguuucggcgccuuaccagcagagagguccugcuccugacaaucggccugucccuuguggcuucuguggaacugcccaacagccucgaggaacugggggauggacucgccaugggcaucaugauucugaaacuucugaccgacuuccaaucccaucagcucugggccacacugcugagccuuaccuuuaucaagacgacauucucucugcacuaugcuuggaaaaccauggccaugguccucuccauuguuagccuguuuccccucugucugucuaccacaucccagaagaccacauggcuuccugugcugcuggggagccucggaugcaagccgcugacgauguuccuuaucgcugagaauaaaauuuggggccggcgcucuuggccccugaacgaaggcaucauggccguggggaucgucuccauucuccugagcucccuccugaagaacgaugugccucuugcgggaccccugaucgccggcgggaugcugauugcuuguuacguuaucagcggaucuagcgccgaccucucccuggagaaagcugccgaggugucuugggaagaggaagccgagcauagcggcgcuucccacaauauucuugucgaagugcaggaugacgggaccaugaagaucaaagaugaggagagagacgauacacugaccauccuccugaaggcgacacuccuggccguuucuggaguguauccucuuagcauucccgcuacccuguuugucugguacuucuggcagaagaagaagcagcgguccggcgugcugugggacacgccuucucccccggaagucgagcgcgccgugcucgaugacggcaucuauagaauuaugcagcgggggcugcuuggacgcagccagguuggcgugggggucuuccaagaaaacguguuucauaccauguggcacguuacaagaggagccgugcugauguaccagggcaaacggcucgagccuuccugggcuagcgucaagaaagaccugaucucuuacgggggaggcuggagacuccagggcuccuggaauaccggggaggaaguccaggugauugccguugagcccggaaagaacccuaaaaauguccaaacagcgcccggcaccuucaagacaccggaaggggaggugggagcuaucgcccuggauuuuaagccuggcacgagcgggucucccauugugaaccgcgaaggaaaaaucgucggccuuuauggcaauggggugguuaccacauccggaaccuacgugagcgccaucgcucaggccaaggcgucccaggagggcccucugcccgagauugaagacgaggucuuccggaaaagaaaccugaccaucauggaucuccaccccgggucuggaaagacacgccgguaucugccugcuauugugagagaagccaucaaacgcaaacuucggacgcugauucucgccccgaccagaguuguggcuagcgagauggccgaagcucugaagggcaugcccauccgcuaccaaacaaccgccgucaaauccgagcauacagggaaggagaucguggaccugaugugccacgcgaccuuuacgaugcggcuccuuagcccuguuagagugcccaauuauaacaugauuaucauggaugaagcccauuucacagacccuucuuccauugcugcccggggcuacaucagcacccgcgucggaaugggcgaggcugccgccauuuuuaugaccgcuacacccccugggucuguggaagcguucccgcagagcaaugccgugauccaggaugaggaaagagacauccccgagcgguccuggaacucuggauaugaguggauuaccgauuuuccuggcaaaacagucugguucguucccagcaucaaguccgggaaugacauugcuaacugucugcgcaaaaauggaaagagagugauccagcugucucggaagaccuuugauacggaauaccagaagaccaagaacaacgacugggacuacguggucaccacagauauuagcgagaugggcgccaauuucagagccgaccgcgugaucgauccucggagaugccucaaacccguuauucugaaggacgggccggaacgcgugauccuugcuggcccuaugcccgucaccguggccuccgcggcucagcggagaggacgcaucggccggaaccacaauaaagagggggaucaguauauuuacaugggacagccccugaacaaugacgaggaucaugcccacuggacggaagccaagaugcuccuggacaacaucaauaccccugagggcauuauccccgcucuguucgaaccugagagagaaaagagcgccgcgauugauggggaguaucgccucagaggagaggcccggaaaacauuuguugaacuuaugcgcagaggcgaccugccgguguggcugucuuacaaggucgcuuccgagggguuccaauauagcgaucggcgcuggugcuuugacggcgaaagaaacaaucaggugcucgaggaaaacauggaugucgagaucuggaccaaagagggagaacggaagaaacugagaccccgcuggcuugacgcccggacauacuccgacccucuggcucucagagaguucaaggaauuugccgcuggccgccggucugugagcggggaucugauccuggagauuggaaaacucccccagcaccuuacccagagagcccaaaaugcgcuggacaaccugguuaugcuccauaauuccgaacagggcgggcgggccuaucgccacgcuauggaggagcugccugauacaaucgaaacccuuaugcugcucgcccugauugcugugcugacgggaggcgugacacucuucuuucuuucuggcagagggcugggaaagaccagcaucggccugcucugugucauggccuccagcguucugcuuuggauggccucuguggagccccauuggauugcugcguccaucauccuggaguucuuucucauggugcugcugauuccggagccugaccggcagcgcacaccccaggauaaccaacucgccuacgucgugaucgggcuucuguucaugauucugacaguugcugccaaugagaugggacuccuggaaaccacaaagaaagaccuuggcaucgggcacguggccgucgagaaccaccaucacgcugccaugcuggauguggaccuccauccugcgagcgccuggacgcuguacgcugucgccaccacaauuaucacccccaugaugagacacacaauugaaaacaccacggcuaauaucucucugaccgccaucgcgaaccaggccgcuauucucaugggacuugauaagggcuggccuaucuccaaaauggacauuggcgugccccugcuggcccucgggugcuauagccagguuaauccgcugacacuuaccgcugccgugcugaugcucgucgcucauuacgccaucauuggaccuggccugcaagcgaaggccacacgggaggcucagaaacgcaccgccgcugggaucaugaagaaccccacgguggauggaaucguugccauugaccuggaucccguggucuaugacgccaaguuugaaaaacagcucggccagaucaugcuucugauucuguguacaucucaaauccuccugaugagaaccacaugggcgcuuugcgagagcauuacccuggcuaccgggccucucacaacgcugugggagggauccccgggcaaguucuggaauaccacaaucgccgugucuauggcuaacaucuuucggggcagcuaccuggccggggccggacucgcuuucucccuuaugaaaagccugggcgggggacgcagaggcaccggggcccagggagaaacacugggcgagaaguggaaacggcagcucaaucagcuguccaagucugaguucaacaccuauaagagaagcggcauuauggagguggaccgcuccgaagcgaaagaggggcuuaagcggggagagacgacaaaacacgccguuucuagaggcaccgcuaagcugcgcugguuugucgaacggaaucucgugaaacccgaggggaaggugaucgaucugggauguggcagagggggauggagcuacuauugcgccggccugaagaaagucaccgaaguuaagggcuacacaaaagggggaccuggccacgaggaacccauuccuauggcuaccuacggguggaaccucgugaaacuucauuccggaaaagacguguucuuuauucccccugagaagugugauacacugcugugcgacauuggcgagucuagcccgaaucccacgaucgaagaggggcgcacccuccggguccugaaaaugguggaaccuuggcuuagaggaaaccaauucuguauuaagauccugaaucccuauaugccuuccguuguggagacacucgagcagaugcagcgcaagcacggcggcaugcugguccggaacccccugagcagaaauucuacccaugaaauguacuggguguccugcgggacaggaaacaucguuagcgccgugaauaugaccucucgcaugcuccugaaccgguuuacgauggcgcacagaaaaccgaccuaugagcgcgaugucgaccuuggcgccgggacaagacacguggcuguggaaccugaggucgccaaccuggauauuaucggacagcggauugaaaauaucaagcaugagcacaaauccaccuggcauuacgacgaggauaaccccuauaagacaugggcuuaccacggcagcuaugaaguuaaacccucuggguccgccagcuccauggugaauggaguggucaagcuccugaccaagccuugggacgugauucccaugguuacacaaaucgcuaugaccgauacgacaccuuucggccagcagcgcguguuuaaagagaaggucgacaccagaaccccgaaagccaagcggggcacagcgcaaaucauggaagugacggccaaauggcuuuggggguuccugagcagaaacaagaagccccggauuuguacccgcgaggaauuuacaagaaaaguucggucuaaugcugccaucggagcuguguucgucgacgagaaccaguggaauagcgccaaggaggccguggaagaugagcgcuuuugggaccucguucauagagaacgggagcugcacaaacagggcaagugcgcgaccugcguguacaacaugauggggaaacgcgaaaagaagcugggagaguucggcaaagcuaagggguccagagccauuugguacauguggcucggcgcccgguuucuggaguucgaagcucuuggauucaugaaugaggaucacugguuuucucgcgaaaacagccuguccggcgucgagggggagggacuccauaaacugggcuauauccuuagagacauuucuaagaucccugggggaaauauguacgccgaugacacagcuggcugggauacccggaucacagaagacgaucugcagaacgaggcccgcauuaccgacaucauggaacccgagcacgcgcuccuggccaaaagcauuuucaagcugacguaucaaaauaaaguggucagagugcagcggccugcuaagaacgggaccguuauggaugugaucucccgcagagaccagcggggcucuggacaggucggcacauacgggcucaauaccuuuacaaacauggaagcccaacugauuagacagauggagagcgagggaaucuucucccccagcgaacuugagaccccgaaccuggcuaagcgcgugcucgauuggcuggaaaaauauggcguggagcggcuuaagagaauggccaucucuggggacgacuguguugugaaaccuauugaugaccgcuuugcgacggcccugacagcucucaaugauaugggaaagguccggaaagacaucccccagugggaaccuuccaagggcuggaacgauuggcagcaagugcccuucugcagccaucacuuucaccagcugauuaugaaggacgggagagagaucguugugccuugucgcaaucaggaugagcuggucggccgggccagagugucucagggagcuggcuggucccuccgcgaaaccgccugccuggggaaaagcuacgcucaaauguggcagcuuauguauuuccaucggagagaccugcgccucgccgcgaacgccauuuguuccgcuguccccguggauuggaucccgacaucucggaccacguggagcauucacgcccaucaccaguggaugaccacagaggacaugcuguccguuuggaauagaguguggaucgaagagaacccuuggauggaagauaagacccauaucagcucuuggggagacguccccuaccuuggcaaacgggaggaccaauggugcgggucccugauuggacucacagccagagcuaccugggccacaaauauccagguggcgauuaaccagguucgccggcugaucggcaaugagaacuaccuggauuauaugaccagcaugaagagauuuaaaaaugaaucugaccccgagggggcucucugguga

SEQ ID NO: 18831 - RNA, 9879 nt, Artificial Sequence
  derived and/or modified CDS sequence (opt5) from DENV-1__EU677158__SS-prME
uccgugaccaugcugcucaugcugaugcccacagcccuugcuuuccaccugacgaccagaggcggggaaccucauaugaucgucuccaagcaggaacggggaaaaucucuccuguuuaagacaagcgccggcguuaauaugugcacccuuauugcgauggaccugggggagcucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuuccugacacaagaugaaaagggggugacgcagaacggacggcuuaucaccgcgaaucccauugucacagacaaagagaagccugugaacaucgaagcugagccgcccuuuggcgaguccuauauuaucauuggggccggagaaaaagcccucaagcugagcugguucaagaaaggcucuagcaucgggaagauguuugaggcuaccgccagaggcgcucgccggauggccauccugggagauacagcgugggacuucggcuccauugggggaguguuuaccucuguuggcaaacucguccaucagaucuucgggacggccuacggagugcuguuuagcggcguguccuggaccaugaagauugggaucggcguccuucugacauggcucggacugaauagcagaucuaccucccugagcaugacauguauugcugugggccuuguuacccucuaccugggggugaugguccaggccgauucuggaugcgugaucaacuggaaaggccgcgaacugaaguguggguccggaauuuucguuacaaaugaggugcacaccuggacggaacaauauaaguuucaggcugacagcccuaaacggcucuccgccgcgaucggcaaggccugggaggagggggucugcggcaucagaucugcuacacgccuggaaaacauuauguggaaacagaucagcaacgagcuuaaucauauucugcucgaaaacgacaugaaguucaccgugguugugggagaugucgccggcauccuggcucaggggaaaaagaugauucggccgcaacccauggaguacaaauauuccuggaagucuuggggaaaggccaaaaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaaacuucgcgauagcuauacccaggucugcgaccaccggcucauguccgcggccaucaaagauagcaaggcuguucacgccgacaugggcuacuggaucgaaucugagaaaaaugaaacauggaagcuggccagagcuuccuucauugaggugaagaccuguaucuggcccaaaagccauacacuguggucuaacggggugcucgaauccgagaugauuaucccgaagauuuauggaggcccuaucagccaacacaauuaccgccccggguacuucacccagacggccggaccuuggcaucugggcaaacuugagcuggauuuugaccucugcgaagggaccacagucgugguugaugagcacugcggaaaccggggccccucucugagaaccacaaccgugacgggcaagaucauucacgaaugguguugccggagcuguacacugccuccccuucgcuucagaggggaggacggaugcugguauggcauggagauccggccggucaaagaaaaggaggaaaaucucgugaaguccaugguuagcgcggggucuggagagguggacuccuuuagccugggccugcucuguauuuccaucauuaucgaagaggucaugagaucucgcuggagccggaaaaugcugaugaccgggacacuugcuguguucguucugcucauuaugggacagcugaccuggaacgaucugaucagacuuugcaucauggugggcgccaaugccuccgaccgcaugggcauggggaccacauaccuggcucucauggccacguuuaagaugagaccuauguucgcggucggacugcucuuucggcgccugaccucuagagaggugcuucugcucacaauuggccugagccugguggcuuccgucgaacuucccaacucucuggaggaacucggggauggacuggccaugggcaucaugauucucaaacugcuuaccgacuuccaaagccaucagcugugggccacacuccugucccugaccuuuaucaagacgacauucagccuucacuaugcuuggaaaaccauggccaugguucugucuauugugucccucuuuccccugugucucagcaccacaucucagaagaccacauggcugccugugcuucuggggucccugggaugcaagccgcucacgauguuccugaucgcugagaauaaaaucuggggccggcgcagcuggccccuuaacgaaggcauuauggccgucgggaucgugucuauucugcucuccagccugcucaagaacgauguuccucuggcgggaccccuuaucgccggcgggaugcugauugcuuguuacgugaucuccggaagcucugccgaccugagccucgagaaagcugccgaggucuccugggaagaggaagccgagcauucuggcgcuagccacaauauccugguggaaguucaggaugacgggaccaugaagauuaaagaugaggagagagacgauacacuuaccauccugcucaaggcgacacugcucgccguguccggagucuauccucugucuauucccgcuacccuuuuugugugguacuucuggcagaagaagaagcagcggagcggcguccugugggacacgccuagcccucccgaaguggagcgcgccguucuggaugacggcaucuauagaauuaugcagcgggggcuccugggacgcucucaggugggcgucgggguguuccaagaaaacguuuuucauaccauguggcacgugacaagaggagccguccuuauguaccagggcaaacggcuggagcccagcugggcuuccgugaagaaagaccucaucagcuacgggggaggcuggagacugcagggcucuuggaauaccggggaggaagugcagguuauugccgucgagcccggaaagaacccuaaaaaugugcaaacagcgcccggcaccuucaagacaccggaaggggaggugggagcuaucgcccucgauuuuaagccuggcacguccgggagccccaucgucaaccgcgaaggaaaaauugugggccuguauggcaaugggguugugaccacaucuggaaccuacgucuccgccaucgcucaggccaaggcgagccaggagggcccucuucccgagauugaagacgagguguuccggaaaagaaaccugaccaucauggaucugcaccccggguccggaaagacacgccgguaucucccugcuauuguuagagaagccaucaaacgcaagcugcggacgcuuauccuggccccgaccagaguggucgcuucugagauggccgaagcucucaagggcaugcccauucgcuaccaaacaaccgccgugaaaagcgagcauacagggaaggagaucguugaccugaugugccacgcgaccuuuacgaugcggcugcucuccccugugagaguccccaauuauaacaugauuaucauggaugaagcccauuucacagacccuagcucuauugcugcccggggcuacaucuccacccgcgugggaaugggcgaggcugccgccaucuuuaugaccgcuacacccccugggagcguggaagcguucccgcagucuaaugccgucauucaggaugaggaaagagacauccccgagcggagcuggaacuccggauaugaguggauuaccgauuuuccuggcaaaacaguuugguucgugcccucuaucaagagcgggaaugacauugcuaacugucuucgcaaaaauggaaagagagugauccagcugucccggaagaccuuugauacggaauaccagaagaccaagaacaacgacugggacuacgucgugaccacagauauuucugagaugggcgccaauuucagagccgaccgcguuaucgauccucggagaugccugaaacccgugauccucaaggacgggccggaacgcgucauucuggcuggcccuaugcccgugaccguugccagcgcggcucagcggagaggacgcaucggccggaaccacaauaaagagggggaucaguauauuuacaugggacagccccuuaacaaugacgaggaucaugcccacuggacggaagccaagaugcugcucgacaacaucaauaccccugagggcauuauccccgcucuguucgaaccugagagagaaaaguccgccgcgaucgauggggaguaucgccugagaggagaggcccggaaaacauuuguggaacucaugcgcagaggcgaccuuccggucuggcugagcuacaagguggcuucugagggguuccaauauuccgaucggcgcuggugcuuugacggcgaaagaaacaaucagguccuggaggaaaacauggauguggagauuuggaccaaagagggagaacggaagaaacucagaccccgcuggcuggacgcccggacauacagcgacccucuugcucugagagaguucaaggaauuugccgcuggccgccgguccguuucuggggaucucauccuggagauuggaaaacugccccagcaccucacccagagagcccaaaaugcgcuugacaaccuggugaugcugcauaauagcgaacagggcgggcgggccuaucgccacgcuauggaggagcucccugauacaaucgaaacccugaugcuucuggcccucauugcugugcugacgggaggcgucacacuguucuuucucuccggcagagggcuuggaaagaccucuaucggccugcuguguguuauggccagcuccgugcuccuguggauggccagcguggagccccauuggaucgcugcgucuauuauccuugaguucuuucugaugguccuccugauuccggagccugaccggcagcgcacaccccaggauaaccaacuggccuacgugguuaucgggcuccuuuucaugauucugacaguggcugccaaugagaugggacugcucgaaaccacaaagaaagaccugggcaucgggcacgucgccguggagaaccaccaucacgcugccaugcuugaugucgaccugcauccugcguccgccuggacgcucuacgcuguggccaccacaauuaucacccccaugaugagacacacaaucgaaaacaccacggcuaauauuagccugaccgccaucgcgaaccaggccgcuauucugaugggacucgauaagggcuggccuaucucuaaaauggacauuggcguuccccuucuggcccuggggugcuauucccaggugaauccgcucacacugaccgcugccguccuuaugcugguggcucauuacgccaucaucggaccuggccuccaagcgaaggccacacgggaggcucagaaacgcaccgccgcugggauuaugaagaaccccacgguugauggaaucguggccauugaccuggaucccgucguguaugacgccaaguuugaaaaacagcugggccagaucaugcuccuuauucuguguacaagccaaauccugcucaugagaaccacaugggcgcugugcgagucuaucacccuugcuaccgggccucugacaacgcucugggagggaagcccgggcaaguucuggaauaccacaauugccguguccauggcuaacaucuuucggggcucuuaccuggccggggccggacuggcuuucagccucaugaaaucccuuggcgggggacgcagaggcaccggggcccagggagaaacacugggcgagaaguggaaacggcagcugaaucagcucagcaaguccgaguucaacaccuauaagagaucuggcauuauggagguugaccgcagcgaagcgaaagaggggcugaagcggggagagacgacaaaacacgccgucuccagaggcaccgcuaaacuucgcugguuuguggaacggaaucuggugaaacccgaggggaaggucaucgaucucggauguggcagagggggauggucuuacuauugcgccggccugaagaaaguuaccgaagugaagggcuacacaaaagggggaccuggccacgaggaacccauuccuauggcuaccuacggguggaaccuggugaagcuccauagcggaaaagacgucuucuuuauucccccugagaagugugauacacuucugugcgacaucggcgaguccucuccgaaucccacgaucgaagaggggcgcacccugcgggugcucaaaaugguugaaccuuggcugagaggaaaccaauucuguaucaagauucuuaaucccuauaugccuagcguggucgagacacuggagcagaugcagcgcaagcacggcggcaugcucgugcggaacccccuguccagaaauagcacccaugaaauguacuggguuucuugcgggacaggaaacaucguguccgccgucaauaugaccagccgcaugcugcucaaccgguuuacgauggcgcacagaaaaccgaccuaugagcgcgauguggaccugggcgccgggacaagacacguggcugucgaaccugagguugccaaccuugauauuaucggacagcggauugaaaauaucaagcaugagcacaaaucuaccuggcauuacgacgaggauaaccccuauaagacaugggcuuaccacggcuccuaugaagugaaacccagcgggucugccuccagcauggugaauggagucgugaagcugcucaccaagccuugggacguuauccccauggugacacaaauugcuaugaccgauacgacaccuuucggccagcagcgcgucuuuaaagagaagguggacaccagaaccccgaaagccaagcggggcacagcgcaaaucauggaaguuacggccaaauggcuguggggguuccuuuccagaaacaagaagccccggauuuguacccgcgaggaauuuacaagaaaagugcggagcaaugcugccaucggagcugucuucguggacgagaaccaguggaacucugccaaggaggccguugaagaugagcgcuuuugggaccuggugcauagagaacgggagcuccacaaacagggcaagugcgcgaccugcgucuacaacaugauggggaaacgcgaaaagaagcugggagaguucggcaaagcuaaggggagcagagccauuugguacauguggcugggcgcccgguuucucgaguucgaagcucugggauucaugaaugaggaucacugguuuucccgcgaaaacucucuuagcggcguggagggggagggacugcauaaacucggcuauauccugagagacaucuccaagauuccugggggaaauauguacgccgaugacacagcuggcugggauacccggaucacagaagacgaucuucagaacgaggcccgcauuaccgacaucauggaacccgagcacgcgcugcucgccaaaucuauuuucaagcugacguaucaaaauaaagucgugagaguucagcggccugcuaagaacgggaccgugauggaugucaucagccgcagagaccagcggggcuccggacaggugggcacauacgggcugaauaccuuuacaaacauggaagcccaacucaucagacagauggagucugagggaauuuucagccccuccgaacuggagaccccgaaccuugcugaacgcgugcuggauuggcucgagaaguauggcguugaacggcugaaaagaauggccaucagcggggacgacuguguggucaagccuauugaugaccgcuuugcgacggcccuuacagcucugaaugauaugggaaaagugcggaaggacaucccccagugggagccuucuaaaggcuggaacgauuggcagcaaguucccuucugcucccaucacuuucaccagcucauuaugaaggacgggagagagaucguggucccuugucgcaaucaggaugaacuggugggccgggccagagucagccagggagcuggcuggucucugcgcgagaccgccugccucgggaaguccuacgcucaaauguggcagcugauguauuuccaucggagagaccuucgccuggccgcgaacgccauuuguagcgcugugcccguugauuggaucccgacaucccggaccacguggucuauccacgcccaucaccaguggaugaccacagaagacaugcucagcguguggaauagagucuggauugaggaaaacccuuggauggaggauaaaacccauaucuccagcuggggagacgugcccuaccugggcaagcgggaggaccaauggugcgggucucuuauuggacugacagccagagcuaccugggccacaaauauccagguugcgauuaaccaggugcgccggcucaucggcaaugaaaacuaccuggauuauaugaccuccaugaaaagauuuaagaaugagggggaccccgaaggcgcucugugguga

SEQ ID NO: 18832 - RNA, 9879 nt, Artificial Sequence
  derived and/or modified CDS sequence (opt5) from DENV-1__EU677159__SS-prME
agcgugaccaugcugcucaugcugaugcccaccgcccuugcuuuccaccugacgaccagaggaggggaaccucauaugaucguguccaagcaggaacggggaaagucucuccuguuuaagaccagcgccggcguuaacaugugcacccuuauugcgauggaccugggggaacucugugaagauacaaugaccuacaaaugcccccgcaucacagaggcugaacccgacgauguggacuguuggugcaaugccaccgauacgugggugaccuauggaacauguucccagaccggcgagcacagacgggacaagcgcucuguggcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaagcucacaguuguggucggagauguggcuggcauucuggggcagggcaagaaaaugauccggccgcaacccauggaguacaaauauucuuggaaaagcuggggcaaggccaagauuaucggggccgacgcucagaauaccaccuucaucauugauggaccuaacacacccgaauguccugacgaucagagagcguggaauaucugggagguggaggacuacggcuuuggcauuuucaccacgaacaucuggcugaaacuucgcgauuccuauacacaggucugcgaccaccggcucaugagcgccgcuauuaaagauucuaaggccguucacgccgacaugggguacuggaucgaauccgagaaaaaugaaaccuggaagcuggcuagagccagcuuuaucgaggugaagacauguauuuggcccaaaucucauacccugugguccaacggagugcucgaaagcgagaugaucauuccgaagaucuauggcgggccuauuucucaacacaauuaccgccccggauacuucacacagaccgcgggcccuuggcaucuggggaaacuugagcuggauuucgaccucugcgaaggaacgaccgucgugguugaugagcacugcggcaaccggggccccagccugagaacaaccacagugaccgggaagaucauccacgaaugguguugccgguccuguacgcugccuccccuucgcuuuagaggagaggacggcugcugguaugggauggagauucggccggucaaagaaaaggaggaaaaucucgucaagagcaugguuucugcuggauccggcgagguggacagcuucucccuggggcugcucuguaucucuauuaugaucgaagaggucaugagaagccgcuggucccggaaaaugcugaugacaggaacccuugccguguuuuuccugcucauuaugggccagcugacauggaacgaucugaucagacuuugcauuaugguuggcgccaaugcuucugaccgcauggggaugggaaccaccuaccuggcccucauggcgacauuuaagaugagaccuauguucgcugugggccugcucuuucggcgccugacgagcagagagguccuucugcucaccaucgggcugucccugguggccucuguggaacuucccaacagccuggaggaacucggagauggccuggccauggggaucaugauucucaaacugcuuacagacuuccaaucccaucagcugugggcuacccuccugagccugacauuuaucaagaccacguucucucuucacuaugccuggaaaacaauggcuaugguccuguccauuguuagccucuuuccccugugucucucuaccaccucccagaagacaaccuggcugccugugcuucugggaagccugggcugcaagccgcucacaauguuccugaucgccgagaauaaaauuuggggccggaagucuuggccccuuaacgaagggaucauggcggugggaaucgucuccauucugcucagcucccugcucaaaaacgaugugccucuggccggcccccuuaucgcugggggaaugcugauugccuguuacguuaucagcggcucuagcgcugaccugucccucgagaaggccgccgaggugucuugggaagaggaagcugagcauagcggggcgucccacaauauucuggucgaagugcaggaugacggaacgaugaaaaucaaggaugaggagcgcgacgauacccuuacaauccugcucaaagccacccugcucgcuguuucuggcguguauccuauuagcauccccgccacacuguuugucugguacuucuggcaaaagaagaaacagagauccggcgugcuuugggacaccccuucucccccggaagucgagcgggccgugcuggaugacgggauuuaucgcaucaugcagagaggacugcucggccggagccagguuggggugggagucuuccaagaaaacguguuucauacgauguggcacguuacccgcggcgcugugcugauguaccaggggaagagacuugagccuuccugggccagcgucaaaaaggaccugauuucuuacggaggcggcuggcggcucagaggguccuggaauacaggagaggaaguccaggugaucgcgguugagcccggcaaaaacccuaagaauguccagaccgcucccgggacauucaagaccccggaaggagaggugggcgccauugcccuggauuuuaaaccugggacaagcggaucucccaucgugaaccgcgaaggcaagaucgucggccucuaugggaauggagugguuacgaccuccggcacauacgugagcgcuauugcccaagcgaaggcuucccaggaggggccucugcccgagaucgaagacgaggucuuccggaagagaaaccuuaccauuauggaucugcaccccggaucuggcaaaacccgccgguaucugccugccaucgugagagaagccauuaagcgcaagcuccggacacugauccuugcuccgacgagaguuguggccagcgagauggcugaagcccugaaagggaugcccauccgcuaccagaccacagcggucaaguccgagcauaccggcaaagagauuguggaccucaugugccacgccacauuuaccaugcggcugcugagcccuguuagagugcccaauuauaacaugaucauuauggaugaagcucauuucacggacccuucuuccaucgccgcucggggauacauuagcacacgcgucggcaugggggaggccgccgcuaucuuuaugaccgcgacacccccuggaucuguggaagccuucccgcaaagcaaugcugugauccaggaugaggaaagagacauucccgagcgguccuggaacucuggcuaugaguggaucacagauuuuccugggaagaccgucugguucguucccagcauuaaauccggaaaugacaucgccaacugucuccgcaagaauggcaagagagugauucagcuuucucggaaaacauuugauaccgaauaccagaagacgaaaaacaacgacugggacuacguggucacaaccgauaucagcgagaugggggccaauuucagagcugaccgcgugauugauccucggagaugccugaagcccguuauccugaaagacggcccggaacgcgugauccucgccggaccuaugcccgucacaguggcguccgcugcccaacggagaggccgcauugggcggaaccacaauaaggagggagaucaguauaucuacaugggccagccccugaacaaugacgaggaucaugcccacuggaccgaagcuaagaugcuucuggacaacauuaauacgccugaggggaucauucccgcccucuucgaaccugagagagaaaagagcgcggccguugauggagaguaucgccugagaggcgaggcucggaagaccuuuguggagcugaugcgcagaggggaccucccggucuggcuuucuuacaaaguggccuccgagggcuuccaguauagcgaucggcgcuggugcuuugacggagaaagaaacaaucaaguccuggaggaaaacauggauguggagaucuggacaaaggagggcgaacggaaaaagcugagaccccgcuggcucgacgcucggaccuacuccgacccucuggcccuuagagaguucaaagaauuugcugccgggcgccggucuguuagcggagaucugauccucgagauuggcaagcugccccagcaccugacacagagagcgcagaaugcccucgacaaccuugugaugcugcauaauuccgaacaagggggacgggcuuaucgccacgccauggaggagcugccugauaccaucgaaacacucaugcugcuugcucugauugccgugcucaccggcggcgucacgcuguucuuucugucugggagaggacucggcaagacaagcaucgggcuucuguguguuauggccuccagcgugcugcucuggauggcuucuguggagccccauuggauugcggccuccaucauccuggaguucuuucuuaugguccugcucauuccggagccugaccggcagcgcacaccccaggauaaccagcuggcuuacgugguuaucggacuccuguucaugauucuuaccguggccgccaaugagaugggccugcuggaaacaaccaaaaaggaccucgggaucggacacgucgcuguggagaaccaccaucacgccgcgaugcuggaugucgaccuucauccugccagcgcuuggacacuguacgccguggcuacgaccauuaucacacccaugaugagacacaccauugaaaacacaaccgccaauaucucucucacggcgaucgccaaccaagcugccauucugaugggccuggauaaaggcuggccuaucuccaagauggacauugggguuccccuccuugcucugggaugcuauagccaggugaauccgcugacccucacagccgcuguccugaugcuuguggcccauuacgcgaucauuggcccugggcugcaggccaaagcuacccgggaggcccaaaagcgcacagcugccggaaucaugaagaaccccaccguugauggcaucguggccauugaccucgaucccgucguguaugacgcgaaauuugaaaagcagcuggggcagaucaugcugcucauucuuuguacgucucagauccugcugaugagaacaaccugggcucucugcgagagcauuacacuggccaccggaccucuuaccacacugugggagggcuccccgggcaaauucuggaauacgaccaucgcugugucuauggccaacaucuuucgggggagcuaccucgccggagcuggccuggccuucucccugaugaaaagccucgggggaggccgcagagggacaggagcgcaaggcgaaacccuuggcgagaaauggaagcggcagcugaaucagcuguccaagucugaguucaacacauauaaaagaagcgggauuauggagguugaccgcuccgaagccaaggagggacucaaacggggcgagaccacgaagcacgcugucucuagagggacagccaaacugcgcugguuuguggaacggaaucuugugaagcccgagggaaaggucaucgaucugggcugugggagaggaggcuggagcuacuauugcgcuggccucaaaaagguuaccgaagugaaaggguacaccaagggaggcccugggcacgaggaacccauuccuauggccacauacggauggaaccuggugaaacugcauuccggcaaggacgucuucuuuauucccccugagaaaugugauacccuccuuugcgacaucggggagucuagcccgaaucccacaaucgaagagggacgcacgcugcgggugcugaagaugguugaaccuuggcucagaggcaaccaguucuguauuaagauccugaaucccuauaugccuuccguggucgaggcgcuugagcaaaugcagcgcaaacacggcgggaugcuggugcggaacccccucagcagaaauucuacccaugaaauguacuggguuuccugcggaacaggcaacaucgugagcgccgucaauaugaccucucgcaugcugcugaaccgguuuacaauggcucacagaaagccgaccuaugagcgcgauguggaccucgggacgggaaccagacacguggccgucgaaccugagguugcuaaccuggauauuaucggccagcggauugaaaauaucaaacaugagcacaaguccacauggcauuacgacgaggauaaccccuauaaaaccugggccuaccacgggagcuaugaagugaagcccucuggauccgcuagcuccauggugaauggcgucgugaaacuucugacaaaaccuugggacguuauucccauggugacccagaucgccaugacagauaccacgccuuucggccaacagcgcgucuuuaaggagaaaguggacacaagaaccccgaaggcgaaacgggggaccgcccagaucauggaaguuacagcuagauggcucuggggauuccugagccggaacaagaagccccgcauuuguacgagagaggaauuuacccggaaagugcgcucuaaugccgcuaucggcgccgucuucguggacgagaaccaauggaauagcgccaaggaggcgguugaagaugagagauuuugggaccuugugcaucgggaacgcgagcugcacaaacaggggaagugcgcuacaugcgucuacaacaugaugggaaaaagagaaaagaagcucggcgaguucgggaaagccaagggcucccgggccauuugguacauguggcugggagcucgcuuucuggaguucgaagcccucggcuucaugaaugaggaucacugguuuucuagagaaaacagccuguccgggguggagggagagggccuucauaaacugggguauauccuccgggacauuucuaagaucccuggaggcaauauguacgcugaugacaccgccgggugggauacacgcaucaccgaagacgaucugcagaacgaggcgaaaauuacagacaucauggaacccgagcacgcccuucuggcuaaggccauuuucaaacucaccuaucagaauaaggucgugagaguucaacggccugcuaagaacggcacggugauggaugucaucagccgcagagaccagcggggauccggccagguggggaccuacggacugaauacauuuaccaacauggaagcccagcugauuagacaaauggagucugagggcaucuucagccccuccgaacucgagacaccgaaccuggcggaacgcgcccuugauuggcuggggaaauauggaguggagcggcucaagagaauggcuaucagcggcgacgacuguguugugaaaccuauugaugaccgcuuugccaccgcucugacggcccuuaaugauauggggaagguccggaaagacaucccccagugggaaccuucuaagggcuggaacgauuggcaacaggugcccuucugcucccaucacuuucaccaacugauuaugaaggacggaagagagaucguugugccuugucgcaaucaggaugagcucgucggccgggcuagagugagccagggggccggauggucucugcgcgaaacagcgugccugggcaaauccuacgcccagauguggcaacucauguauuuccaucggagagaccugcgccuugcugccaacgccauuuguagcgcuguccccguggauuggguuccgaccucccggacaaccuggucuauccacgcccaucaccaguggaugacgaccgaggacaugcugagcguguggaauagagucuggauugaagagaacccuuggauggaagauaagacacauaucuccagcugggaggacgugcccuaccucgggaaacgggaggaccaguggugcggaucucugaucggccuuaccgcgagagcuacaugggccaccaauauucaaguugccaucaaccaggugcgccggcugauugggaaugaaaacuaccucgauuauaugaucuccaugaagagauuuaaaaaugagagcgaccccgaaggcgcucugugguga

SEQ ID NO: 18833 - RNA, 9879 nt, Artificial Sequence
  derived and/or modified CDS sequence (opt5) from DENV-1__EU677160__SS-prME
agcgugaccaugcugcucaugcugaugcccaccgcccuugcuuuccaccugacgaccagaggcggggaaccucauaugaucgucuccaagcaggaacggggaaagucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccagaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucguccuggugaccccuagcauggcuaugagaugcguuggcauugggucccgggauuucguggagggacuuagcggcgccacaugggucgacguggugcuggagcacgggucuugugucacgaccauggcuaaggauaaacccacacucgacaucgaacugcugaagaccgagguuacaaacccugccgugcuccgcaaacugugcauugaagcgaagaucuccaauaccacgacagauagcagauguccgacccaaggagaggccacccuuguggaagaacaagacgcuaacuuugucugccggcgcacauucguggauagaggcuggggcaauggguguggacuguuuggcaaagggucucucauuaccugcgccaaguucaagugcguuacaaaacuggagggaaagacggugcaguacgaaaaccuuaaauauuccgucaucgugaccguucacacaggcgaccagcaucaaguggggaaugagagcaccgaacacggaacaaccgcuacgaucacaccccaggccccuucuacagagauucagcugaccgacuacggcgcccucacacuggauuguagcccccggaccggccuggacuuuaacgaaaugguccuccugacgaugaaggagaaaagcuggcuugugcauaagcagugguuccuggaucucccucugcccuggacauccggggcuucuaccagccaagagacauggaaucgcaaagaccuucuggucaccuuuaagaccgcgcacgccaagaaacaggaagugguugugcucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugucauguguacaggcuccuucaagcuggagaaggaaguggccgagacccagcacggaaccguucucgugcagaucaaauacgagggcacagacgcgccgugcaagauuccuuuuagcacccaggaugaaaaaggggucacacaaaacggacggcugaucacggcuaaucccaucgugaccgacaaggagaaaccugugaacauugaagccgagccgcccuucggcgagucuuauaucguuauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggagucuucacauccgugggcaagcuggugcaucagaucuuugggaccgcuuacggaguccuguucagcggcgugucuuggacgaugaaaauugggaucggcguucuccugaccuggcuuggacucaauuccagaagcacaucucucuccaugaccuguauugccgugggccuggucacacuguaccuuggggugaugguucaggcugauagcggaugcgugaucaacuggaagggccgcgaacucaaguguggguccggaauuuuugucaccaaugaggugcacacauggaccgaacaguauaaauuccaagccgacucuccuaagcggcugagcgcggccaucggcaaggcuugggaggaggggguuugcggcauuagauccgccacgcgccuggaaaacaucauguggaagcagaucucuaacgagcucaaucauauucugcuugaaaacgacaugaaauuuacaguggucgugggagauguggcuggcauccuggcccaggggaagaaaaugauucggccgcagcccauggaguacaaguauagcuggaaguccuggggaaaagccaagaucauuggcgcugacguccaaaauaccaccuucaucaucgaugggccuaacacacccgaauguccugacgaucagagagcguggaauauuugggagguugaggacuacggauuuggcaucuucaccacgaacauuuggcucaaacugcgcgauagcuauacacaggugugcgaccaccggcugaugucugccgcuaucaaggauuccaaagccgugcacgccgacaugggcuacuggauugaaagcgagaagaaugaaaccuggaaacuugcuagagccucuuucaucgaggucaaaacauguaucuggcccaagucccauacccucuggagcaacggggugcuggaaucugagaugauuaucccgaaaauuuauggaggcccuaucagccagcacaauuaccgccccggguacuuuacacaaaccgcgggaccuuggcaucugggcaagcucgagcuggauuucgaccuuugcgaagggacgaccguuguggucgaugagcacugcggaaaccggggccccucccugagaacaaccacagugaccggcaaaauuauccacgaaugguguugccggagcuguacgcucccuccccugcgcuuuaagggggaggacggaugcugguauggcauggagaucagaccgguuaaggaaaaagaggaaaaucuggugaagucucuugucuccgcugggagcggagagguggacuccuucucucucggccugcuguguauuagcaucaugauugaagagguuaugcgguccagauggucucgcaaaaugcucaugacagggacccuggccguguuuuuccuucugaucaugggacagcucacauggaacgaucugauucggcugugcaucauggucggcgccaaugcuagcgacagaaugggcauggggaccaccuaccuugcccugauggcgacauuuaagaugcgcccuauguucgcugugggacuccuguuuagacggcucacgucccgcgaggugcugcuucugaccauuggccucucucuggucgccagcguugaacugcccaacucccuugaggaacugggggauggacucgccaugggcaucaugauccugaaacuccugacagacuuccagagccaucaacuuugggcuacccugcucucucugacauuuauuaagaccacguucucccugcacuaugccuggaagacaauggcuauggugcuuagcaucgugucucuguuuccccucugucuguccaccaccagccagaaaacaaccuggcucccuguccugcuugggucucugggaugcaagccgcugacaauguuccucauugccgagaauaaaaucuggggcagaaaguccuggccccugaacgaaggcauuauggcgguggggaucguuagcauccuucuguccagccuccugaaaaacgaugugccucucgccggaccccugauugcuggcgggaugcuuaucgccuguuacgucauuucuggaagcuccgcugaccugucucuggagaaggccgccgaggugagcugggaagaggaagcugagcauuccggcgcgucucacaauauccucguugaagugcaggaugacgggacgaugaaaauuaaggaugaggagcgggacgauacccugacaauccuucugaaggccacccuccuggcugucagcggaguguauccucucuccauccccgccacacuguucgucugguacuuuuggcagaaaaagaaacaacgcucuggcgugcuuugggacaccccuuccccucccgaaguugagagagccgugcuggaugacggcauuuaucggaucaugcagcgcgggcugcucggaagaucccaggucggcguggggguuuuccaggaaaacguguuucauacgauguggcacgucacccggggagcugugcugauguaccaaggcaagcgccuugagcccagcugggccucugugaaaaaggaccugauuuccuacgggggaggcuggagacuccagggcagcuggaauacaggggaggaaguucaggucaucgcgguggagcccggaaagaacccuaaaaaugugcagaccgcucccggcacauucaagaccucugaaggggaggucggagccauugcccuggauuuuaaaccgggcacauccgggagcccuaucgugaaccgggaaggaaagauuguuggccucuauggcaaugggguggucacgaccuccggaacauacgugucugcuaucgcccaagcgaaagcuagccaggagggcccccugccugagaucgaagacgagguuuucagaaagcgcaaccuuaccauuauggaucugcaccccggguccggaaagacccggagauaucugcccgccaucgugcgcgaagccauuaaacggaagcucagaacacugauccuugcuccuacgcgcgucguggccagcgagauggcugaagcccugaaaggcaugccgauucgguaccagaccacagcgguuaagucugagcauaccgggaaagagaucguggaccucaugugccacgccacauuuaccaugagacugcugucccccguccgcgugccuaauuauaacaugaucauuauggaugaagcucauuucacggaccccagcucuaucgccgcucggggcuacauuagcacaagagugggaaugggcgaggccgccgcuaucuuuaugaccgcgaccccucccggguccgucgaagccuucccucaaucuaaugcuguuauucaggaugaggaacgggacaucccggagcgcagcuggaacuccggauaugaguggaucacagauuuucccggcaagaccgugugguucgugccuucuauuaagagcgggaaugacaucgccaacugucuccgcaagaauggaaagcgggucauucagcuuucccgcaaaacauucgauaccgaauaccagaagacgaaaaacaacgacugggacuacgugguuacaaccgauaucagcgagaugggcgccaauuuuagagcugaccgggugauugaucccagacgcugccugaagccugucauccugaaggacgggcccgaacgggugauucucgccggcccgaugccuguuacaguggcgucugcugcccaaagacgcggacggaucggcagaaaccacaauaaagagggggaucaguauaucuacaugggacagccccugaacaaugacgaggaucaugcccacuggaccgaagcuaagaugcuucuggacaacauuaauacgcccgagggcaucauuccugcccucuucgaacccgagcgcgaaaaauccgcggccaucgauggggaguaucggcugagaggagaggcucgcaagaccuuugucgaacugaugagacggggcgaccucccuguguggcuuagcuacaaagucgccuccgagggguuccaguauucugaucgcagauggugcuuugacggcgaacggaacaaucaagugcuggaggaaaacauggauguugagauuuggacaaaggagggagaacgcaaaaagcugagaccgcgguggcucgacgcuagaaccuacagcgacccccuggcccuucgcgaguucaaggaauuugcugccggccggagauccgugucuggggaucugauccucgagaucggaaaacugccucagcaccugacacagcgcgcgcagaaugcccucgacaaccuugugaugcugcauaauagcgaacaaggcgggcgggcuuauagacacgccauggaggagcugcccgauaccauugaaacacucaugcugcuugcucugaucgccguccucaccggaggcguuacgcuguucuuucuguccggccgggggcucggaaagacaagcauuggccuucugugugugauggccucuuccgugcugcucuggauggcuagcgucgagccucauuggaucgcggccucuauuauccuggaguucuuucuuauggugcugcucauccccgagccggaccgccagagaaccccucaggauaaccagcuggcuuacguugugauugggcugcuguucaugauccuuaccgucgccgccaaugagaugggacugcuggaaacaaccaaaaaggaccucggcauugggcacguggcugucgagaaccaccaucacgccgcgaugcuggauguggaccuucaucccgccuccgcuuggacacuguacgccguugcuacgaccaucauuacaccuaugaugcggcacaccaucgaaaacacaaccgccaauauuagccucacggcgaucgccaaccaagcugccauccugaugggacuggauaaaggcuggcccauuucuaagauggacaucggcgugccucuccuugcucuggggugcuauagccaggucaauccccugacccucacagccgcugugcugaugcuuguugcccauuacgcgauuaucggaccgggccugcaggccaaggcuacccgcgaggcccagaagagaacagcugccgggauuaugaagaacccuaccguggauggaaucgucgccaucgaccucgaucccgugguguaugacgcgaaauuugaaaagcagcugggccagauuaugcugcucauccuuuguacgucccagauucugcugaugcggacaaccugggcucucugcgagucuaucacacuggccaccgggccccuuaccacacugugggagggaagcccuggcaaauucuggaauacgaccauugcuguuuccauggccaacaucuuccgcggcagcuaccucgccggggcuggacuggccuuuucccugaugaagucucucggcgggggaagacggggcacaggggcgcaaggagaaacccuuggcgagaaguggaaacgccagcugaaucagcugagcaaguccgaguucaacacauauaaaagaucuggcaucauggaggucgaccggagcgaagccaaggaggggcucaaaagaggagagaccacgaagcacgcugugucccgcggcacagccaagcugcggugguuuguggaaagaaaucuugucaaaccggaggggaagguuauugaucugggauguggccgcgggggauggucuuacuauugcgcuggccucaaaaaggugaccgaagugaaaggcuacaccaaagggggacccggccacgaggaaccuauccccauggccacauacggguggaaccuggucaaacugcauagcggaaaggacguguucuuuauuccucccgagaagugugauacccuccuuugcgacaucggcgaguccagcccuaauccgacaauugaagaggggcggacgcugagaguucugaaaaugguggaacccuggcuccgcggaaaccaguucuguaucaagauucugaauccuuauaugcccucugucguggagacccuugagcaaaugcagcggaaacacggcggcaugcugguuagaaacccucucucccgcaauagcacacaugaaauguacugggugucuugcgggaccggaaacaucgucuccgcggugaauaugacaagccggaugcugcugaacagauuuaccauggcccaccgcaagcccacguaugagcgggauguggaccucggcgcugggaccagacacgucgccguugaaccggagguggcuaaccuggauaucauuggacagcgcaucgaaaauauuaaacaugagcacaagucuacauggcauuacgacgaggauaacccuuauaagaccugggccuaccacggcuccuaugaagugaaacccagcggguccgcuagcucuauggucaauggagugguuaaacuucugacaaaacccugggacgugaucccuauggucacccagauugccaugacagauaccacgcccuucggccaacagagaguguuuaaggagaaaguugacacacggaccccuaaggcgaagcgcggcaccgcccagaucauggaagugacagcuaaauggcucuggggguuccugagcagaaacaagaaaccgcggaucuguacgagagaggaauuuacccggaagguccgcuccaaugccgcuauuggagccguguucguugacgagaaccaauggaacucugccaaagaggcgguggaagaugagagauuuugggaccuuguccaucgggaacgcgagcugcacaagcagggcaagugcgcuacaugcguguacaacaugauggggaaaagagaaaagaaacucggagaguucggcaaggccaaagggagccgggccaucugguacauguggcugggcgcucgcuuccuggaguuugaagcccucggauucaugaaugaggaucacugguuuuccagagaaaacucucugagcggcgucgagggggagggacuucauaagcugggcuauauucuccgggacaucuccaaaauucccgggggaaauauguacgcugaugacaccgccggcugggauacacgcaucaccgaagacgaucugcagaacgaggcgaagaucacagacauuauggaaccugagcacgcccuucuggcuaagucuaucuucaaacucaccuaucagaauaaggugguuagagugcaacggcccgccaaaaacgggacggucauggaugugauuagccgcagagaccagcggggcuccggacaggugggcaccuacgggcugaauacauuuaccaacauggaagcucagcugauccgccaaauggagagcgagggaauuuucucuccuuccgaacucgagacacccaaccuggccagacggguucuugauuggcuggaaaagcauggcguggagagacucaaacgcauggcgaucagcggggacgacugugucgugaagccgaucgaugaccgguuugccaccgcucugacggcccuuaaugauaugggaaagguuagaaaagacauuccucagugggaacccucuaagggcuggaacgauuggcaacaggugccuuucugcucccaccacuuucaucaacugaucaugaaagacgggcgcgagauugucgugcccugucggaaucaggaugagcucgucggcagagcucgcgugagccagggagccggcuggucccugcgggaaacagcuugccuggggaagucuuaugcccagauguggcaacucauguacuuccacagacgcgaccugcggcuugcggccaacgcuaucuguagcgccguuccuguggauuggguccccaccuccagaacaaccuggagcauucaugcccaccaucaguggaugacgaccgaggacaugcugucuguguggaaucgcguuuggaucgaagagaacccguggauggaagauaaaacacacauuuccagcuggggagacgugccuuaucucggcaagcgggaggaccaguggugcgggucucugaucggacuuaccgcuagagccacaugggcgaccaauauccaagucgcuauuaaccaggugcggagacugaucggcaaugagaacuaccucgauuacaugacaagcaugaagcgcuuuaaaaaugaauccgaccccgagggggcccugugguga

SEQ ID NO: 18834 - RNA, 9879 nt, Artificial Sequence
  derived and/or modified CDS sequence (opt5) from DENV-1__EU677162__SS-prME
agcgugaccaugcugcugaugcugaugcccacagcccuugcuuuccaccugacgacccggggcggggaaccucauaugaucgucuccaagcaggaacggggaaagucucuccuguuuaagacaagcgccggcguuaauaugugcacccuuauugcgauggaccugggggaguucugugaagauacaaugaccuacaaaugcccgcgcaucacagaagcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgcaaagaccuucuggugacauuuaagaccgcgcacgccaagaaacaggaagucgugguucucggaucccaggagggcgcuaugcacaccgcccugacaggggccacggaaauucaaaccagcggaacaaccacaaucuucgcuggccaucugaagugcagacucaaaauggauaagcugacccuuaaagggaugucuuaugugauguguacgggcuccuucaagcuggagaaggaagucgccgagacacagcacggaaccgugcucguucagauuaaauacgagggcaccgacgcgccgugcaagaucccuuuuagcacacaggaugaaaaaggggugacccaaaacggacggcugaucacagcuaaucccauugucacggacaaggagaaaccugugaacaucgaagccgagccgcccuucggcgagucuuauauugugaucggggccggagaaaaggcucugaaacuuagcugguuuaaaaagggcuccucuauugggagaauguucgaggccaccgcucgcggcgcccggagaauggcgauccucggagauacagccugggacuuuggcagcaucgggggaguuuucaccuccgucggcaaacuggugcaucagauuuuugggacagcuuacggagugcuguucagcggcgucucuuggaccaugaagaucgggauuggcgugcuccugacguggcuuggacucaauucccgcagcaccucucucuccaugacauguaucgccguuggccuggugacccuguaccuuggggucauggugcaggcugauagcggaugcguuauuaacuggaaaggccgggaacucaaguguggguccggaaucuuugugacaaaugagguccacaccuggacagaacaguauaaguuccaagccgacucuccuaaaagacugagcgcggccauuggcaaggcuugggaggagggggugugcggcauccgcuccgccacccggcuggaaaacaucauguggaaacagauuucuaacgagcucaaucauauccugcuugaaaacgacaugaaguuuacgguuguggucggagauguggcuggcauucuggcccaggggaaaaagaugaucagaccgcagcccauggaguacaaauauagcuggaaguccuggggaaaggccaaaauuaucggcgcugacgugcaaaauacaaccuucaucauugaugggccuaacacccccgaauguccugacgaucagcgcgcguggaauaucugggaggucgaggacuacggauuuggcauuuucacaaccaacaucuggcucaagcugcgggauagcuauacgcagguuugcgaccacagacugaugucugccgcuauuaaagauuccaaggccgugcacgccgacaugggcuacuggaucgaaagcgagaaaaaugaaacauggaaacuugcucgcgccucuuucaucgaggugaagaccuguauuuggcccaaaucccauacacucuggagcaacgggguccuggaaucugagaugaucauuccgaagaucuauggaggcccuauuagccagcacaauuaccggcccggguacuuuacccaaacagcgggaccuuggcaucugggcaaacucgagcuggauuucgaccuuugcgaagggaccacggugguuguggaugagcacugcggaaacagaggccccucccugcggaccacaaccgucacaggcaagaucauccacgaaugguguugccgcagcuguacccucccuccccugagauuuaaaggggaggacggaugcugguauggcauggagauucggccggugaaggaaaaggaggaaaaucugguuaaaucuaugguguccgcugggagcggagaggucgacuccuucucucuuggccuccuguguaucagcauuaugaucgaagaggugaugagaucccgcuggucucggaagaugcugaugacggggacacucgccgucuuuuuccugcuuauuaugggacagcugaccuggaacgaucucaucagacugugcauuauggugggcgccaaugcuagcgaccgcaugggcauggggacaaccuaccuggcccuuauggcgaccuuuaaaaugagaccuauguucgcugucggacugcucuuucggcgccugacauccagagaggugcuccugcuuacgaucggccugucucucguggccagcgucgaacugcccaacucccuggaggaacuuggggauggacuggccaugggcaucaugauucucaagcugcucaccgacuuccagagccaucaacugugggcuacacuucugucucucaccuuuaucaaaacaaccuucucccugcacuaugccuggaagacgauggcuaugguucugagcauugugucucuuuuuccccugugucucuccacaaccagccagaagaccacauggcugccugugcuccuggggucucuuggaugcaaaccgcugaccauguuccugaucgccgagaauaagauuuggggccggaaauccuggccccucaacgaaggcaucauggcggucgggaucgugagcauucugcuuuccagccugcucaagaacgauguuccucuggccggaccccucaucgcuggcgggaugcugauugccuguuacgugaucucuggaagcuccgcugaccuuucucuggagaaagccgccgaggucagcugggaagaggaagcugagcauuccggcgcgucucacaauauucugguggaaguucaggaugacgggacaaugaagaucaaagaugaggagcgcgacgauacgcucaccauccugcuuaaggccacacugcucgcugugagcggagucuauccucuguccauucccgccacccucuucgugugguacuuuuggcagaagaaaaagcaaagaucuggcguccugugggacacaccuuccccucccgaaguggagcgggccguucuugaugacggcaucuaucgcauuaugcagagagggcugcugggacggucccaggugggcgucgggguguuccaggaaaacguuuuucauaccauguggcacgugacgcgcggagcuguccucauguaccaaggcaaaagacuggagcccagcugggccucugugaagaaagaccuuaucuccuacgggggaggcuggcggcugcagggcagcuggaauaccggggaggaagugcagguuauugcggucgagcccggaaagaacccuaagaaugugcagacagcucccggcaccuucaaaacaucugaaggggaggugggagccaucgcccucgauuuuaagccgggcaccuccgggagcccuauugucaacagagaaggaaaaaucgugggccuguauggcaaugggguugugacaacguccggaaccuacgucucugcuaucgcccaagcgaaggcuagccaggagggcccccucccugagauugaagacgagguguuccgcaaacggaaccugacaaucauggaucuucaccccggguccggaaagaccagacgcuaucugcccgccauuguucgggaagccaucaagagaaaacugcgcacccucauucuggcuccuacacggguggucgccagcgagauggcugaagcccuuaagggcaugccgaucagauaccagacgaccgcggugaaaucugagcauacagggaaggagaucguugaccugaugugccacgccaccuuuacaaugcgccuccugucccccgugcgggucccuaauuauaacaugauuaucauggaugaagcucauuucaccgaccccagcucuauugccgcuagaggcuacaucagcacgcgggugggaaugggcgaggccgccgcuauuuuuaugacagcgaccccucccggguccguggaagccuucccucaaucuaaugcugucauccaggaugaggaacgcgacaucccggagagaagcuggaacuccggauaugaguggauuaccgauuuucccggcaaaacaguuugguucgugccuucuaucaagagcgggaaugacauugccaacugucugcggaagaauggaaaacgcgugauccagcucuccagaaagaccuucgauacagaauaccagaaaaccaagaacaacgacugggacuacgucgugacgacagauauuagcgagaugggcgccaauuuucgggcugacagaguuaucgauccccgccggugccuuaaaccugugauucugaaggacgggcccgaaagagucauccuggccggcccgaugccugugaccguugcgucugcugcccaacgccggggaagaaucggccgcaaccacaauaaggagggggaucaguauauuuacaugggacagccccucaacaaugacgaggaucaugcccacuggacagaagcuaaaaugcugcuugacaacaucaauacccccgagggcauuaucccugcccuguucgaacccgagcgggaaaaguccgcggccauugauggggaguauagacuccgcggagaggcuagaaaaacguuuguggaacugaugcggcgcggcgaccugccugucuggcucagcuacaagguggccuccgagggguuccaguauucugauagacgguggugcuuugacggcgaacgcaacaaucaaguccuugaggaaaacauggauguggagaucuggaccaaagagggagaaagaaagaaacugcggccgagauggcuggacgcucgcacauacagcgacccccucgcccugcgggaguucaaggaauuugcugccggcagacgcuccguuucuggggaucuuauccuggagauuggaaagcucccucagcaccugacccagcgggcgcagaaugcccuggacaaccucgugaugcuucauaauagcgaacaaggcgggagagcuuaucggcacgccauggaggagcugcccgauacaaucgaaacccugaugcuccuggcucuuauugccgugcugacaggaggcgucacccucuucuuucuguccggccgcgggcugggaaaaacgagcaucggccuccuuuguguuauggccucuuccgugcugcuguggauggcuagcguggagccucauuggauugcggccucuaucauccucgaguucuuucugaugguccuucugauucccgagccggacagacagcggacaccucaggauaaccagcucgcuuacgugguuaucgggcugcuguucaugauucucaccguggccgccaaugagaugggacuucuggaaaccacaaagaaagaccugggcaucgggcacgucgcuguggagaaccaccaucacgccgcgaugcucgaugucgaccugcaucccgccuccgcuuggacccuuuacgccguggcuacaacgauuaucaccccuaugaugcgccacacaauugaaaacaccacagccaauaucagccugaccgcgaucgccaaccaagcugccauucucaugggacuggauaagggcuggcccaucucuaaaauggacauuggcguuccucugcucgcucuugggugcuauagccaggugaauccccugacgcugaccgccgcuguccucaugcugguggcccauuacgcgaucauuggaccgggccuucaggccaaggcuacaagagaggcccaaaagcggaccgcugccgggaucaugaaaaacccuacaguugauggaaucguggccauugaccuggaucccgucguguaugacgcgaaguuugaaaaacagcucggccagaucaugcugcugauucucuguaccucccagauccuucugaugcgcacgacaugggcucugugcgagucuauuacccucgccacagggccccugaccacccuuugggagggaagcccuggcaaguucuggaauacaacgaucgcuguguccauggccaacaucuucagaggcagcuaccuggccggggcuggacucgccuuuucccugaugaaaucucugggcgggggacggcgcggcaccggggcgcaaggagaaacacucggcgagaaguggaagagacagcuuaaucagcugagcaaauccgaguucaacaccuauaagcggucuggcauuauggagguugacagaagcgaagccaaagaggggcugaagcgcggagagacaaccaaacacgcugucucccggggcacggccaagcucagaugguuuguggaacgcaaucuggugaagccggaggggaaagucaucgaucuuggauguggcagagggggauggucuuacuauugcgcuggccugaagaaaguuacagaagugaagggcuacaccaaagggggacccggccacgaggaaccuauucccauggccaccuacggguggaaccucgugaagcugcauagcggaaaagacgucuucuuuaucccucccgagaagugugauacacugcucugcgacauuggcgaguccagcccuaauccgaccaucgaagaggggagaacacuucgcgugcugaagaugguugaacccuggcugcggggaaaccaguucuguauuaaaauccucaauccuuauaugcccucuguggucgagacgcuggagcaaaugcagagaaagcacggcggcaugcuugugcgcaacccucugucccggaauagcacccaugaaauguacuggguuucuugcgggacaggaaacaucguguccgcggucaauaugaccagcagaaugcuccugaaccgcuuuacaauggcccaccggaaacccaccuaugagagagauguggaccugggcgcugggacgcgccacguggccgucgaaccggagguugcuaaccucgauauuaucggacagagaauugaaaauaucaagcaugagcacaaaucuaccuggcauuacgacgaggauaacccuuauaagacaugggccuaccacggcuccuaugaagugaagcccagcggguccgcuagcucuauggugaauggagucgugaaacugcuuaccaagcccugggacguuauuccuauggugacacagaucgccaugaccgauacaacccccuucggccaacagcgggucuuuaaagagaagguggacacgcgcacaccuaaagcgaagagaggcaccgcccagaucauggaaguuaccgcuaaguggcuguggggguuccucagccggaacaaaaagccgagaauuuguacacgggaggaauuuacgcgcaaagugagauccaaugccgcuaucggagccgucuucguggacgagaaccaauggaacucugccaaggaggcgguugaagaugagcgguuuugggaccuggugcaucgcgaaagagagcuucacaaacagggcaagugcgcuaccugcgucuacaacaugauggggaagcgggagaagaagcugggagaguucggcaaagccaaggggagccgcgccauuugguacauguggcucggcgcuagauuccuggaguuugaagcccugggauucaugaaugaggaucacugguuuucccgggaaaacucucucagcggcguggagggggagggacugcauaaacuuggcuauauccugcgcgacauuuccaagauccccgggggaaauauguacgcugaugacacagccggcugggauaccagaaucacagaagacgaucuccagaacgaggcgaaaauuaccgacaucauggaaccugagcacgcccugcuugcuaagucuauuuucaagcugacauaucagaauaaagucgugcggguucaacgccccgccaagaacgggaccgugauggaugucaucagcagacgggaccagcgcggcuccggacaggugggcacguacgggcucaauaccuuuacaaacauggaagcucagcugauuagacaaauggagagcgagggaaucuucucuccuuccgaacuggagacccccaaccucgccggccgggugcuggauuggcuugaaaaacaugggguugagagacugaagcgcauggcgaucagcggagacgacuguguggucaaaccgauugaugaccgguuugccacagcucucaccgcccugaaugauaugggcaaggugagaaaggacaucccucagugggaacccucuaaaggguggaacgauuggcagcagguuccuuucugcucccaccacuuucaucaacuuauuaugaaggacggccgcgagaucgugguccccugucggaaucaggaugagcuggugggcagagcucgcgucagccagggagccggguggucccuccgggaaacggcuugccugggaaaaucuuaugcccagauguggcaacugauguacuuccacagacgcgaccuccggcuggcggccaacgcuauuuguagcgccgugccuguugauugggugcccacauccagaaccacauggagcauccaugcccaccaucaguggaugaccacggaggacaugcuuucugucuggaaucgcguguggauugaagagaacccguggauggaagauaagacccacaucuccagcuggggcgacguuccuuaucuggggaaacgggaggaccaguggugcggaucucucaucggccugacagcuagagccaccugggcgacaaauauucaaguggcuaucaaccagguccggagacuuauugggaaugagaacuaccuggauuacaugaccagcaugaagcgcuuuaagaaugaauccgaccccgagggcgcccucugguga

SEQ ID NO: 18835 - RNA, 9879 nt, Artificial Sequence
  derived and/or modified CDS sequence (opt5) from DENV-1__EU677164__SS-prME
agcgugacaaugcugcugaugcugaugcccacagcccuugcuuuccaccugacgaccagaggcggggaaccucauaugaucgucuccaagcaggaacggggaaaaucucuccuguuuaagacaagcgccggcguuaacaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauugcgauccucggagauaccgccugggacuuuggcagcaucgggggaguuuucacauccgucggcaagcuggugcaucagauuuuugggaccgcuuacggagugcuguucagcggcgucucuuggacgaugaaaaucgggauuggcgugcuccugaccuggcuuggacucaauuccagaagcacaucucucuccaugaccuguaucgccguuggccuggugacacuguaccuuggggucauggugcaggcugauagcggaugcguuauuaacuggaagggccgcgaacucaaguguggguccggaaucuuugugaccaaugagguccacacauggaccgaacaguauaaauuccaagccgacucuccuaagcggcugagcgcggccauuggcaaggcuugggaggagggggugugcggcaucagauccgccacgcgccuggaaaacaucauguggaagcagauuucuaacgagcucaaucauauccugcuugaaaacgacaugaaauuuacaguuguggucggagauguggcuggcauucuggcccaggggaagaaaaugauccggccgcagcccauggaguacaaguauagcuggaaguccuggggaaaagccaagauuaucggcgcugacgugcaaaauaccaccuucaucauugaugggccuaacacacccgaauguccugacgaucagagagcguggaauaucugggaggucgaggacuacggauuuggcauuuucaccacgaacaucuggcucaaacugcgcgauagcuauacacagguuugcgaccaccggcugaugucugccgcuauuaaggauuccaaagccgugcacgccgacaugggcuacuggaucgaaagcgagaagaaugaaaccuggaaacuugcuagagccucuuucaucgaggugaaaacauguauuuggcccaagucccauacccucuggagcaacgggguccuggaaucugagaugaucauuccgaaaaauuauggaggcccuaucagccagcacaacuaccgccccggguacuuuacacaaaccgcgggaccuuggcaucugggcaagcucgagcuggauuucgaccuuugcgaagggacgaccgugguuguggaugagcacugcggaaaucggggccccucccugagaacaaccacagucaccggcaaaauuauccacgaaugguguugccggagcuguacgcucccuccccugcgcuuuaagggggaggacggaugcugguauggcauggagaucagaccggugaaggaaaaagaggaaaaccugguuaagucuaugguguccgcugggagcggagaggucgacuccuucucucuuggccuccuguguauuagcaucaugauugaagaggugaugcgguccagauggucucgcaaaaugcugaugacagggacccucgccguucuguuucuucugaucaugggacagcucacauggaaugaucugauucggcugugcaucauggugggcgccaacgcuagcgacagaaugggcauggggaccaccuaccuugcccugauggcgacauucaagaugcgcccuauguuugcugucggacuccuguucagacggcucacgucccgcgaggugcugcuucugaccauuggccucucucugguggccagcgucgaacugcccaauucccuugaggaacugggggauggacucgccaugggcaucaugauccugaaacuccugacagacuuucagagccaucaacuuugggcuacccugcucucucugacauucauuaagaccacguuuucccugcacuaugccuggaagacaauggcuaugguucuuagcaucgugucucuguucccccucugucuguccaccaccagccagaaaacaaccuggcucccugugcugcuugggucucugggaugcaagccgcugacaauguuucucauugccgagaacaaaaucuggggcagaaaguccuggccccugaacgaaggcauuauggcggucgggaucgugagcauccuucuguccagccuccugaaaaaugauguuccucucgccggaccccugauugcuggcgggaugcuuaucgccuguuacgugauuucuggaagcuccgcugaccugucucuggagaaggccgccgaggucagcugggaagaggaagcugagcauuccggcgcgucucacaacauccucguggaaguucaggaugacgggacgaugaaaauuaaggaugaggagcgggacgauacccugacaacccuucugaaggccacacuccuggcugugagcggagucuauccucucuccauccccgccacccuguucgugugguacuucuggcagaaaaagaaacaacgcucuggcguccuuugggacacgccuuccccucccgaaguggagagagccguucuggaugacggcaucuaucggauuaugcagcgcgggcugcucggaagaucccaggugggcgucgggguguuucaggaaaauguuuuccauaccauguggcacgugacacggggagcuguccugauguaccaaggcaagcgccuugagcccagcugggccucugugaaaaaggaccugaucuccuacgggggaggcuggagacuccagggcagcuggaacaccggggaggaagugcagguuauugcggucgagcccggaaagaauccuaaaaacgugcagacagcucccggcaccuuuaagacaucugaaggggaggugggagccaucgcccuggauuucaaaccgggcacguccgggagcccuauugucaaucgggaaggaaagaucgugggccucuauggcaacgggguugugaccacauccggaaccuacgucucugcuauugcccaagcgaaagcuagccaggagggcccccugccugagaucgaagacgagguguuuagaaagcgcaaucuuaccaucauggaucugcaccccggguccggaaagacacggagauaucugcccgccauuguucgcgaagccaucaaacggaagcucagaacgcugauucuugcuccuacccgcguggucgccagcgagauggcugaagcccugaaaggcaugccgauccgguaccagacaaccgcggugaagucugagcauacagggaaagagauuguugaccucaugugccacgccaccuucacgaugagacugcugucccccgugcgcgucccuaacuauaauaugaucaucauggaugaagcucauuuuacagaccccagcucuauugccgcucggggcuacaucagcaccagagugggaaugggcgaggccgccgcuauuuucaugaccgcgacaccucccggguccguggaagccuuuccucaaucuaacgcugucauccaggaugaggaacgggacauuccggagcgcagcuggaacuccggauaugaguggaucaccgauuuccccggcaagacaguuugguuugugccuucuaucaagagcgggaacgacauugccaauugucuccgcaagaauggaaagcgggugauccagcuuucccgcaaaaccuucgauacggaauaccagaagaccaagaacaaugacugggacuacgucgugaccacagauauuagcgagaugggcgccaacuucagagcugaccggguuaucgaucccagacgcugccugaagccugugauucugaaggacgggcccgaacgggucauccucgccggcccgaugccugugaccguugcgucugcugcccaaagacgcggacggauuggcagaaaucacaacaaagagggggaucaguauaucuacaugggacagccccugaauaacgacgaggaucaugcccacuggacggaagcuaagaugcuucuggacaauaucaacacccccgagggcauuaucccugcccucuuugaacccgagcgcgaaaaauccgcggccauugauggggaguaucggcugagaggagaggcucgcaagacauucguggaacugaugagacggggcgaccucccugucuggcuuagcuacaaaguggccuccgagggguuucaguauucugaucgcagauggugcuucgacggcgaacggaauaaccaaguccuggaggaaaauauggauguggagaucuggaccaaggagggagaacgcaaaaagcugagaccgcgguggcucgacgcuagaacauacagcgacccccuggcccuucgcgaguuuaaggaguucgcugccggccggagauccguuucuggggaucugauucucgagaucggaaaacugccucagcaccugacccagcgcgcgcagaacgcccucgacaaucuugugaugcugcauaacagcgaacaaggcgggcgggcuuauagacacgccauggaggagcugcccgauacaaucgaaacccucaugcugcuugcucugauugccgugcucacgggaggcgucacacuguuuuuccuguccggccgggggcucggaaagaccagcaucggccuucuguguguuauggccucuuccgugcugcucuggauggcuagcguggagccucauuggauugcggccucuaucauucuggaauuuuuccuuaugguccugcucauccccgagccggaccgccagagaaccccucaggauaaucagcuggcuuacgugguuaucgggcugcucuuuaugauucuuacaguggccgccaacgagaugggacugcuggaaaccaccaagaaggaccucggcaucgggcacgucgcuguggagaaccaccaucacgccgcgaugcuggaugucgaccuucaucccgccuccgcuuggacgcuguacgccguggcuaccacaauuaucaccccuaugaugcggcacacaauugaaaauaccacggccaacaucagccucaccgcgauugccaaucaagcugccauccugaugggacuggauaaaggcuggcccaucucuaagauggacauuggcguuccucuccuugcucuggggugcuauagccaggugaacccccugacacucaccgccgcuguccugaugcuuguggcccauuacgcgaucauuggaccgggccugcaggccaaggcuacacgcgaggcccagaaaagaaccgcugccgggaucaugaagaauccuacgguugauggaauuguggccaucgaccucgaucccgucguguaugacgcgaaauucgaaaagcagcugggccagaucaugcugcucauucuuuguacaucccagauccugcugaugcggaccacaugggcucucugcgagucuauuacccuggccaccgggccccuuacaacgcugugggagggaagcccuggcaaauuuuggaacaccacaaucgcuguguccauggccaauauuuuccgcggcagcuaccucgccggggcuggacuggccuucucccugaugaagucucucggcgggggaagacggggcaccggggcgcaaggagaaacacuuggcgagaaguggaaacgccagcugaaccagcugagcaaguccgaauuuaauaccuauaaaagaucuggcaucauggagguugaccggagcgaagccaaggaggggcucaaaagaggagagacgacaaagcacgcugucucccgcggcaccgccaagcugcggugguucguggaaagaaaccuugugaaaccggaggggaaggucaucgaucugggauguggccgcgggggauggucuuacuauugcgcuggccucaaaaagguuaccgaagugaaaggcuacacaaaagggggacccggccacgaggaaccuauucccauggccaccuacggguggaaucuggugaaacugcauagcggaaaggacgucuuuuucaucccucccgagaagugugauacacuccuuugcgacauuggcgaguccagcccuaacccgacgaucgaagaggggcggacccugagagugcugaaaaugguugaacccuggcuccgcggaaaucaguuuuguauuaagauccugaacccuuauaugcccucuguggucgagacacuugagcaaaugcagcggaaacacggcggcaugcuggugagaaauccucucucccgcaacagcacccaugaaauguacuggguuucuugcgggacaggaaauauuguguccgcggucaacaugaccagccggaugcugcugaacagauucacgauggcccaccgcaagcccaccuaugagcgggauguggaccucggcgcugggacaagacacguggccgucgaaccggagguugcuaaucuggauaucaucggacagcgcauugaaaacaucaaacaugagcacaagucuaccuggcauuacgacgaggauaauccuuauaagacaugggccuaccacggcuccuaugaagugaaacccagcggguccgcuagcucuauggugaacggagucgugaaacuucugaccaaacccugggacguuauuccuauggugacacagaucgccaugaccgauacgacacccuuuggccaacagagagucuucaaggagaaaguggacacccggaccccuaaggcgaagcgcggcacagcccagauuauggaaguuacggcuaaauggcucuggggguuucugagcagaaauaagaaaccgcggaucuguaccagagaggaguucacacggaaggugcgcuccaacgccgcuaucggagccgucuuuguggacgagaaucaauggaacucugccaaagaggcgguugaagaugagagauucugggaccuugugcaucgggaacgcgagcugcacaagcagggcaagugcgcuaccugcgucuacaauaugauggggaaaagagaaaagaaacucggagaguuuggcaaggccaaagggagccgggccauuugguacauguggcugggcgcucgcuuccuggaguucgaagcccucggauuuaugaacgaggaucacugguucuccagagaaaauucucugagcggcguggagggggagggacuucauaagcugggcuauauccuccgggacauuuccaaaauccccgggggaaacauguacgcugaugacacagccggcugggauacccgcauuacagaagacgaucugcagaaugaggcgaagaucaccgacaucauggaaccugagcacgcccuucuggcuaagucuauuuuuaaacucacguaucagaacaaggucgugagaguucaacggcccgccaaaaaugggaccgugauggaugucaucagccgcagagaccagcggggcuccggacaggugggcacauacgggcugaacaccuucacaaacauggaagcucagcugauucgccaaauggagagcgagggaaucuuuucuccuuccgaacucgagacccccaaucuggccggcagagugcuugauuggcuggaaaagcaugggguugagcggcucaaaagaauggcgauuagcggagacgacuguguggucaagccgaucgaugaccgcuucgccacggcucugacagcccuuaacgauaugggcaaggugcggaaagacaucccucagugggaacccucuaagggguggaaugauuggcagcagguuccuuuuugcucccaccacuuccaucaacugauuaugaaagacggcagagagaucgugguccccugucgcaaccaggaugagcucgugggacgggcuagagucagccagggcgccggguggucccugcgcgaaaccgcuugccugggaaagucuuaugcccagauguggcaacucauguacuuucaccggagagaccugcgccuugcggccaaugcuauuuguagcgccgugccuguugauugggugcccacaucccggaccacguggagcauccaugcccaccaucaguggaugaccacagaggacaugcugucugucuggaacagaguguggauugaagagaauccguggauggaagauaaaacccacaucuccagcuggggcgacguuccuuaucucgggaagcgcgaggaccaguggugcggaucucugauuggccuuacagcucgggccaccugggcgacaaacauccaaguggcuaucaaucaggucagacggcugauugggaacgagaauuaccucgauuacaugaccagcaugaagagauucaaaaacgaauccgaccccgagggcgcccugugguga

SEQ ID NO: 18836 - RNA, 9879 nt, Artificial Sequence
  derived and/or modified CDS sequence (opt5) from DENV-1__EU677165__SS-prME
agcgugaccaugcugcucaugcugaugcccaccgcccuugcuuuccaccugacgaccagaggaggggaaccucauaugaucguguccaagcaggaacggggaaaaucucuccuguuuaagacaagcgccggcguuaacaugugcacccuuauugcgauggaccugggggagcucugugaagauacaaucaccuacaaaugccccagaauuacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauccagcggguugaaaccugggcccugcgccaccccggcuucacagugauugcucuuuuucuggcccaugcgaucgggaccucuaucacccagaagggaauuaucuucauucuccugaugcuugccacaccuagcauggcuaugagaugcgucggcaucgggucccgggauuuuguggagggacugagcggcgccacguggguugacgugguccucgagcacgggucuugugugaccacaauggcuaaggauaaacccacccuggacauugaacugcucaagacagaggugaccaacccugccguccugcgcaaacuuugcaucgaagcgaagauuuccaauacgacaaccgauagcagauguccgacccaaggagaggccacacugguugaagaacaggacgcuaacuucgugugccggcgcaccuuuguggauagaggcuggggcaauggguguggacucuucggcaaagggucucugaucacaugcgccaaguuuaagugcgucacgaaacuugagggaaagaucgugcaguacgaaaaccugaaauauuccguuauugugaccguccacacaggcgaccagcaucaaguggggaaugagagcaccgaacacggaacaaccgcuacgaucacaccccaggccccuacaaccgagauucagcucacagacuacggcgcccugacccuggauuguucuccccggacgggccucgacuucaacgaaaugguucugcuuacaaugaaggagaaauccuggcuggugcauaagcagugguuucucgaucugccucuucccuggaccagcggggcuuccacaucucaagagaccuggaaucgccaggaccugcucgucaccuucaaaacagcgcacgccaagaagcaggaaguggucgugcugggaagccaagagggcgcuaugcacacggcccugaccggggccacagaaauccagaccuccggaacaaccacgauuuuugcuggccaucucaaaugcagacugaagauggauaaacuuacacugcgggggaugagcuauguuauguguaccggcucuuucaagcucgagaaagaaguggccgagacccagcacggaacaguccuggugcagaucaaguacgagggcaccgacgcgccgugcaagaucccuuucuccacacaagaugaaaaagggguuacgcagaacggaagacugauuaccgcuaaucccaucgugacagacaaggagaaaccugucaacauugaagccgagccgcccuuuggcgagagcuauaucgugauuggggccggagaaaaggcucuuaaacucucuugguucaagaagggcagcuccaucgggaaaauguuugaggccaccgcucgcggcgcccggagaauggcgauccugggagauacagccugggacuucggcucuauugggggaguguuuaccagcguuggcaagcugguccaucagaucuucgggacggcuuacggagugcucuuuuccggcgugagcuggaccaugaaaauugggaucggcguccugcuuacauggcugggacucaauucucgcuccaccagccugucuaugacauguauugccgugggccugguuacccuuuaccucggggugaugguccaggcugauuccggaugcgugaucaacuggaagggccgggaacugaaaugugggagcggaauuuucguuacaaaugaggugcacaccuggacggaacaauauaaguuucaggccgacuccccuaagagacugucugcggccaucggcaaggcuugggaggagggggucugcggcauccgcagcgccacacggcucgaaaacauuauguggaagcagaucuccaacgagcugaaucauauucuucuggaaaacgacaugaaauucaccgugguugugggagaugucgcuggcauccucgcccaggggaagaaaaugauuagaccgcaacccauggagcacaaguacucuuggaaaagcuggggaaaggccaagaucaucggcgcugacgugcagaauaccacauuuauuaucgaugggccuaacacccccgaauguccugacgaucagcgcgcguggaauauuugggagguggaggacuauggauucggcaucuuuacgacaaacauuuggcugaaacugcgggauuccuacacccaggucugcgaccacagacuuaugagcgccgcuaucaaggauucuaaagccguucaugccgacaugggcuauuggaucgaauccgagaagaaugaaacauggaaacucgcucgcgccagcuucauugaggugaagaccuguaucuggcccaagucucacacacugugguccaacggggugcuggaaagcgagaugauuaucccgaaaauuuacggaggcccuaucucucaacauaauuaucggcccggguacuucacccagacggcgggaccuuggcaccucggcaagcuggagcuugauuuugaccugugcgaagggaccacagucgugguugaugagcacugcggaaacagaggccccagccuccggaccacaaccgugacgggcaaaaucauucaugaaugguguugccgcuccuguacacugccuccccugagauucagaggggaagacggaugcugguacggcauggagauccggccggucaaggaaaaagaggaaaaucuugugaaaagcaugguuucugcuggguccggagagguggacagcuuuucccucggccugcuguguauuucuaucaugauugaagaggucaugcgcagccggugguccagaaagaugcucaugaccgggacacuggccguguucuuucuucugaucaugggacagcucaccuggaacgaucugauucgccugugcaucaugguuggcgccaaugcuucugacagaaugggcauggggaccacauaucuugcccugauggcgacguucaaaaugcggccuauguuugcugugggacuccuguuccgcagacucaccagccgggagguccugcuucugacaaucggccucucccugguggccucuguggaacugcccaacagccuugaggaacugggggauggacucgccaugggcauuaugauccugaagcuccugaccgacuuucaaucccaccagcuuugggcuacacugcucagccugaccuucauuaaaacgacauuuucucugcauuacgccuggaagaccauggcuaugguccuuuccaucguuagccuguucccccucugucugucuaccacaucccagaaaaccacauggcucccugugcugcuugggagccugggaugcaagccgcugacgauguuucucauugccgagaauaagaucuggggccgcagaucuuggccccugaacgaaggcaucauggcgguggggauugucuccauccuucugagcucccuccugaaaaacgaugugccucucgccggaccccugauugcuggcgggaugcuuaucgccuguuauguuauuagcggaucuagcgcugaccugucccuggagaaggccgccgaggugucuugggaagaggaagcugagcacagcggcgcgucccauaauauccucgucgaagugcaggaugacgggaccaugaaaaucaaggaugaggagcgggacgauacacugaccauucuucugaaagccacacuccuggcuguuucuggaguguacccucucagcauccccgccacccuguucgucugguauuucuggcaaaagaaaaagcagcgcuccggcgugcuuugggacacgccuucucccccggaagucgagagagccgugcuggaugacggcauuuaccggaucaugcagcgcgggcugcucggaagaagccagguuggcgugggggucuuucaagaaaacguguuccacaccauguggcacguuacacggggagcugugcugauguaucagggcaagagacuugagccuuccugggccagcgucaaaaaggaccugauuucuuacgggggaggcuggcgccuccagggcuccuggaauaccggggaggaaguccaggugaucgcgguugagcccggcaagaauccuaagaauguccaaacagcucccggcaccuuuaaaacaccggaaggggaggugggagccauugcccuggauuucaagccuggcacgagcgggucucccaucgugaaccgggaaggaaagaucgucggccucuacggcaauggggugguuaccacauccggaaccuaugugagcgcuauugcccaggcgaaggcuucccaggagggcccucugcccgagaucgaagacgaggucuuuagaaagcgcaaccuuaccauuauggaucugcaucccgggucuggaaaaacacggagauaccugccugccaucgugcgcgaagccauuaagcggaaacucagaacgcugauccuugcuccgacccgcguuguggccagcgagauggcugaagcccugaagggcaugcccauccgguaucaaacaaccgcggucaaguccgagcacacagggaaagagauuguggaccucaugugccaugccaccuucacgaugagacugcugagcccuguucgggugcccaauuacaacaugaucauuauggaugaagcucacuuuacagacccuucuuccaucgccgcucgcggcuauauuagcaccagagucggaaugggcgaggccgccgcuaucuucaugaccgcgacacccccugggucuguggaagccuuuccgcagagcaaugcugugauccaggaugaggaacgggacauucccgagcgcuccuggaacucuggauacgaguggaucaccgauuucccuggcaagacagucugguuuguucccagcauuaaauccgggaaugacaucgccaacugucucagaaagaauggaaaacgggugauucagcuuucuagaaagaccuucgauacggaauaucaaaagaccaaaaacaacgacugggacuacguggucaccacagauaucagcgagaugggcgccaauuuccgcgcugaccgggugauugauccuagacgcugccugaagcccguuauccugaaagacgggccggaacgggugauccucgccggcccuaugcccgucaccguggcguccgcugcccagagacgcggacggauuggcagaaaccauaauaaggagggggaucaguacaucuauaugggacagccccugaacaaugacgaggaucacgcccacuggacggaagcuaaaaugcuucuggacaacauuaauaccccugagggcaucauucccgcccucuuugaaccugagcgcgaaaagagcgcggccaucgauggggaguacagacugcggggagaggcucgcaagacauucguugaacugaugagacggggcgaccucccgguguggcuuucuuauaaagucgccuccgagggguuucaauacagcgaucgcagauggugcuucgacggcgaacggaacaaucaggugcuggaggaaaacauggaugucgagaucuggaccaaggagggagaacgcaaaaagcugcgcccccgguggcucgacgcuagaacauauuccgacccucuggcccuucgcgaguuuaaagaguucgcugccggccggagaucugugagcggggaucugauucucgagaucggaaagcugccccagcaucugacccagcgggcgcaaaaugcccucgacaaccuuguuaugcugcacaauuccgaacagggcgggcgcgcuuacagacaugccauggaggagcugccugauacaauugaaacccucaugcugcuugcucugaucgccgugcucacgggaggcgugacacuguuuuuccugucuggccgggggcucggaaaaaccagcauuggccuucugugugucauggccuccagcguucugcucuggauggcuucuguggagccccacuggaucgcggccuccaucauucuggaauuuuuccuuauggugcugcucaucccggagccugaccgccagagaacaccccaggauaaccaacuggcuuaugucgugauugggcugcucuuuaugauccuuacaguugccgccaaugagaugggacugcuggaaaccacaaagaaggaccucggcauugggcacguggcugucgagaaccaucaccaugccgcgaugcuggauguggaccuucacccugccagcgcuuggacgcuguacgccgucgcuaccacaaucauuacccccaugaugcggcauacaaucgaaaacaccacggccaauaucucucucaccgcgauugccaaccaggcugccauccugaugggacuggauaaaggcuggccuauuuccaagauggacaucggcgugccccuccuugcucuggggugcuacagccagguuaauccgcugacacucaccgccgcugugcugaugcuugucgcccacuaugcgauuaucggaccuggccugcaagccaaagcuacacgcgaggcccagaagagaaccgcugccgggaucaugaaaaaccccacgguggauggaauuguugccaucgaccucgaucccguggucuacgacgcgaaguucgaaaagcagcugggccagauuaugcugcucauccuuuguacaucucaaauucugcugaugcggaccacaugggcucucugcgagagcaucacccuggccaccgggccucuuacaacgcugugggagggauccccgggcaaauuuuggaauaccacaaucgcugugucuauggccaacauuuuccgcggcagcuaucucgccggggcuggacuggccuucucccugaugaaaagccucggcgggggaagacggggcaccggggcgcagggagaaacacuuggcgagaaauggaagagacagcugaaucagcuguccaaaucugaauuuaacaccuacaagcgcagcggcaucauggagguggaccgguccgaagccaaggaggggcucaaaagaggagagacgacaaagcacgcuguuucucgcggcaccgccaaacugcggugguucgucgaaagaaaucuugugaagcccgaggggaaagugauugaucugggauguggccgcgggggauggagcuauuacugcgcuggccucaagaaggucaccgaaguuaaaggcuauacaaaagggggaccuggccaugaggaacccaucccuauggccaccuacggguggaaccuggugaaacugcacuccggaaaggacguguuuuucauucccccugagaaaugugauacacuccuuugcgacaucggcgagucuagcccgaaucccacgauugaagaggggcggacccugagaguccugaagaugguggaaccuuggcuccgcggaaaccaauuuuguaucaaaauccugaaucccuacaugccuuccguuguggagacacuugagcagaugcagcggaagcauggcggcaugcuggucagaaacccccucagccgcaauucuacccacgaaauguauuggguguccugcgggacaggaaacauuguuagcgcggugaauaugaccucucggaugcugcugaacagauucacgauggcccaccgcaagccgaccuacgagagagaugucgaccucggcgcugggacacggcauguggccguggaaccugaggucgcuaaccuggauaucauuggacagcgcaucgaaaauauuaaacacgagcauaaguccaccuggcacuaugacgaggauaaccccuacaaaacaugggccuaucauggcagcuacgaaguuaagcccucuggguccgcuagcuccauggugaauggaguggucaaacuucugaccaagccuugggacgugauccccaugguuacacaaaucgccaugaccgauacgacaccuuuuggccagcagagaguguucaaggagaaagucgacacccggaccccgaaggcgaaaagaggcacagcccaaauuauggaagugacggcuaaguggcucuggggguuucuggcccggaacaaaaagccccgcaucuguaccagagaggaguucacacggaagguucgcagcaaugcugccauuggagccguguuugucgacgagaaccaguggaacucugcgaaagaggcuguggaagaugagagauucugggaccuuguucaccgggaacgcgagcugcacaagcagggcaaaugcgcuaccugcguguauaacaugauggggaagagagagaaaaagcucggagaguuuggcaaggccaaagggagccgggcuaucugguacauguggcugggcgcccgcuuccuggaguucgaagcucucggauuuaugaaugaggaucauugguucuccagagaaaacucucugagcggcgucgagggggagggacuucacaagcugggcuacauucuccgggacaucuccaaaaucccugggggaaauauguaugccgaugacacagcgggcugggauacccgcauuacagaagacgaucugcagaacgaggccagaaucaccgacauuauggaacccgagcaugcccuucuggccaagucuaucuuuaaacucacguaccaaaauaaggugguccgggugcagcgcccugcuaaaaacgggaccguuauggaugugauuagcagacgggaccagagaggcuccggacaggucggcacauaugggcugaauaccuucacaaacauggaagcccaacugauccgccagauggagucugagggaaucuuuagccccuccgaacucgagaccccgaaccuggcggaacgggugcuugauuggcuggagaaguacggcguggaaagacucaagcgcauggccauuagcggggacgacuguguugugaaaccuaucgaugaccgguucgcuacggcccugacagcucuuaaugauaugggaaaggucagaaaagacauuccccagugggagccuucuaagggcuggaacgauuggcagcaagugcccuuuugcucccaccacuuccaucagcugaucaugaaagacgggcgcgagauuguugugccuugucggaaucaggaugaacucgucggcagagcccgcgugagccagggagcuggcuggucucugcgggagaccgccugccuggggaaguccuaugcgcaaauguggcagcucauguacuuucacagacgcgaccugcggcuugccgcuaacgccaucuguagcgccguccccguggauuggauuccgacauccagaaccacguggucuauccaugcucaccaucaguggaugaccacagaagacaugcugagcguuuggaaucggguguggaucgaggaaaacccuuggauggaggauaagacccacauuuccagcuggggagacguccccuaucucggcaaaagagaggaccaauggugcgggucucugaucggacuuacagcccgcgcgaccugggcuacaaauauucagguggccaucaaccagguucggagacugauuggcaaugaaaacuaccucgauuacaugaccuccaugaagcgcuucaaaaaugagagcgaccccgaaggggcccugugguga

SEQ ID NO: 18837 - RNA, 9879 nt, Artificial Sequence
  derived and/or modified CDS sequence (opt5) from DENV-1__EU677140__SS-prME
agcgugaccaugcugcucaugcugaugcccacagcccuugcuuuccaccugacgaccagaggcggggaaccucauaugaucguguccaagcaggaacggggaaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauuaucauuggggccggagaaaaagcccuuaagcucucuugguucaagaaaggcagcuccaucgggaagauguuugaggcuaccgccagaggcgcucgccggauggccauccugggagauacagcgugggacuucggcucuauugggggaguguuuaccagcguuggcaaacugguccaucagaucuucgggacggccuacggagugcucuuuuccggcgugagcuggaccaugaagauugggaucggcguccugcuuacauggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcugucugccgcgaucggcaaggccugggaggagggggucugcggcaucagaagcgcuacacgccucgaaaacauuauguggaaacagaucuccaacgagcugaaucauauucuucuggaaaacgacaugaaguucaccgugguugugggagaugucgccggcauccucgcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaagcugcgcgauucccacacccaggucugcgaccaccggcuuaugagcgcggccaucaaagauucuaaggcuguucaugccgacaugggcuauuggaucgaauccgagaaaaaugaaacauggaagcucgccagagcuagcuucauugaggugaagaccuguaucuggcccaaaucucacacacugugguccaacggggugcuggaaagcgagaugauuaucccgaagauuuacggaggcccuaucucucaacauaauuaucgccccggguacuucacccagacggccggaccuuggcaccucggcaaacuggagcuugauuuugaccugugcgaagggaccacagucgugguugaugagcacugcggaaaccggggccccagccucagaaccacaaccgugacgggcaagaucauucaugaaugguguugccgguccuguacacugccuccccugcgcuucagaggggaggacggaugcugguacggcauggagauccggccggucaaagaaaaggaggaaaaucuugucaagagcaugguuucugcgggguccggagagguggacagcuuuucccucggccugcuguguauuucuaucaugauugaagaggucaugagaagccgcuggucccggaaaaugcucaugaccgggacacuggcuguguucuuucuucugaucaugggacagcucaccuggaacgaucugauuagacugugcaucaugguuggcgccaaugccucugaccgcaugggcauggggaccacauaucuugcucugauggccacguucaagaugagaccuauguuugcggugggacuccuguuccggcgccucaccagcagagagguccugcuucugacaaucggccucucccugguggcuucuguggaacugcccaacagccuugaggaacugggggauggacucgccaugggcauuaugauccugaaacuccugaccgacuuucaaucccaccagcuuugggccacacugcucagccugaccuucauuaagacgacauuuucucugcauuacgcuuggaaaaccauggccaugguccuuuccaucguuagccuguucccccucugucugucuaccacaucccagaagaccacauggcucccugugcugcuugggagccugggaugcaagccgcugacgauguuucucauugcugagaauaaaaucuggggccggcgcucuuggccccugaacgaaggcaucauggccguggggauugucuccauccuucugagcucccuccugaagaacgaugugccucucgcgggaccccugauugccggcgggaugcuuaucgcuuguuauguuauuagcggaucuagcgccgaccugucccuggagaaagcugccgaggugucuugggaagaggaagccgagcacagcggcgcuucccauaauauccucgucgaagugcaggaugacgggaccaugaagaucaaagaugaggagagagacgauacacugaccauucuucugaaggcgacacuccuggccguuucuggaguguacccucucagcauccccgcuacccuguucgucugguauuucuggcagaagaagaagcagcgguccggcgugcuuugggacacgccuucucccccggaagucgagcgcgccgugcuggaugacggcauuuacagaaucaugcagcgggggcugcucggacgcagccagguuggcgugggggucuuucaagaaaacguguuccacaccauguggcacguuacaagaggagccgugcugauguaucagggcaaacggcuugagccuuccugggcuagcgucaagaaagaccugauuucuuacgggggaggcuggagacuccagggcuccuggaauaccggggaggaaguccaggugaucgccguugagcccggaaagaacccuaaaaauguccaaacagcgcccggcaccuuuaagacaccggaaggggaggugggagcuauugcccuggauuucaagccuggcacgagcgggucucccaucgugaaccgcgaaggaaaaaucgucggccucuacggcaauggggugguuaccacauccggaaccuaugugagcgccauugcucaggccaaggcgucccaggagggcccucugcccgagaucgaagacgaggucuuucggaaaagaaaccuuaccauuauggaucugcaucccgggucuggaaagacacgccgguaccugccugcuaucgugagagaagccauuaaacgcaagcuccggacgcugauccuugccccgaccagaguuguggcuagcgagauggccgaagcucugaagggcaugcccauccgcuaucaaacaaccgccgucaaauccgagcacacagggaaggagauuguggaccucaugugccaugcgaccuucacgaugcggcugcugagcccuguuagagugcccaauuacaacaugaucauuauggaugaagcccacuuuacagacccuucuuccaucgcugcccggggcuauauuagcacccgcgucggaaugggcgaggcugccgccaucuucaugaccgcuacacccccugggucuguggaagcguuuccgcagagcaaugccgugauccaggaugaggaaagagacauucccgagcgguccuggaacucuggauacgaguggaucaccgauuucccuggcaaaacagucugguuuguucccagcauuaaguccgggaaugacaucgcuaacugucuccgcaaaaauggaaagagagugauucagcuuucucggaagaccuucgauacggaauaucagaaaaccaagaacaacgacugggacuacguggucaccacagauaucagcgagaugggcgccaauuucagagccgaccgcgugauugauccucggagaugccugaaacccguuauccugaaggacgggccggaacgcgugauccucgcuggcccuaugcccgucaccguggccuccgcggcucagcggagaggacgcauuggccggaaccauaauaaagagggggaucaguacaucuauaugggacagccccugaacaaugacgaggaucacgcccacuggacggaagccaagaugcuucuggacaacauuaauaccccugagggcaucauucccgcucucuuugaaccugagagagaaaagagcgccgcgaucgauggggaguaccgccugagaggagaggcccggaaaacauucguugaacugaugcgcagaggcgaccucccgguguggcuuucuuauaaggucgcuuccgagggguuucaauacagcgaucggcgcuggugcuucgacggcgaaagaaacaaucaggugcuggaggaaaacauggaugucgagaucuggaccaaagagggagaacggaagaaacugagaccccgcuggcucgacgcccggacauauuccgacccucuggcucuuagagaguuuaaggaguucgccgcuggccgccggucugugagcggggaucugauucucgagaucggaaaacugccccagcaucugacccagagagcccaaaaugcgcucgacaaccuuguuaugcugcacaauuccgaacagggcgggcgggccuaccgccaugcuauggaggagcugccugauacaauugaaacccucaugcugcuugcccugaucgcugugcucacgggaggcgugacacuguuuuuccugucuggcagagggcucggaaagaccagcauuggccuucugugugucauggccuccagcguucugcucuggauggccucuguggagccccacuggaucgcugcguccaucauucuggaauuuuuccuuauggugcugcucaucccggagccugaccggcagcgcacaccccaggauaaccaacuggccuaugucgugauugggcugcucuuuaugauccuuacaguugcugccaaugagaugggacugcuggaaaccacaaagaaagaccucggcauugggcacguggccgucgagaaccaucaccaugcugccaugcuggauguggaccuucacccugcgagcgccuggacgcuguacgcugucgccaccacaaucauuacccccaugaugagacauacaaucgaaaacaccacggcuaauaucucucucaccgccauugcgaaccaggccgcuauccugaugggacuggauaagggcuggccuauuuccaaaauggacaucggcgugccccuccuugcccuggggugcuacagccagguuaauccgcugacacucaccgcugccgugcugaugcuugucgcucacuaugccauuaucggaccuggccugcaagcgaaggccacacgggaggcucagaaacgcaccgccgcugggaucaugaagaaccccacgguggauggaauuguugccaucgaccucgaucccguggucuacgacgccaaguucgaaaaacagcugggccagauuaugcugcucauccuuuguacaucucaaauucugcugaugagaaccacaugggcgcucugcgagagcaucacccuggcuaccgggccucuuacaacgcugugggagggauccccgggcaaguuuuggaauaccacaaucgccgugucuauggcuaacauuuuccggggcagcuaucucgccggggccggacuggcuuucucccugaugaaaagccucggcgggggacgcagaggcaccggggcccagggagaaacacuuggcgagaaguggaaacggcagcugaaucagcuguccaagucugaauuuaacaccuacaagagaagcggcaucauggagguggaccgcuccgaagcgaaagaggggcucaagcggggagagacgacaaaacacgccguuucuagaggcaccgcuaagcugcgcugguucgucgaacggaaucuugugaaacccgaggggaaggugauugaucugggauguggcagagggggauggagcuauuacugcgccggccucaagaaagucaccgaaguuaagggcuauacaaaagggggaccuggccaugaggaacccaucccuauggcuaccuacggguggaaccuggugaagcugcacuccggaaaagacguguuuuucauucccccugagaagugugauacacuccuuugcgacaucggcgagucuagcccgaaucccacgauugaagaggggcgcacccugcggguccugaaaaugguggaaccuuggcucagaggaaaccaauuuuguaucaagauccugaaucccuacaugccuuccguuguggagacacuugagcagaugcagcgcaagcauggcggcaugcugguccggaacccccucagcagaaauucuacccacgaaauguauuggguguccugcgggacaggaaacauuguuagcgccgugaauaugaccucucgcaugcugcugaaccgguucacgauggcgcacagaaaaccgaccuacgagcgcgaugucgaccucggcgccgggacaagacauguggcuguggaaccugaggucgccaaccuggauaucauuggacagcggaucgaaaauauuaagcacgagcauaaauccaccuggcacuaugacgaggauaaccccuacaagacaugggcuuaucauggcagcuacgaaguuaaacccucuggguccgccagcuccauggugaauggaguggucaaacuucugaccaagccuugggacgugauccccaugguuacacaaaucgcuaugaccgauacgacaccuuuuggccagcagcgcguguucaaagagaaggucgacaccagaaccccgaaagccaagcggggcacagcgcaaauuauggaagugacggccaaauggcucuggggguuucugagcagaaacaagaagccccggaucuguacccgcgaggaguucacaagaaaaguucggucuaaugcugccauuggagcuguguuugucgacgagaaccaguggaauagcgccaaggaggccguggaagaugagcgcuucugggaccuuguucacagagaacgggagcugcacaaacagggcaagugcgcgaccugcguguauaacaugauggggaaacgcgaaaagaagcucggagaguuuggcaaagcuaagggguccagagccaucugguacauguggcugggcgcccgguuccuggaguucgaagcucucggauuuaugaaugaggaucauugguucucucgcgaaaacagccuguccggcgucgagggggagggacuucacaaacugggcuacauucucagagacaucucuaagaucccugggggaaauauguaugccgaugacacagcuggcugggauacccggauuacagaagacgaucugcagaacgaggcccgcaucaccgacauuauggaacccgagcaugcgcuucuggccaaaagcaucuuuaagcucacguaccaaaauaaaguggucagagugcagcggccugcuaagaacgggaccguuauggaugugauuucccgcagagaccagcggggcucuggacaggucggcacauaugggcugaauaccuucacaaacauggaagcccaacugaucagacagauggagagcgagggaaucuuuucccccagcgaacucgagaccccgaaccuggcugaacgcgugcuugauuggcugaagaaauacggcguggagcggcucaagagaauggccauuucuggggacgacuguguugugaaaccuaucgaugaccgcuucgcgacggcccugacagcucuuaaugauaugggaaagguccggaaagacauuccccagugggaaccuuccaagggcuggaacgauuggcagcaagugcccuuuugcagccaccacuuccaucagcugaucaugaaggacgggagagagauuguugugccuugucgcaaucaggaugagcucgucggccgggccagagugucucagggagcuggcuggucccugcgcgaaaccgccugccuggggaaaagcuaugcucaaauguggcagcucauguacuuucaccggagagaccugcgccuugccgcgaacgccaucuguuccgcuguccccguggauuggauuccgacaucucggaccacguggagcauccaugcccaccaucaguggaugaccacagaggacaugcuguccguuuggaauagaguguggaucgaagagaacccuuggauggaagauaagacccacauuagcucuuggggagacguccccuaucucggcaaacgggaggaccaauggugcgggucccugaucggacuuacagccagagcuaccugggccacaaauauucagguggcgaucaaccagguucgccggcugauuggcaaugagaacuaccucgauuacaugaccagcaugaagagauucaaaaaugaaggggaccccgagggcgcucugugguga

SEQ ID NO: 18838 - RNA, 9879 nt, Artificial Sequence
  derived and/or modified CDS sequence (opt5) from DENV-1__EU677166__SS-prME
agcgugaccaugcugcucaugcugaugcccacagcccuugcuuuccaccugacgaccagaggcggggaaccucauaugaucgucuccaagcaggaacgggggaaaucucuccuguuuaagacaagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccagacggccggaccuuggcaucucggcaaacuggagcuugauuuugaccugugcgaagggaccacagugguuguggaugagcacugcggaaaccggggccccagccucagaaccacaaccgucacgggcaagaucauccacgaaugguguugccgguccuguacacugccuccccugcgcuucagaggggaggacggaugcugguauggcauggagauucggccggugaaagaaaaggaggaaaaucuuguuaagagcauggugucugcgggguccggagaggucgacagcuuuucccucggccugcuguguaucucuauuaugaucgaagaggugaugagaagccgcuggucccggaaaaugcucaugaccgggacacuggcuguuuucuuucuucugauuaugggacagcucaccuggaacgaucugaucagacugugcauuauggugggcgccaaugccucugaccgcaugggcauggggaccacauaccuugcucugauggccacguucaagaugagaccuauguuugcggucggacuccuguuccggcgccucaccagcagagaggugcugcuucugacaaucggccucucccugguggcuucugucgaacugcccaacagccuugaggaacugggggauggacucgccaugggcaucaugauucugaaacuccugaccgacuuucaaucccaucagcuuugggccacacugcucagccugaccuucaucaagacgacauuuucucugcacuaugcuuggaaaaccauggccaugguucuuuccauugugagccuguucccccucugucugucuaccacaucccagaagaccacauggcucccugugcugcuugggagccugggaugcaagccgcugacgauguuucucaucgcugagaauaaaauuuggggccggcgcucuuggccccugaacgaaggcaucauggccgucgggaucguguccauucuucugagcucccuccugaagaacgauguuccucucgcgggaccccugaucgccggcgggaugcuuauugcuuguuacgugaucagcggaucuagcgccgaccugucccuggagaaagcugccgaggucucuugggaagaggaagccgagcauagcggcgcuucccacaauauucucguggaaguucaggaugacgggaccaugaagaucaaagaugaggagagagacgauacacugaccauccuucugaaggcgacacuccuggccgugucuggagucuauccucucagcauucccgcuacccuguucgugugguacuucuggcagaagaagaagcagcgguccggcguccuuugggacacgccuucucccccggaaguggagcgcgccguucuggaugacggcaucuauagaauuaugcagcgggggcugcucggacgcagccaggugggcgucgggguguuucaagaaaacguuuuccauaccauguggcacgugacaagaggagccguccugauguaccagggcaaacggcuugagccuuccugggcuagcgugaagaaagaccugaucucuuacgggggaggcuggagacuccagggcuccuggaauaccggggaggaagugcagguuauugccgucgagcccggaaagaacccuaaaaaugugcaaacagcgcccggcaccuuuaagacaccggaaggggaggugggagcuaucgcccuggauuucaagccuggcacgagcgggucucccauugucaaccgcgaaggaaaaaucgugggccucuauggcaaugggguugugaccacauccggaaccuacgucagcgccaucgcucaggccaaggcgucccaggagggcccucugcccgagauugaagacgagguguuucggaaaagaaaccuuaccaucauggaucugcaccccgggucuggaaagacacgccgguaucugccugcuauuguuagagaagccaucaaacgcaagcuccggacgcugauucuugccccgaccagaguggucgcuagcgagauggccgaagcucugaagggcaugcccauccgcuaccaaacaaccgccgugaaauccgagcauacagggaaggagaucguugaccucaugugccacgcgaccuucacgaugcggcugcugagcccugugagaguccccaauuauaacaugauuaucauggaugaagcccauuuuacagacccuucuuccauugcugcccggggcuacaucagcacccgcgugggaaugggcgaggcugccgccauuuucaugaccgcuacacccccugggucuguggaagcguuuccgcagagcaaugccgucauccaggaugaggaaagagacauccccgagcgguccuggaacucuggauaugaguggauuaccgauuucccuggcaaaacaguuugguuugugcccagcaucaaguccgggaaugacauugcuaacugucuccgcaaaaauggaaagagagugauccagcuuucucggaagaccuucgauacggaauaccagaaaaccaagaacaacgacugggacuacgucgugaccacagauauuagcgagaugggcgccaauuucagagccgaccgcguuaucgauccucggagaugccugaaacccgugauucugaaggacgggccggaacgcgucauccucgcuggcccuaugcccgugaccguugccuccgcggcucagcggagaggacgcaucggccggaaccacaauaaagagggggaucaguauauuuacaugggacagccccugaacaaugacgaggaucaugcccacuggacggaagccaagaugcuucuggacaacaucaauaccccugagggcauuauccccgcucucuuugaaccugagagagaaaagagcgccgcgauugauggggaguaucgccugagaggagaggcccggaaaacauucguggaacugaugcgcagaggcgaccucccggucuggcuuucuuacaagguggcuuccgagggguuucaauauagcgaucggcgcuggugcuucgacggcgaaagaaacaaucagguccuggaggaaaacauggauguggagaucuggaccaaagagggagaacggaagaaacugagaccccgcuggcucgacgcccggacauacuccgacccucuggcucuuagagaguuuaaggaguucgccgcuggccgccggucuguuagcggggaucugauccucgagauuggaaaacugccccagcaccugacccagagagcccaaaaugcgcucgacaaccuugugaugcugcauaauuccgaacagggcgggcgggccuaucgccacgcuauggaggagcugccugauacaaucgaaacccucaugcugcuugcccugauugcugugcucacgggaggcgucacacuguuuuuccugucuggcagagggcucggaaagaccagcaucggccuucuguguguuauggccuccagcgugcugcucuggauggccucuguggagccccauuggauugcugcguccaucauccuggaauuuuuccuuaugguccugcucauuccggagccugaccggcagcgcacaccccaggauaaccaacuggccuacgugguuaucgggcugcucuuuaugauucuuacaguggcugccaaugagaugggacugcuggaaaccacaaagaaagaccucggcaucgggcacgucgccguggagaaccaccaucacgcugccaugcuggaugucgaccuucauccugcgagcgccuggacgcuguacgcuguggccaccacaauuaucacccccaugaugagacacacaauugaaaacaccacggcuaauaucucucucaccgccaucgcgaaccaggccgcuauucugaugggacuggauaagggcuggccuaucuccaaaauggacauuggcguuccccuccuugcccuggggugcuauagccaggugaauccgcugacacucaccgcugccguccugaugcuuguggcucauuacgccaucauuggaccuggccugcaagcgaaggccacacgggaggcucagaaacgcaccgccgcugggaucaugaagaaccccacgguugauggaaucguggccauugaccucgaucccgucguguaugacgccaaguucgaaaaacagcugggccagaucaugcugcucauucuuuguacaucucaaauccugcugaugagaaccacaugggcgcucugcgagagcauuacccuggcuaccgggccucuuacaacgcugugggagggauccccgggcaaguuuuggaauaccacaaucgccgugucuauggcuaacaucuuccggggcagcuaccucgccggggccggacuggcuuucucccugaugaaaagccucggcgggggacgcagaggcaccggggcccagggagaaacacuuggcgagaaguggaaacggcagcugaaucagcuguccaagucugaauuuaacaccuauaagagaagcggcauuauggagguugaccgcuccgaagcgaaagaggggcucaagcggggagagacgacaaaacacgccgucucuagaggcaccgcuaagcugcgcugguucguggaacggaaucuugugaaacccgaggggaaggucaucgaucugggauguggcagagggggauggagcuacuauugcgccggccucaagaaaguuaccgaagugaagggcuacacaaaagggggaccuggccacgaggaacccauuccuauggcuaccuacggguggaaccuggugaagcugcauuccggaaaagacgucuuuuucauucccccugagaagugugauacacuccuuugcgacauuggcgagucuagcccgaaucccacgaucgaagaggggcgcacccugcgggugcugaaaaugguugaaccuuggcucagaggaaaccaauuuuguauuaagauccugaaucccuauaugccuuccguggucgagacacuugagcagaugcagcgcaagcacggcggcaugcuggugcggaacccccucagcagaaauucuacccaugaaauguacuggguuuccugcgggacaggaaacaucgugagcgccgucaauaugaccucucgcaugcugcugaaccgguucacgauggcgcacagaaaaccgaccuaugagcgcgauguggaccucggcgccgggacaagacacguggcugucgaaccugagguugccaaccuggauauuaucggacagcggauugaaaauaucaagcaugagcacaaauccaccuggcauuacgacgaggauaaccccuauaagacaugggcuuaccacggcagcuaugaagugaaacccucuggguccgccagcuccauggugaauggagucgugaaacuucugaccaagccuugggacguuauucccauggugacacaaaucgcuaugaccgauacgacaccuuuuggccagcagcgcgucuucaaagagaagguggacaccagaaccccgaaagccaagcggggcacagcgcaaaucauggaaguuacggccaaauggcucuggggguuucugagcagaaacaagaagccccggauuuguacccgcgaggaguucacaagaaaagugcggucuaaugcugccaucggagcugucuuuguggacgagaaccaguggaauagcgccaaggaggccguugaagaugagcgcuucugggaccuugugcauagagaacgggagcugcacaaacagggcaagugcgcgaccugcgucuacaacaugauggggaaacgcgaaaagaagcucggagaguuuggcaaagcuaagggguccagagccauuugguacauguggcugggcgcccgguuccuggaguucgaagcucucggauuuaugaaugaggaucacugguucucucgcgaaaacagccuguccggcguggagggggagggacuucauaaacugggcuauauccucagagacauuucuaagaucccugggggaaauauguacgccgaugacacagcuggcugggauacccggaucacagaagacgaucugcagaacgaggcccgcauuaccgacaucauggaacccgagcacgcgcuucuggccagaagcauuuuuaaacucacguaucaaaauaaggucgugcggguucagcgcccugcuaaaaacgggaccgugauggaugucaucuccagacgggaccagagaggcucuggacaggugggcacauacgggcugaauaccuucacaaacauggaagcccaacugauucgccagauggagagcgagggaaucuuuucccccagcgaacucgagaccccgaaccuggcugaacgggugcuugauuggcuggagaaguauggcguugaaagacucaagcgcauggccaucucuggggacgacuguguggucaaaccuauugaugaccgguucgcgacggcccugacagcucuuaaugauaugggaaaggugagaaaagacaucccccagugggagccuuccaagggcuggaacgauuggcagcaaguucccuuuugcagccaucacuuccaccagcugauuaugaaagacgggcgcgagaucguggucccuugucggaaucaggaugaacucgugggcagagcccgcgucucucagggagcuggcuggucccugcgggagaccgccugccugggaaagagcuacgcucaaauguggcagcucauguauuuucauagacgcgaccugcggcuugccgcgaacgccauuuguuccgcugugcccguuaauuggaucccgacaucuagaaccacguggagcauucacgcccaucaccaguggaugaccacagaagauaugcuguccguguggaaccgggucuggaucgaggaaaauccuuggauggaggacaagacccauaucagcucuuggggagaugugcccuaccucggcaaaagagaggaccaauggugcgggucccugauuggacuuacagcccgcgcuaccugggccacaaacauccagguugcgauuaaucaggugcggagacugaucggcaacgaaaauuaccucgacuauaugaccagcaugaagcgcuucaaaaacgagucugaucccgaaggggcucugugguga

SEQ ID NO: 18839 - RNA, 9879 nt, Artificial Sequence
  derived and/or modified CDS sequence (opt5) from DENV-1__EU677170__SS-prME
agcgugaccaugcugcucaugcugaugcccacagcccuugcuuuccaccugacgaccagaggcggggaaccucauaugaucgucuccaagcaggaacgggggaaaucucuccuguuuaagacaagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggaugaagcugcgcgauuccuauacccagguuugcgaccaccggcugaugagcgcggccauuaaagauucuaaggcugugcacgccgacaugggcuacuggaucgaauccgagaaaaaugaaacauggaaacuugccagagcuagcuucaucgaggugaagaccuguauuuggcccaaaucucauacacucugguccaacgggguccuggaaagcgagaugaucauuccgaagaucuauggaggcccuauuucucaacacaauuaccgccccggguacuucacccagacggccggaccuuggcaucugggcaaacucgagcuggauuuugaccuuugcgaagggaccacagugguuguggaugagcacugcggaaaccggggccccagccugagaaccacaaccgucacgggcaagaucauccacgaaugguguugccgguccuguacacucccuccccugcgcuucagaggggaggacggaugcugguauggcauggagauucggccggugaaagaaaaggaggaaaaucugguuaagagcauggugucugcgggguccggagaggucgacagcuuuucccuuggccuccuguguaucucuauuaugaucgaagaggugaugagaagccgcuggucccggaaaaugcugaugaccgggacacucgcuguuuucuuucugcuuauuaugggacagcugaccuggaacgaucucaucagacugugcauuauggugggcgccaaugccucugaccgcaugggcauggggaccacauaccuggcucuuauggccacguucaagaugagaccuauguuugcggucggacuccuguuccggcgccugaccagcagagaggugcuccugcuuacaaucggccugucccucguggcuucugucgaacugcccaacagccuggaggaacuuggggauggacuggccaugggcaucaugauucucaaacugcucaccgacuuucaaucccaucagcugugggccacacuucugagccucaccuucaucaagacgacauuuucucugcacuaugcuuggaaaaccauggccaugguucuguccauugugagccuuuucccccugugucucucuaccacaucccagaagaccacauggcugccugugcuccuggggagccuuggaugcaagccgcugacgauguuucugaucgcugagaauaaaauuuggggccggcgcucuuggccccucaacgaaggcaucauggccgucgggaucguguccauucugcuuagcucccugcucaagaacgauguuccucuggcgggaccccucaucgccggcgggaugcugauugcuuguuacgugaucagcggaucuagcgccgaccuuucccuggagaaagcugccgaggucucuugggaagaggaagccgagcauagcggcgcuucccacaauauucugguggaaguucaggaugacgggaccaugaagaucaaagaugaggagagagacgauacacucaccauccugcuuaaggcgacacugcucgccgugucuggagucuauccucugagcauucccgcuacccucuucgugugguacuucuggcagaagaagaagcagcgguccggcguccugugggacacgccuucucccccggaaguggagcgcgccguucuugaugacggcaucuauagaauuaugcagcgggggcugcugggacgcagccaggugggcgucgggguguuucaagaaaacguuuuccauaccauguggcacgugacaagaggagccguccucauguaccagggcaaacggcuggagccuuccugggcuagcgugaagaaagaccuuaucucuuacgggggaggcuggagacugcagggcuccuggaauaccggggaggaagugcagguuauugccgucgagcccggaaagaacccuaaaaaugugcaaacagcgcccggcaccuuuaagacaccggaaggggaggugggagcuaucgcccucgauuucaagccuggcacgagcgggucucccauugucaaccgcgaaggaaaaaucgugggccuguauggcaaugggguugugaccacauccggaaccuacgucagcgccaucgcucaggccaaggcgucccaggagggcccucuccccgagauugaagacgagguguuucggaaaagaaaccugaccaucauggaucuucaccccgggucuggaaagacacgccgguaucugccugcuauuguuagagaagccaucaaacgcaagcugcggacgcucauucuggccccgaccagaguggucgcuagcgagauggccgaagcucuuaagggcaugcccauccgcuaccaaacaaccgccgugaaauccgagcauacagggaaggagaucguugaccugaugugccacgcgaccuucacgaugcggcuccugagcccugugagaguccccaauuauaacaugauuaucauggaugaagcccauuuuacagacccuucuuccauugcugcccggggcuacaucagcacccgcgugggaaugggcgaggcugccgccauuuucaugaccgcuacacccccugggucuguggaagcguuuccgcagagcaaugccgucauccaggaugaggaaagagacauccccgagcgguccuggaacucuggauaugaguggauuaccgauuucccuggcaaaacaguuugguuugugcccagcaucaaguccgggaaugacauugcuaacugucugcgcaaaaauggaaagagagugauccagcucucucggaagaccuucgauacggaauaccagaaaaccaagaacaacgacugggacuacgucgugaccacagauauuagcgagaugggcgccaauuucagagccgaccgcguuaucgauccucggagaugccuuaaacccgugauucugaaggacgggccggaacgcgucauccuggcuggcccuaugcccgugaccguugccuccgcggcucagcggagaggacgcaucggccggaaccacaauaaagagggggaucaguauauuuacaugggacagccccucaacaaugacgaggaucaugcccacuggacggaagccaagaugcugcuugacaacaucaauaccccugagggcauuauccccgcucuguuugaaccugagagagaaaagagcgccgcgauugauggggaguaucgccucagaggagaggcccggaaaacauucguggaacugaugcgcagaggcgaccugccggucuggcucucuuacaagguggcuuccgagggguuucaauauagcgaucggcgcuggugcuucgacggcgaaagaaacaaucagguccuugaggaaaacauggauguggagaucuggaccaaagagggagaacggaagaaacugagaccccgcuggcuggacgcccggacauacuccgacccucucgcucugagagaguuuaaggaguucgccgcuggccgccggucuguuagcggggaucuuauccuggagauuggaaaacucccccagcaccugacccagagagcccaaaaugcgcuggacaaccucgugaugcuucauaauuccgaacagggcgggcgggccuaucgccacgcuauggaggagcugccugauacaaucgaaacccugaugcuccuggcccuuauugcugugcugacgggaggcgucacacucuuuuuccugucuggcagagggcugggaaagaccagcaucggccuccuuuguguuauggccuccagcgugcugcuguggauggccucuguggagccccauuggauugcugcguccaucauccucgaauuuuuccugaugguccuucugauuccggagccugaccggcagcgcacaccccaggauaaccaacucgccuacgugguuaucgggcugcuguuuaugauucucacaguggcugccaaugagaugggacuucuggaaaccacaaagaaagaccugggcaucgggcacgucgccguggagaaccaccaucacgcugccaugcucgaugucgaccugcauccugcgagcgccuggacgcuuuacgcuguggccaccacaauuaucacccccaugaugagacacacaauugaaaacaccacggcuaauaucucucugaccgccaucgcgaaccaggccgcuauucucaugggacuggauaagggcuggccuaucuccaaaauggacauuggcguuccccugcucgcccuugggugcuauagccaggugaauccgcugacacugaccgcugccguccucaugcugguggcucauuacgccaucauuggaccuggccuucaagcgaaggccacacgggaggcucagaaacgcaccgccgcugggaucaugaagaaccccacgguugauggaaucguggccauugaccuggaucccgucguguaugacgccaaguucgaaaaacagcucggccagaucaugcugcugauucucuguacaucucaaauccuucugaugagaaccacaugggcgcugugcgagagcauuacccucgcuaccgggccucugacaacgcuuugggagggauccccgggcaaguuuuggaauaccacaaucgccgugucuauggcuaacaucuuccggggcagcuaccuggccggggccggacucgcuuucucccugaugaaaagccugggcgggggacgcagaggcaccggggcccagggagaaacacucggcgagaaguggaaacggcagcuuaaucagcuguccaagucugaauuuaacaccuauaagagaagcggcauuauggagguugaccgcuccgaagcgaaagaggggcugaagcggggagagacgacaaaacacgccgucucuagaggcaccgcuaagcuccgcugguucguggaacggaaucuggugaaacccgaggggaaggucaucgaucuuggauguggcagagggggauggagcuacuauugcgccggccugaagaaaguuaccgaagugaagggcuacacaaaagggggaccuggccacgaggaacccauuccuauggcuaccuacggguggaaccucgugaagcugcauuccggaaaagacgucuuuuucauucccccugagaagugugauacacugcucugcgacauuggcgagucuagcccgaaucccacgaucgaagaggggcgcacccuucgggugcugaaaaugguugaaccuuggcugagaggaaaccaauuuuguauuaagauccucaaucccuauaugccuuccguggucgagacacuggagcagaugcagcgcaagcacggcggcaugcuugugcggaacccccugagcagaaauucuacccaugaaauguacuggguuuccugcgggacaggaaacaucgugagcgccgucaauaugaccucucgcaugcuccugaaccgguucacgauggcgcacagaaaaccgaccuaugagcgcgauguggaccugggcgccgggacaagacacguggcugucgaaccugagguugccaaccucgauauuaucggacagcggauugaaaauaucaagcaugagcacaaauccaccuggcauuacgacgaggauaaccccuauaagacaugggcuuaccacggcagcuaugaagugaaacccucuggguccgccagcuccauggugaauggagucgugaagcugcuuaccaagccuugggacguuauucccauggugacacaaaucgcuaugaccgauacgacaccuuuuggccagcagcgcgucuucaaagagaagguggacaccagaaccccgaaagccaagcggggcacagcgcaaaucauggaaguuacggccaaauggcuguggggguuucucagcagaaacaagaagccccggauuuguacccgcgaggaguucacaagaaaagugcggucuaaugcugccaucggagcugucuuuguggacgagaaccaguggaauagcgccaaggaggccguugaagaugagcgcuucugggaccuggugcauagagaacgggagcuucacaaacagggcaagugcgcgaccugcgucuacaacaugauggggaaacgcgaaaagaagcugggagaguuuggcaaagcuaagggguccagagccauuugguacauguggcucggcgcccgguuccuggaguucgaagcucugggauuuaugaaugaggaucacugguucucucgcgaaaacagccucuccggcguggagggggagggacugcauaaacuuggcuauauccugagagacauuucuaagaucccugggggaaauauguacgccgaugacacagcuggcugggauacccggaucacagaagacgaucuccagaacgaggcccgcauuaccgacaucauggaacccgagcacgcgcugcuugccagaagcauuuuuaaacugacguaucaaaauaaggucgugcggguucagcgcccugcuaaaaacgggaccgugauggaugucaucuccagacgggaccagagaggcucuggacaggugggcacauacgggcucaauaccuucacaaacauggaagcccaacugauucgccagauggagagcgagggaaucuuuucccccagcgaacuggagaccccgauccucgcugaacgggugcuggauuggcuugagaaguauggcguugaaagacugaagcgcauggccauuucuggggacgacuguguggucaaaccuaucgaugaccgguucgcgacggcccucacagcucugaacgauaugggaaaggugagaaaagacauuccccagugggagccuuccaagggcuggaaugauuggcagcaaguucccuuuugcagccaucacuuccaccagcuuaucaugaaagacgggcgcgagauuguggucccuugucggaaccaggaugaacuggugggcagagcccgcgucucucagggagcuggcuggucccuccgggagaccgccugccugggaaagagcuacgcucaaauguggcagcugauguauuuucauagacgcgaccuccggcuggccgcgaaugccaucuguuccgcugugcccguugauuggauuccgacaucuagaaccacguggagcauccacgcccaucaccaguggaugaccacagaagacaugcuuuccguguggaaccgggucuggaucgaggaaaauccuuggauggaggauaagacccauauuagcucuuggggagacgugcccuaccugggcaaaagagaggaccaauggugcgggucccucaucggacugacagcccgcgcuaccugggccacaaacauucagguugcgaucaaucaggugcggagacuuauuggcaacgaaaauuaccuggauuauaugaccagcaugaagcgcuucaaaaacgagucugaccccgaaggggcucucugguga

SEQ ID NO: 18840 - RNA, 9879 nt, Artificial Sequence
  derived and/or modified CDS sequence (opt5) from DENV-1__EU677171__SS-prME
agcgugaccaugcugcucaugcugaugcccacagcccuugcuuuccaccugacgaccagaggcggggaaccucauaugaucgucuccaagcaggaacgggggaaaucucuccuguuuaagacaagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccagacggccggaccuuggcaucucggcaaacuggagcuugauuuugaccugugcgaagggaccacagugguuguggaugagcacugcggaaaccggggccccagccucagaaccacaaccgucacgggcaagaucauccacgaaugguguugccgguccuguacacugccuccccugcgcuucagaggggaggacggaugcugguauggcauggagauucggccggugaaagaaaaggaggaaaaucuuguuaagagcauggugucugcgggguccggagaggucgacagcuuuucccucggccugcuguguaucucuauuaugaucgaagaggugaugagaagccgcuggucccggaaaaugcucaugaccgggacacuggcuguuuucuuucuucugauuaugggacagcucaccuggaacgaucugaucagacugugcauuauggugggcgccaaugccucugaccgcaugggcauggggaccacauaccuugcucugauggccacguucaagaugagaccuauguuugcggucggacuccuguuccggcgccucaccagcagagaggugcugcuucugacaaucggccucucccugguggcuucugucgaacugcccaacagccuugaggaacugggggauggacucgccaugggcaucaugauucugaaacuccugaccgacuuucaaucccaucagcuuugggccacacugcucagccugaccuucaucaagacgacauuuucucugcacuaugcuuggaaaaccauggccaugguucuuuccauugugagccuguucccccucugucugucuaccacaucccagaagaccacauggcucccugugcugcuugggagccugggaugcaagccgcugacgauguuucucaucgcugagaauaaaauuuggggccggcgcucuuggccccugaacgaaggcaucauggccgucgggaucguguccauucuucugagcucccuccugaagaacgauguuccucucgcgggaccccugaucgccggcgggaugcuuauugcuuguuacgugaucagcggaucuagcgccgaccugucccuggagaaagcugccgaggucucuugggaagaggaagccgagcauagcggcgcuucccacaauauucucguggaaguucaggaugacgggaccaugaagaucaaagaugaggagagagacgauacacugaccauccuucugaaggcgacacuccuggccgugucuggagucuauccucucagcauucccgcuacccuguucgugugguacuucuggcagaagaagaagcagcgguccggcguccuuugggacacgccuucucccccggaaguggagcgcgccguucuggaugacggcaucuauagaauuaugcagcgggggcugcucggacgcagccaggugggcgucgggguguuucaagaaaacguuuuccauaccauguggcacgugacaagaggagccguccugauguaccagggcaaacggcuugagccuuccugggcuagcgugaagaaagaccugaucucuuacgggggaggcuggagacuccagggcuccuggaauaccggggaggaagugcagguuauugccgucgagcccggaaagaacccuaaaaaugugcaaacagcgcccggcaccuuuaagacaccggaaggggaggugggagcuaucgcccuggauuucaagccuggcacgagcgggucucccauugucaaccgcgaaggaaaaaucgugggccucuauggcaaugggguugugaccacauccggaaccuacgucagcgccaucgcucaggccaaggcgucccaggagggcccucugcccgagauugaagacgagguguuucggaaaagaaaccuuaccaucauggaucugcaccccgggucuggaaagacacgccgguaucugccugcuauuguuagagaagccaucaaacgcaagcuccggacgcugauucuugccccgaccagaguggucgcuagcgagauggccgaagcucugaagggcaugcccauccgcuaccaaacaaccgccgugaaauccgagcauacagggaaggagaucguugaccucaugugccacgcgaccuucacgaugcggcugcugagcccugugagaguccccaauuauaacaugauuaucauggaugaagcccauuuuacagacccuucuuccauugcugcccggggcuacaucagcacccgcgugggaaugggcgaggcugccgccauuuucaugaccgcuacacccccugggucuguggaagcguuuccgcagagcaaugccgucauccaggaugaggaaagagacauccccgagcgguccuggaacucuggauaugaguggauuaccgauuucccuggcaaaacaguuugguuugugcccagcaucaaguccgggaaugacauugcuaacugucuccgcaaaaauggaaagagagugauccagcuuucucggaagaccuucgauacggaauaccagaaaaccaagaacaacgacugggacuacgucgugaccacagauauuagcgagaugggcgccaauuucagagccgaccgcguuaucgauccucggagaugccugaaacccgugauucugaaggacgggccggaacgcgucauccucgcuggcccuaugcccgugaccguugccuccgcggcucagcggagaggacgcaucggccggaaccacaauaaagagggggaucaguauauuuacaugggacagccccugaacaaugacgaggaucaugcccacuggacggaagccaagaugcuucuggacaacaucaauaccccugagggcauuauccccgcucucuuugaaccugagagagaaaagagcgccgcgauugauggggaguaucgccugagaggagaggcccggaaaacauucguggaacugaugcgcagaggcgaccucccggucuggcuuucuuacaagguggcuuccgagggguuucaauauagcgaucggcgcuggugcuucgacggcgaaagaaacaaucagguccuggaggaaaacauggauguggagaucuggaccaaagagggagaacggaagaaacugagaccccgcuggcucgacgcccggacauacuccgacccucuggcucuuagagaguuuaaggaguucgccgcuggccgccggucuguuagcggggaucugauccucgagauuggaaaacugccccagcaccugacccagagagcccaaaaugcgcucgacaaccuugugaugcugcauaauuccgaacagggcgggcgggccuaucgccacgcuauggaggagcugccugauacaaucgaaacccucaugcugcuugcccugauugcugugcucacgggaggcgucacacuguuuuuccugucuggcagagggcucggaaagaccagcaucggccuucuguguguuauggccuccagcgugcugcucuggauggccucuguggagccccauuggauugcugcguccaucauccuggaauuuuuccuuaugguccugcucauuccggagccugaccggcagcgcacaccccaggauaaccaacuggccuacgugguuaucgggcugcucuuuaugauucuuacaguggcugccaaugagaugggacugcuggaaaccacaaagaaagaccucggcaucgggcacgucgccguggagaaccaccaucacgcugccaugcuggaugucgaccuucauccugcgagcgccuggacgcuguacgcuguggccaccacaauuaucacccccaugaugagacacacaauugaaaacaccacggcuaauaucucucucaccgccaucgcgaaccaggccgcuauucugaugggacuggauaagggcuggccuaucuccaaaauggacauuggcguuccccuccuugcccuggggugcuauagccaggugaauccgcugacacucaccgcugccguccugaugcuuguggcucauuacgccaucauuggaccuggccugcaagcgaaggccacacgggaggcucagaaacgcaccgccgcugggaucaugaagaaccccacgguugauggaaucguggccauugaccucgaucccgucguguaugacgccaaguucgaaaaacagcugggccagaucaugcugcucauucuuuguacaucucaaauccugcugaugagaaccacaugggcgcucugcgagagcauuacccuggcuaccgggccucuuacaacgcugugggagggauccccgggcaaguuuuggaauaccacaaucgccgugucuauggcuaacaucuuccggggcagcuaccucgccggggccggacuggcuuucucccugaugaaaagccucggcgggggacgcagaggcaccggggcccagggagaaacacuuggcgagaaguggaaacggcagcugaaucagcuguccaagucugaauuuaacaccuauaagagaagcggcauuauggagguugaccgcuccgaagcgaaagaggggcucaagcggggagagacgacaaaacacgccgucucuagaggcaccgcuaagcugcgcugguucguggaacggaaucuugugaaacccgaggggaaggucaucgaucugggauguggcagagggggauggagcuacuauugcgccggccucaagaaaguuaccgaagugaagggcuacacaaaagggggaccuggccacgaggaacccauuccuauggcuaccuacggguggaaccuggugaagcugcauuccggaaaagacgucuuuuucauucccccugagaagugugauacacuccuuugcgacauuggcgagucuagcccgaaucccacgaucgaagaggggcgcacccugcgggugcugaaaaugguugaaccuuggcucagaggaaaccaauuuuguauuaagauccugaaucccuauaugccuuccguggucgagacacuugagcagaugcagcgcaagcacggcggcaugcuggugcggaacccccucagcagaaauucuacccaugaaauguacuggguuuccugcgggacaggaaacaucgugagcgccgucaauaugaccucucgcaugcugcugaaccgguucacgauggcgcacagaaaaccgaccuaugagcgcgauguggaccucggcgccgggacaagacacguggcugucgaaccugagguugccaaccuggauauuaucggacagcggauugaaaauaucaagcaugagcacaaauccaccuggcauuacgacgaggauaaccccuauaagacaugggcuuaccacggcagcuaugaagugaaacccucuggguccgccagcuccauggugaauggagucgugaaacuucugaccaagccuugggacguuauucccauggugacacaaaucgcuaugaccgauacgacaccuuuuggccagcagcgcgucuucaaagagaagguggacaccagaaccccgaaagccaagcggggcacagcgcaaaucauggaaguuacggccaaauggcucuggggguuucugagcagaaacaagaagccccggauuuguacccgcgaggaguucacaagaaaagugcggucuaaugcugccaucggagcugucuuuguggacgagaaccaguggaauagcgccaaggaggccguugaagaugagcgcuucugggaccuugugcauagagaacgggagcugcacaaacagggcaagugcgcgaccugcgucuacaacaugauggggaaacgcgaaaagaagcucggagaguuuggcaaagcuaagggguccagagccauuugguacauguggcugggcgcccgguuccuggaguucgaagcucucggauuuaugaaugaggaucacugguucucucgcgaaaacagccuguccggcguggagggggagggacuucauaaacugggcuauauccucagagacauuucuaagaucccugggggaaauauguacgccgaugacacagcuggcugggauacccggaucacagaagacgaucugcagaacgaggcccgcauuaccgacaucauggaacccgagcacgcgcuucuggccagaagcauuuuuaaacucacguaucaaaauaaggucgugcggguucagcgcccugcuaaaaacgggaccgugauggaugucaucuccagacgggaccagagaggcucuggacaggugggcacauacgggcugaauaccuucacaaacauggaagcccaacugauucgccagauggagagcgagggaaucuuuucccccagcgaacucgagaccccgaaccuggcugaacgggugcuugauuggcuggagaaguauggcguugaaagacucaagcgcauggccaucucuggggacgacuguguggucaaaccuauugaugaccgguucgcgacggcccugacagcucuuaaugauaugggaaaggugagaaaagacaucccccagugggagccuuccaagggcuggaacgauuggcagcaaguucccuuuugcagccaucacuuccaccagcugauuaugaaagacgggcgcgagaucguggucccuugucggaaucaggaugaacucgugggcagagcccgcgucucucagggagcuggcuggucccugcgggagaccgccugccugggaaagagcuacgcucaaauguggcagcucauguauuuucauagacgcgaccugcggcuugccgcgaacgccauuuguuccgcugugcccguugauuggaucccgacaucuagaaccacguggagcauucacgcccaucaccaguggaugaccacagaagacaugcuguccguguggaaucgggucuggaucgaggaaaacccuuggauggaggauaagacccauaucagcucuuggggagacgugcccuaccucggcaaaagagaggaccaauggugcgggucccugauuggacuuacagcccgcgcuaccugggccacaaauauccagguugcgauuaaccaggugcggagacugaucggcaaugaaaacuaccucgauuauaugaccagcaugaagcgcuucaaaaaugagucugaccccgaaggggcucugugguga

SEQ ID NO: 18841 - RNA, 9879 nt, Artificial Sequence
  derived and/or modified CDS sequence (opt5) from DENV-1__EU677172__SS-prME
agcgugaccaugcugcucaugcugaugcccacagcccuugcuuuccaccugacgaccagaggcggggaaccucauaugauugucuccaagcaggaacgggggaaaucucuccuguuuaagaccagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcguuggcaaacucguccaucagauuuucgggacggccuacggagugcuguuuuccggcgugagcuggaccaugaagaucgggauuggcguccuucugacauggcucggacucaauucuagauccaccagccugucuaugacauguaucgcugugggccuuguuacccucuaccugggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcucucugccgcgauuggcaaggccugggaggagggggucugcggcaucagaagcgcuacacgccuggaaaacaucauguggaaacagauuuccaacgagcuuaaucauauccugcucgaaaacgacaugaaguucaccgugguugugggagaugucgccggcauucuggcucaggggaaaaagaugauccggccgcaacccauggaguacaaauauucuuggaaaagcuggggaaaggccaagauuaucggcgccgacgcucagaauaccacauuuaucauugaugggccuaacacccccgaauguccugacgaucagagagcguggaauaucugggagguggaggacuacggauucggcauuuuuacgacaaacaucuggcugaaacuucgcgauuccuauacccaggugugcgaccaccggcucaugagcgccgcuauuaaagauucuaaggccguccacgccgacaugggcuacuggaucgaauccgagaaaaaugaaacauggaagcuggcuagagccagcuucaucgagguuaagaccuguauuuggcccaaaucucauacacugugguccaacggggugcucgaaagcgagaugaucauuccgaagaucuauggaggcccuauuucucaacacaauuaccgccccggguacuucacccagacggcgggaccuuggcaucugggcaaacuugagcuggauuuugaccucugcgaagggaccacaguggucguggaugagcacugcggaaaccggggccccagccugagaaccacaaccguuacgggcaagaucauccacgaaugguguugccgguccuguacacugccuccccuucgcuucagaggggaggacggaugcugguauggcauggagauucggccggugaaagaaaaggaggaaaaucucgucaagagcauggugucugcuggguccggagagguugacagcuuuucccugggccugcucuguaucucuauuaugaucgaagaggugaugagaagccgcuggucccggaaaaugcugaugaccgggacacuugccgucuucuuucugcucaccaugggacagcugaccuggaacgaucugauuagacuuugcaucauggugggcgccaaugcuucugaccgcaugggcauggggacaacguaccuggcccucauggcgaccuucaagaugagaccuauguuugcuguuggacugcuguuccggcgccugacaagcagagaggugcuucugcucaccauuggccugucccuggucgccucuguggaacuucccaacagccuggaggaacucggggauggacuggccaugggcaucaugauccucaaacugcuuacagacuuucaaucccaucagcugugggcuacccuccugagccugacguucauuaagacaaccuuuucucuucacuaugccuggaaaaccauggcuauggugcuguccaucgucagccucuucccccugugucucucuacaaccucccagaagacaacguggcugccuguucuucuggggagccugggaugcaagccgcucaccauguuucugauugccgagaauaaaaucuggggccggcgcucuuggccccuuaacgaaggcauuauggcgguggggaucguguccauccugcucagcucccugcucaagaacgaugucccucuggccggaccccuuauugcuggcgggaugcugaucgccuguuacgugauuagcggaucuagcgcugaccugucccucgagaaagccgccgagguuucuugggaagaggaagcugagcauagcggcgcgucccacaauauccugguggaaguccaggaugacgggacaaugaagauuaaagaugaggagagagacgauacccuuacaauccugcucaaggccacccugcucgcugugucuggaguuuauccucugagcauccccgccacgcuuuucgugugguacuucuggcagaagaagaagcagcgguccggcguccugugggacaccccuucucccccggaaguggagcgcgccguccuggaugacggcauuuauagaaucaugcagcgggggcuccugggacgcagccaggugggcguugggguguuucaagaaaacgucuuccauacaauguggcacgugaccagaggagcuguucuuauguaccagggcaaacggcuggagccuuccugggccagcgugaagaaagaccucauuucuuacgggggaggcuggagacugcagggcuccuggaauacaggggaggaaguccaggugaucgcgguggagcccggaaagaacccuaaaaauguucaaaccgcucccggcacauuuaagacgccggaaggggaggucggagccauugcccucgauuucaagccuggcaccagcgggucucccaucgugaaccgcgaaggaaaaauugugggccuguauggcaauggggucgugacaaccuccggaaccuacguuagcgcuaucgcccaggcgaaggcuucccaggagggcccucuucccgagaucgaagacgagguguuucggaaaagaaaccugacaauuauggaucugcaccccgggucuggaaagacgcgccgguaucucccugccaucgucagagaagccauuaaacgcaagcugcggacccuuauccuggcuccgacaagagugguugccagcgagauggcugaagcccucaagggcaugcccauucgcuaccaaaccacagcggugaaauccgagcauaccgggaaggagaucgucgaccugaugugccacgccacguucacaaugcggcugcucagcccugugagaguucccaauuauaacaugaucauuauggaugaagcucauuuuaccgacccuucuuccaucgccgcucggggcuacauuagcacccgcgugggaaugggcgaggccgccgcuaucuucaugacagcgacacccccugggucugucgaagccuuuccgcagagcaaugcugugauucaggaugaggaaagagacauccccgagcgguccuggaacucuggauaugaguggaucacagauuucccuggcaaaaccgugugguuuguccccagcauuaaguccgggaaugacaucgccaacugucuucgcaaaaauggaaagagaguuauucagcugucucggaagacguucgauacagaauaccagaagaccaagaacaacgacugggacuacguggugacaaccgauaucagcgagaugggcgccaauuucagagcugaccgcgucauugauccucggagaugccugaaacccgugauccucaaggacgggccggaacgcguuauucuggccggcccuaugcccgugacggucgcguccgcugcccagcggagaggacgcaucggccggaaccacaauaaagagggggaucaguauaucuacaugggacagccccuuaacaaugacgaggaucaugcccacuggaccgaagcuaagaugcugcucgacaacauuaauacaccugagggcaucauucccgcccuguuugaaccugagagagaaaagagcgcggccaucgauggggaguaucgccugagaggagaggcucggaaaaccuucguggaacucaugcgcagaggcgaccuuccgguuuggcugucuuacaagguggccuccgagggguuucaauauagcgaucggcgcuggugcuucgacggcgaaagaaacaaucagguccuggaggaaaacauggauguggagauuuggacaaaagagggagaacggaagaaacucagaccccgcuggcuggacgcucggaccuacuccgacccucuugcccugagagaguuuaaggaguucgcugccggccgccggucugucagcggggaucucauccuggagaucggaaaacugccccagcaccucacacagagagcgcaaaaugcccuugacaaccuggugaugcugcauaauuccgaacagggcgggcgggcuuaucgccacgccauggaggagcucccugauaccauugaaacgcugaugcuucuggcucucaucgccguucugacaggaggcgugacccuguuuuuccucucuggcagagggcuuggaaagaccagcauuggccugcugugugugauggccuccagcguccuccuguggauggcuucuguugagccccauuggaucgcggccuccauuauccuugaauuuuuccugauggugcuccugaucccggagccugaccggcagcgcacaccccaggauaaccaacuggcuuacguggucauugggcuccuuuuuaugauccugaccguggccgccaaugagaugggacugcucgaaacaacgaagaaagaccugggcauugggcacguugcuguggagaaccaccaucacgccgcgaugcuugaugucgaccugcauccugccagcgcuuggacccucuacgccguggcuacaaccaucauuacacccaugaugagacacaccaucgaaaacacgaccgccaauauuucucugacagcgaucgccaaccaggcugccauccugaugggacucgauaagggcuggccuauuuccaaaauggacaucggcgucccccuucuggcucuggggugcuauagccaggugaauccgcucacccugacagccgcuguucuuaugcugguggcccauuacgcgauuaucggaccuggccuccaagccaaggcuacccgggaggcccagaaacgcacggcugccgggauuaugaagaaccccacagucgauggaaucguggccaucgaccuggaucccguuguguaugacgcgaaguucgaaaaacagcugggccagauuaugcuccuuauccuguguaccucucaaauucugcucaugagaacaaccugggcucugugcgagagcaucacccuugccacagggccucugacgacccucugggagggauccccgggcaaguuuuggaauacaaccauugcugucucuauggccaacaucuuccggggcagcuaccuggccggggcuggacuggccuucucccucaugaaaagccuuggcgggggacgcagaggcacaggggcgcagggagaaacccugggcgagaaguggaaacggcagcugaaucagcucuccaagucugaauuuaacacguauaagagaagcggcaucauggagguggaccgcuccgaagccaaagaggggcugaagcggggagagacaaccaaacacgcugugucuagaggcaccgccaaacuucgcugguucguugaacggaaucuggucaaacccgaggggaaggugauugaucucggauguggcagagggggauggagcuacuauugcgcuggccugaagaaagugacagaagucaagggcuacaccaaagggggaccuggccacgaggaacccaucccuauggccacauacggguggaaccugguuaagcuccauuccggaaaagacguguuuuucauucccccugagaagugugauacgcuucugugcgacaucggcgagucuagcccgaaucccaccauugaagaggggcgcacacugcgggugcucaaaauggucgaaccuuggcugagaggaaaccaauuuuguaucaagauucuuaaucccuauaugccuuccgugguugagacccuggagcagaugcagcgcaagcacggcggcaugcucgugcggaacccccugagcagaaauucuacacaugaaauguacugggucuccugcgggaccggaaacaucgugagcgcgguuaauaugacgucucgcaugcugcucaaccgguucaccauggcccacagaaaaccgacauaugagcgcgauguggaccugggcgcugggaccagacacgucgccguggaaccugagguggcuaaccuugauaucauuggacagcggaucgaaaauauuaagcaugagcacaaauccacauggcauuacgacgaggauaaccccuauaagaccugggccuaccacggcagcuaugaagucaaacccucuggguccgcuagcuccaugguuaauggaguggugaagcugcucacaaagccuugggacgucauccccauggugacccaaauugccaugacggauacaaccccuuuuggccagcagcgcguuuucaaagagaagguggacaccagaacaccgaaagcgaagcggggcacggcccaaaucauggaagucaccgcuaaauggcuguggggguuucuuagcagaaacaagaagccccggaucuguacacgcgaggaguucaccagaaaagugcggucuaaugccgcuauuggagccguuuuuguggacgagaaccaguggaauagcgccaaggaggcggucgaagaugagcgcuucugggaccuggugcauagagaacgggagcuccacaaacagggcaagugcgcuacaugcguuuacaacaugauggggaaacgcgaaaagaagcugggagaguuuggcaaagccaagggguccagagccaucugguacauguggcugggcgcucgguuccucgaguucgaagcccugggauuuaugaaugaggaucacugguucucucgcgaaaacagccuuuccggcguggagggggagggacugcauaaacucggcuauauucugagagacaucucuaagauuccugggggaaauauguacgcugaugacaccgccggcugggauacacggaucaccgaagacgaucuucagaacgaggcgcgcaucacggacauuauggaacccgagcacgcccugcucgcuaaaagcaucuuuaagcugaccuaucaaaauaaagucgugagaguccagcggccugccaagaacgggacagugauggauguuauuucccgcagagaccagcggggcucuggacaggugggcaccuacgggcugaauacauucaccaacauggaagcucaacucaucagacagauggagagcgagggaaucuuuucccccagcgaacuggagacgccgaaccuugccgaacgcguccuggauuggcucgagaaguauggcguggaacggcugaaaagaauggcgaucucuggggacgacugugugguuaagccuaucgaugaccgcuucgccacagcucuuaccgcccugaaugauaugggaaaagugcggaaggacauuccccagugggagccuuccaaaggcuggaacgauuggcagcaaguccccuuuugcagccaucacuuccaccagcucaucaugaaggacgggagagagauugugguuccuugucgcaaucaggaugaacuggugggccgggcuagagucucucagggagccggcuggucccugcgcgagacagcuugccucggaaagagcuacgcccaaauguggcagcugauguauuuucaucggagagaccuucgccuggcggccaacgcuaucuguuccgccgugcccgucgauuggauuccgaccucucggacgaccuggagcauccacgcccaucaccaguggaugacaaccgaagacaugcucuccguguggaauagaguuuggauugaggaaaacccuuggauggaggauaaaacacauaucagcucuuggggagacgugcccuaccugggcaagcgggaggaccaauggugcgggucccuuaucggacugaccgcuagagccacaugggcgaccaauauucaggucgcuaucaaccaggugcgccggcucauuggcaaugaaaacuaccuggauuauaugacgagcaugaaaagauucaagaaugagucugaccccgaaggggcccugugguga

SEQ ID NO: 18842 - RNA, 9879 nt, Artificial Sequence
  derived and/or modified CDS sequence (opt5) from DENV-1__EU677173__SS-prME
uccgugaccaugcugcucaugcugaugcccaccgcccuugcuuuccaccugacgaccagaggcggggaaccucauaugaucgucacaaagcaggaacggggaaaaucccuccuguuuaagaccucugccggcguuaauaugugcacacuuauugcgauggaccugggggaacucugugaagauaccaugacauacaaaugcccgcgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuaccacaucccaagagaccuggaaucgccaggaccugcucgucaccuucaaaacagcgcacgccaagaagcaggaaguggucgugcugggaucucaagagggcgcuaugcacacggcccugaccggggccacagaaauucagaccagcggaacaaccacgaucuuugcuggccaucucaaaugcagacugaagauggauaaacuuacacugaaggggauguccuauguuauguguaccggcagcuucaaacucgagaaggaaguggccgagacccagcacggaacaguccuggugcagauuaaguacgagggcaccgacgcgccgugcaaaaucccuuucucuacacaagaugaaaaggggguuacgcagaacggacggcugaucaccgcuaaucccauugugacagacaaagagaagccugucaacaucgaagccgagccgcccuuuggcgaguccuauauugugaucggggccggagaaaaagcucuuaagcucagcugguucaagaaaggcucuagcauugggaagauguuugaggccaccgcuagaggcgcccgccggauggcgauccugggagauacagccugggacuucggcuccaucgggggaguguuuaccucuguuggcaaacugguccaucagauuuucgggacggcuuacggagugcucuuuagcggcguguccuggaccaugaagaucgggauuggcguccugcuuacauggcugggacucaauagcagaucuaccucccugagcaugacauguaucgccgugggccugguuacccuuuaccucggggugaugguccaggcugauucuggaugcgugauuaacuggaaaggccgcgaacugaaguguggguccggaaucuucguuacaaaugaggugcacaccuggacggaacaauauaaguuucaggccgacagcccuaaacggcuguccgcggccauuggcaaggcuugggaggagggggucugcggcaucagaucugccacacgccucgaaaacaucauguggaaacagauuagcaacgagcugaaucauauccuucuggaaaacgacaugaaguucaccgugguugugggagaugucgugggcauucucgcucaggggaaaaagaugauccggccgcaacccauggagcacaaauacuccuggaagucuuggggaaaggccaaaauuaucggcgccgacgugcagaauaccacauuuaucauugaugggccuaacacccccgaauguccugacgaucagagagcuuggaauaucugggaggucgaggacuauggauucggcauuuuuacgacaaacaucuggcugaagcugcgcgauagcuacacccagaugugcgaccaccggcuuauguccgcggccauuaaagauagcaaggcuguucaugccgacaugggcuauuggaucgaaucugagaaaaaugaaacauggaagcucgccagagcuuccuucaucgaggugaagaccuguauuuggcccaaaagccacacacuguggucuaacggggugcuggaauccgagaugaucauuccgaagaucuacggaggcccuauuagccaacauaauuaucgccccggguacuucacccagacggccggaccuuggcaccucggcaaacuggagcuugauuuugaccugugcgaagggaccacagucgugguugaugagcacugcggaaaccggggccccucucucagaaccacaaccgugacgggcaagaucauccaugaaugguguugccggagcuguacacugccuccccugcgcuucaaaggggaggacggaugcugguacggcauggagauuagaccggucaaggaaaaggaggaaaaucuugugaaauccaugguuagcgcggggucuggagagguggacuccuuuagccucggccugcuguguaucuccauuaugaucgaagaggucaugcggucuagauggagccgcaagaugcucaugaccgggacacuggcuguguuccuucugcucauuaugggacagcugaccuggaacgaucugauccggcuuugcauuaugguuggcgccaaugccuccgacagaaugggcauggggaccacauaucuggcucucauggccacguuuaaaaugcgcccuauguucgcggugggacugcucuuuagacggcugaccucucgcgagguccuucugcucacaaucggccugagccugguggcuuccguggaacuucccaacucucuggaggaacucggggauggacuggccaugggcaucaugauucucaagcugcuuaccgacuuccaaagccaccagcugugggccacacuccugucccugaccuuuaucaaaacgacacuuagccugcauuacgcuuggaagaccauggccaugguccucucuauuguuucccuguucccccucugucugagcaccacaucucagaagaccacauggcuuccugugcugcuggggucccucggaugcaaaccgcugacgauguuucuuaucaccgagaauaagauuuggggcagaaaaagcuggccccugaacgaaggcaucauggcugugggggucgugucuauccuccuguccagccuccugaagaacgauguuccucuugccggaccccugauugcgggcgggaugcugaucgccuguuaugugauuuccggaagcucugcugaccucagccuggagaaagccgcugaggucuccugggaagaggaagccgagcacucuggcgccagccauaauauccuuguggaaguucaggaugacgggacaaugaagauuaaagaugaggagcgggacgauacccugacaauccuccugaaggcuacccuccuggcgguguccggagucuacccucuuucuauccccgccacgcuguucgugugguauuuuuggcaaaagaaaaagcagcgcagcggcguccugugggacaccccuagcccucccgaaguggagagagcuguucucgaugacggcauuuaccggaucaugcagcgcgggcugcuuggaagaucucaggugggcgucgggguguuccaagaaaacguuuuccacacaauguggcacgugacccggggagccguccugauguaucagggcaaacgccucgagcccagcugggccuccgugaagaaagaccugauuagcuacgggggaggcuggagacuccagggcucuuggaaugcuggggaggaagugcagguuaucgccgucgagcccggaaagaacccuaagaaugugcaaacagcgcccggcaccuuuaaaacaccggaaggggaggugggagcuauugcccuggauuucaagccuggcacguccgggagccccaucgucaaccgggaaggaaaaauugugggccuuuacggcaaugggguugugaccacaucuggaaccuaugucuccgccaucgcucaggccaaggcgagccaggagggcccucugcccgagaucgaagacgagguguuuagaaaacgcaaccugaccauuauggaucuccaucccggguccggaaagacacggagauaccugccugcuaucguucgcgaagccauuaagcggaaacuuagaacgcugauccucgccccgacccgcguggucgcuucugagauggccgaagcucugaagggcaugcccauucgguaucaaacaaccgccgugaaaagcgagcacacagggaaggagaucguugaccugaugugccaugcgaccuucacgaugagacuccuuuccccugugcgcguccccaauuacaacaugaucauuauggaugaagcccacuuuacagacccuagcucuaucgcugcccggggcuauauuuccaccagagugggaaugggcgaggcugccgccaucuucaugaccgcuacacccccugggagcguggaagcguuuccgcagucuaaugccgucauucaggaugaggaacgggacauccccgagcgcagcuggaacuccggauacgaguggaucaccgauuucccuggcaaaacaguuugguuugugcccucuauuaagagcgggaaugacaucgcuaacugucugagaaagaauggaaaacgggugauucagcugucccgcaagaccuucgauacggaauaucagaagaccaagaacaacgacugggacuacgucgugaccacagauaucucugagaugggcgccaauuuuagagccgaccggguuauugauccuagacgcugccucaaacccgugauccugaaggacgggccggaacgggucauucuugcuggcccuaugcccgugaccguugccagcgcggcucagagacgcggacggaucggcagaaaccauaauaaggagggggaucaguacaucuauaugggacagccccugaacaaugacgaggaucacgcccacuggacggaagccaaaaugcuccuggacaacauuaauaccccugagggcaucauucccgcucuguucgaaccugagcgcgaaaaguccgccgcgaucgauggggaguaccggcucagaggagaggcccgcaaaacauucguggaacuuaugagacggggcgaccugccggucuggcugagcuauaagguggcuucugagggguuucaauacuccgaucgcagauggugcuucgacggcgaacggaacaaucagguccucgaggaaaacauggauguggagauuuggaccaaagagggagaacgcaagaaacugagaccccgguggcuugacgccagaacauauagcgacccucuggcucuccgcgaguuuaaggaguucgccgcuggccggagauccguuucuggggaucugauccuggagaucggaaagcucccccagcaucuuacccagcgcgcccaaaaugcgcuggacaaccuggugaugcuccacaauagcgaacagggcgggcgggccuacagacaugcuauggaggagcugccugauacaauugaaacccuuaugcugcucgcccugaucgcugugcugacgggaggcgucacacucuuuuuccuuuccggccgggggcugggaaaaaccucuauuggccugcucuguguuauggccagcuccgugcugcuuuggauggccagcguggagccccacuggaucgcugcgucuauuauccuggaauuuuuccucaugguccugcugaucccggagccugaccgccagagaacaccccaggauaaccaacucgccuaugugguuauugggcuucuguuuaugauccugacaguggcugccaaugagaugggacuccuggaaaccacaaagaaagaccuuggcauugggcacgucgccguggagaaccaucaccaugcuacgaugcuggaugucgaccuccacccugccuccgcguggacccuguacgccguggcuacaaccaucauuacacccaugaugcggcauaccaucgaaaacacgaccgccaauauuagccugacagcuaucgccaaccaggcggccauccucaugggacuugauaagggcuggccuauuucuaaaauggacaucggcguuccccugcuggcucucgggugcuacucccaggugaauccgcugacccuuacagccgcuguccugaugcucguggcccacuaugcuauuaucggaccuggccugcaagccaaggcgacccgcgaggcccagaagagaacggcugccgggauuaugaaaaaccccacaguugauggaaucguggcuaucgaccuggaucccgucguguacgacgccaaguucgaaaaacagcucggccagauuaugcuucugauccuguguaccagccaaauucuccugaugcggacaaccugggcccuuugcgagucuaucacccuggcgacagggccucucacgacccugugggagggaagcccgggcaaguuuuggaauacaaccauugcuguguccauggccaacaucuuccgcggcucuuaucuggcuggggccggacucgccuuuagccuuaugaaaucccugggcgggggaagacggggcacaggggcucagggagaaacccugggcgagaaguggaagcgccagcucaaucagcugagcaaauccgaguucaacaucuacaagagaucuggcauuauggagguugaccggagcgaagccaaagaggggcuuaagagaggagagacgacacgccacgcggucucccggggcaccgccaaacugagaugguucguggaacgcaaucucgugaagcccgaggggaaggucaucgaucugggauguggcagagggggauggucuuauuacugcgcuggccugaaaaagguuaccgaagugaaaggcuauacaaaagggggaccuggccaugaggaacccauuccuauggccaccuacggguggaaccucgugaaacuucacagcggaaaggacgucuuuuucacacccccugagaaaugugauacgcugcugugcgacaucggcgaguccucuccgaaucccaccauugaagaggggagaacacuccgcgugcugaagaugguugaaccuuggcuucggggaaaccaauuuuguaucaagauucugaaucccuacaugccuagcguggucgagacccucgagcagaugcagagaaaauauggcggcaugcuggugcgcaacccccugucccggaauagcacacaugaaauguacuggguuucuugcgggaccggaaacaucguguccgcugucaauaugacgagcagaaugcuccugaaccgcuucaccauggcccaccggaagccgacauaugagagagauguggaccuuggcgcggggacccgccacguggccgucgaaccugagguugcuaaccuggauaucauuggacagagaaucgaaaauauuaaacaugagcacaagucuacauggcauuacgacgaggauaaccccuauaaaaccugggccuaccacggcuccuaugaagugaagcccagcgggucugcuuccagcauggugaauggagucgugaagcuccugacaaaaccuugggacguuauccccauggugacccaaauugccaugacggauacaaccccuuuuggccagcagcgggucuucaaggagaaaguggacacccgcacaccgaaggcuaaaagaggcacggcccaaaucauggaaguuaccgcgcgguggcuuuggggguuucuguccagaaacaagaagccccggaucuguacacgcgaggaguucaccagaaaagugcggagcaaugccgcuauuggagccgucuuuguggacgagaaccaguggaacucugcuaaggaggccguugaagaugagcgcuucugggaccucgugcagaaagaaagagagcugcauaagcagggcaaaugcgccacaugcgucuacaacaugauggggaagcgggaaaagaaacugggagaguuuggcaaggcgaaagggagccgcgcuaucugguacauguggcucggcgccagauuccuggaguuugaagcccuuggauucaugaaugaggaucacugguucucccgggaaaacucucugagcggcguggagggggagggacuccacaagcugggcuauauucuucgcgacaucuccaaaauuccugggggaaauauguacgcugaugacaccgccggcugggauacaagaaucaccgaagacgaucugcaaaacgaggcuaagaucacggacauuauggaacccgagcaugcccuccuggcgaccucuaucuuuaaacugacauaucagaauaaggucgugcggguucagcgcccugccaagaacgggaccgugauggaugucauuagcagacgggaccagcgcggcuccggacaagugggcacauacgggcucaauaccuucacgaacauggaagcucagcugaucagacagauggagucugagggaauuuuucuucccagcgaacuggagacaccgaaccucgccgaacgggugcuggauuggcuugagaaauauggcguugaaagacugaagcgcauggcuaucuccggggacgacuguguggucaaaccuaucgaugaccgguucgccaccgcgcucacagcccugaaugauaugggaaaggugagaaaagacauuccccagugggagccuagcaagggcuggaacgauuggcaacagguucccuuuugcucucaccauuuccaccagcugaucaugaaggacgggcgcgagauuguggucccuugucggaaucaggaugaacucgugggcagagcucgcgucucccaaggagccggcuggagccugcgggagaccgcuugccuugggaaaucuuacgcccagauguggcagcugauguauuuucacagacgcgaccuccggcuggcugccaacgcgaucuguuccgccgugcccguugauugggugccgacgagcagaaccacaugguccauucaugcucaccaucaauggaugaccacagaagacaugcuuucugucuggaaucgcguguggaucgaggaaaacccuuggauggaggauaagacccacguuagcuccuggggagacgugcccuaccugggcaaacgggaggaccaguggugcgggagccucauuggacugacagccagagccaccugggcuucuaauauccaggucgccaucaaccaggugcggagacugauuggcaaugaaaacuaccucgauuauaugacguccaugaagcgcuucaaaaaugagggggaccccgaaggcgcgcugugguga

SEQ ID NO: 18843 - RNA, 9879 nt, Artificial Sequence
  derived and/or modified CDS sequence (opt5) from DENV-1__EU726779__SS-prME
agcgugaccaugcugcugaugcugaugcccacagcccuugcuuuccaccugacgaccagaggcggggagccucauaugaucgucuccaagcaggaacggggaaaaucucuccuguuuaagacaagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccagacaggcgagcacagacgggacaagcgcucuguugcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagcuucucuaugacauguaucgcuguuggccuggugacccuguaccuuggggucauggugcaggccgauuccggaugcguuauuaacuggaaaggccgcgaacucaagugugggagcggaaucuuugugacaaaugagguccacaccuggacggaacaauauaaguuccaggcugacuccccuaaacggcugucugccgcgauuggcaaggccugggaggagggggugugcggcaucagaagcgcuacacgccuggaaaacaucauguggaaacagauuuccaacgagcucaaucauauccugcuugaaaacgacaugaaguuuaccguuguggucggagauguggccggcauucuggcucaggggaaaaagaugauccggccgcaacccauggaguacaaauauucuuggaaaagcuggggaaaggccaagauuaucggcgccgacgugcagaauaccacauucaucauugaugggccuaacacccccgaauguccugacgaucagagagcuuggaauaucugggaggucgaggacuacggauuuggcauuuucacgacaaacaucuggcucaagcugcgcgauuccuauacccagguuugcgaccaccggcugaugagcgcggccauuaaagauucuaaggcugugcacgccgacaugggcuacuggaucgaauccgagaaaaaugaaacauggaaacuugccagagcuagcuucaucgaggugaagaccuguauuuggcccaaaucucauacacucugguccaacgggguccuggaaagcgagaugaucauuccgaagaucuauggaggcccuauuucucaacacaauuaccgccccggguacuuuacccagacggccggaccuuggcaucugggcaaacucgagcuggauuucgaccuuugcgaagggaccacagugguuguggaugagcacugcggaaaccggggccccagccugagaaccacaaccgucacgggcaagaucauccacgaaugguguugccgguccuguacacucccuccccugcgcuuuagaggggaggacggaugcugguauggcauggagauucggccggugaaagaaaaggaggaaaaucugguuaagagcauggugucugcgggguccggagaggucgacagcuucucccuuggccuccuguguaucucuauuaugaucgaagaggugaugagaagccgcuggucccggaaaaugcugaugaccgggacacucgcugucuuuuuccugcuuauuaugggacagcugaccuggaacgaucucaucagacugugcauuauggugggcgccaaugccucugaccgcaugggcauggggaccacauaccuggcucuuauggccacguuuaagaugagaccuauguucgcggucggacugcucuuucggcgccugaccagcagagaggugcuccugcuuacaaucggccugucccucguggcuucugucgaacugcccaacagccuggaggaacuuggggauggacuggccaugggcaucaugauucucaaacugcucaccgacuuccaaucccaucagcugugggccacacuucugagccucaccuuuaucaagacgacauucucucugcacuaugcuuggaaaaccauggccaugguucuguccauugugagccuuuuuccccugugucucucuaccacaucccagaagaccacauggcugccugugcuccuggggagccuuggaugcaagccgcugacgauguuccugaucgcugagaauaaaauuuggggccggcgcucuuggccccucaacgaaggcaucauggccgucgggaucguguccauucugcuuagcucccugcucaagaacgauguuccucuggcgggaccccucaucgccggcgggaugcugauugcuuguuacgugaucagcggaucuagcgccgaccuuucccuggagaaagcugccgaggucucuugggaagaggaagccgagcauagcggcgcuucccacaauauucugguggaaguucaggaugacgggaccaugaagaucaaagaugaggagagagacgauacacucaccauccugcuuaaggcgacacugcucgccgugucuggagucuauccucugagcauucccgcuacccucuucgugugguacuuuuggcagaagaagaagcagcgguccggcguccugugggacacgccuucucccccggaagugggccgcgccguucuugaugacgggaucuauagaauuaugcagcggggacugcugggccgcagccaggugggggucggaguguuccaagagaacguuuuucauaccauguggcacgugacaagaggcgccguccucauguaccaggggaaacggcuggaaccuuccugggcuagcgugaagaaagaccuuaucucuuacggaggcggcuggagacugcagggguccuggaauaccggagaggaggugcagguuauugccgucgaacccggcaagaacccuaaaaaugugcaaacagcgcccgggaccuucaagacaccggagggagaagugggcgcuaucgcccucgauuuuaagccugggacgagcggaucucccauugucaaccgcgagggcaaaaucgugggccuguaugggaauggaguugugaccacauccggcaccuacgucagcgccaucgcucaggccaaggcgucccaggaagggccucuccccgagauugaggacgaaguguuccggaaaagaaaccugaccaucauggaucuucaccccggaucuggcaagacacgccgguaucugccugcuauuguuagagaggccaucaaacgcaagcugcggacgcucauucuggccccgaccagaguggucgcuagcgaaauggccgaggcucuuaaggggaugcccauccgcuaccaaacaaccgccgugaaauccgaacauacaggcaaggagaucguugaccugaugugccacgcgaccuuuacgaugcggcuccugagcccugugagaguccccaauuauaacaugauuaucauggaugaggcccauuucacagacccuucuuccauugcugcccggggauacaucagcacccgcgugggcaugggggaagcugccgccauuuuuaugaccgcuacacccccuggaucuguggaggcguucccgcagagcaaugccgucauccaggaugaagagagagacauccccgaacgguccuggaacucuggcuaugaguggauuaccgauuuuccugggaaaacaguuugguucgugcccagcaucaaguccggaaaugacauugcuaacugucugcgcaaaaauggcaagagagugauccagcucucucggaagaccuucgauacggaguaccagaaaaccaagaacaacgacugggacuacgucgugaccacagauauuagcgaaaugggggccaauuuuagagccgaccgcguuaucgauccucggagaugccuuaaacccgugauucugaaggacggcccggagcgcgucauccuggcuggaccuaugcccgugaccguugccuccgcggcucagcggagaggccgcaucgggcggaaccacaauaaagaaggagaucaguauauuuacaugggccagccccucaacaaugacgaggaucaugcccacuggacggaggccaagaugcugcuugacaacaucaauaccccugaagggauuauccccgcucuguucgagccugaaagagaaaagagcgccgcgauugauggagaauaucgccucagaggcgaggcccggaaaacauuuguggagcugaugcgcagaggggaccugccggucuggcucucuuacaagguggcuuccgaaggcuuccaauauagcgaucggcgcuggugcuuugacggagagagaaacaaucagguccuugaagagaacauggauguggaaaucuggaccaaagagggcgagcggaagaaacugagaccccgcuggcuggacgcccggacauacuccgacccucucgcucugagagaguucaaggaguuugccgcugggcgccggucuguuagcggagaucuuauccuggaaauuggcaaacucccccagcaccugacccagagagcccaaaaugcgcuggacaaccucgugaugcuucauaauuccgagcaagggggacgggccuaucgccacgcuauggaggaacugccugauacaaucgagacccugaugcuccuggcccuuauugcugugcugacgggcggcgucacacucuucuuucugucugggagaggacugggcaagaccagcaucgggcuccuuuguguuauggccuccagcgugcugcuguggauggccucuguggaaccccauuggauugcugcguccaucauccucgaguucuuucugaugguccuucugauuccggaaccugaccggcagcgcacaccccaggauaaccaacucgccuacgugguuaucggacugcuguucaugauucucacaguggcugccaaugagaugggccuucuggagaccacaaagaaagaccuggggaucggacacgucgccguggaaaaccaccaucacgcugccaugcucgaugucgaccugcauccugcgagcgccuggacgcuuuacgcuguggccaccacaauuaucacccccaugaugagacacacaauugagaacaccacggcuaauaucucucugaccgccaucgcgaaccaggccgcuauucucaugggccuggauaagggcuggccuaucuccaaaauggacauugggguuccccugcucgcccuuggaugcuauagccaggugaauccgcugacacugaccgcugccguccucaugcugguggcucauuacgccaucauuggcccugggcuucaagcgaaggccacacgggaagcucagaaacgcaccgccgcuggaaucaugaagaaccccacgguugauggcaucguggccauugaccuggaucccgucguguaugacgccaaguuugagaaacagcucgggcagaucaugcugcugauucucuguacaucucaaauccuucugaugagaaccacaugggcgcugugcgaaagcauuacccucgcuaccggaccucugacaacgcuuugggagggcuccccgggcaaguucuggaauaccacaaucgccgugucuauggcuaacaucuuccgggggagcuaccuggccggagccggccucgcuuuuucccugaugaaaagccucgggggaggccgcagagggaccggagcccagggcgagacacucggcgaaaaguggaaacggcagcuuaaucagcuguccaagucugaguucaacaccuauaagagaagcgggauuauggaaguugaccgcuccgaggcgaaagaaggacugaagcggggcgagacgacaaaacacgccgucucuagagggaccgcuaagcuccgcugguuuguggagcggaaucuggugaaacccgaaggaaaggucaucgaucuuggcugugggagaggaggcuggagcuacuauugcgccggccugaagaaaguuaccgaggugaagggguacacaaaaggaggcccugggcacgaggaacccauuccuauggcuaccuacggauggaaccucgugaagcugcauuccggcaaagacgucuucuuuauucccccugaaaagugugauacacugcucugcgacauuggggagucuagcccgaaucccacgaucgaggaaggacgcacccuucgggugcugaaaaugguugagccuuggcugagaggcaaccaauucuguauuaagauccucaaucccuauaugccuuccguggucgaaacacuggagcagaugcagcgcaagcacggcgggaugcuugugcggaacccccugagcagaaauucuacccaugagauguacuggguuuccugcggaacaggcaacaucgugagcgccgucaauaugaccucucgcaugcuccugaaccgguuuacgauggcgcacagaaaaccgaccuaugaacgcgauguggaccugggggccggaacaagacacguggcugucgagccugaaguugccaaccucgauauuaucggccagcggauugagaauaucaagcaugaacacaaauccaccuggcauuacgacgaggauaaccccuauaagacaugggcuuaccacgggagcuaugaggugaaacccucuggauccgccagcuccauggugaauggcgucgugaagcugcuuaccaagccuugggacguuauucccauggugacacaaaucgcuaugaccgauacgacaccuuucggccagcagcgcgucuuuaaagaaaagguggacaccagaaccccgaaagccaagcgggggacagcgcaaaucauggagguuacggccaaauggcuguggggauuccucagcagaaacaagaagccccggauuuguacccgcgaagaguuuacaagaaaagugcggucuaaugcugccaucggcgcugucuucguggacgaaaaccaguggaauagcgccaaggaggccguugaggaugaacgcuuuugggaccuggugcauagagagcgggaacuucacaaacaggggaagugcgcgaccugcgucuacaacaugaugggaaaacgcgagaagaagcugggcgaguucgggaaagcuaagggcuccagagccauuugguacauguggcucggagcccgguuccuggaguuugaggcucugggcuucaugaaugaagaucacugguuuucucgcgagaacagccucuccgggguggaaggagagggccugcauaaacuuggguauauccugagagacauuucuaauaucccuggaggcaacauguacgccgaugacacagcugggugggauacccggaucacagaggacgaucuccagaaugaagcccgcauuaccgacaucauggagcccgaacacgcgcugcuugccaagagcauuuucaaacugacguaucaaaacaaggucgugagaguucagcggccugcuaaaaauggcaccgugauggaugucaucucccgcagagaccagcggggaucuggccagguggggacauacggacucaacaccuuuacaaacauggaggcccaacugauuagacagauggaaagcgagggcaucuucucccccagcgagcuggaaaccccgaaucucgcugagcgcgugcuggauuggcuugaaaaguaugggguugagcggcugaagagaauggccaucucuggagacgacuguguggucaaaccuauugaugaccgcuuugcgacggcccucacagcucugaacgauaugggcaaggugcggaaagacaucccccagugggaaccuuccaagggguggaaugauuggcagcaaguucccuucugcagccaucacuuucaccagcuuauuaugaaagacggcagagagaucguggucccuugucgcaaccaggaugagcuggugggacgggccagagucucucagggcgcuggguggucccuccgcgaaaccgccugccugggaaagagcuacgcucaaauguggcagcugauguauuuccaucggagagaccuccgccuggccgcgaaugccauuuguuccgcugugcccguugauuggaucccgacaucucggaccacguggagcauucacgcccaucaccaguggaugaccacagaggacaugcuuuccguguggaacagagucuggaucgaagagaauccuuggauggaagauaagacccauaucagcucuuggggcgacgugcccuaccuggggaaacgggaggaccaauggugcggaucccucauuggccugacagccagagcuaccugggccacaaacauccagguugcgauuaaucaggugcgccggcuuaucgggaacgagaauuaccuggauuauaugaccagcaugaagagauuuaaaaacgaaucugaccccgagggcgcucucugguga

SEQ ID NO: 18844 - RNA, 9879 nt, Artificial Sequence
  derived and/or modified CDS sequence (opt5) from DENV-1__EU677176__SS-prME
agcgugaccaugcugcugaugcugaugcccacggcccuugcuuuccaccugacgacccggggcggggaaccucauaugaucguguccaagcaggaacggggaaagucucuccuguuuaagaccagcgccggcguuaauaugugcacccuuauugcgauggaccugggggagcucugugaagauacaaugaccuacaagugcccgcgcaucacagagguggaacccgacgauguggacuguuggugcaauaccacggauaccugggucacauauggaaccuguucccaaacaggcgagcaccggcgggacaagcgcucuguggcucuggccccucauguugggcugggacucgagaccagagccgaaacguggaugagcuccgagggcgcuuggaagcagauucagaagguggaaacaugggcccugcggcaccccggcuucaccgucaucgcucuuuuucuggcccaugcgauugggacaucuaucacccagaagggaaucauuuucauccuccugaugcuugugaccccuagcauggccaugcgcugcguuggcauuggguccagagauuuuguggagggacugagcggcgcuacaugggucgacguggugcucgagcacgggucuugugucacgaccauggccaaggauaagcccacacuggacaucgaacugcucaaaaccgagguuacaaacccugcugugcugcggaaacuuugcauugaagccaaaaucuccaauaccacgacagauagccgcuguccgacccaaggagaggcgacccugguggaagaacaagacgccaacuucgucugcagacggacauuuguggaucgcggcuggggcaauggguguggacucuucggcaaggggucucugauuaccugcgcuaaguuuaaaugcguuacaaaacuugagggaaaaaucgugcaguacgaaaaccugaaguauuccgucaucgugacgguucacaccggcgaccagcaucaaguggggaaugagagcacagaacacggaaccacagccaccauuacgccccaggcuccuaccucugagauccagcucacagacuacggcgcccugacccuggauuguucccccagaacaggccucgacuucaacgaaaugguccugcuuaccaugaaagaaaagagcuggcuggugcauaaacagugguuucucgaucugccucuucccuggacguccggggccucuacaagccaagagaccuggaaucggcaggaccugcucgucacauucaagaccgcucacgcgaagaaacaggaagugguugugcugggaucccaagagggcgccaugcacaccgcucugacaggggccacggaaauucagaccagcggaacaaccacaaucuuugccggccaucucaagugccgccugaaaauggauaaacuuacccugaaagggaugucuuaugucauguguacgggccucuucaagcuggagaaggaaguggcugagacacagcacggaaccguucuggugcagauuaaauacgagggcaccgacgccccgugcaagaucccuuucuccacacaagaugaaaaaggggucacccagaacggaagacuuaucacagcgaaucccauugugacggacaaggagaaaccugugaacaucgaagcugagccgcccuuuggcgagagcuauauuguuaucggggccggagaaaaggcccucaagcugucuugguucaaaaagggcagcuccauugggaaaauguuugaggcuaccgcccggggcgcuagacgcauggccauccugggagauacagcgugggacuucggcucuaucgggggagucuuuaccagcgugggcaagcucgugcaucagauuuucgggacagccuacggaguccuguuuuccggcgugagcuggaccaugaaaaucgggauuggcguucuucugacguggcucggacucaauucucgguccaccagccugucuaugacauguaucgcugugggccuugucacccucuaccugggggugaugguucaggccgauuccggaugcgugauuaacuggaagggcagagaacugaagugugggagcggaaucuucgucacaaaugaggugcacaccuggacagaacaauauaaauuucaggcugacuccccuaagcgccucucugccgcgauuggcaaagccugggaggaggggguuugcggcauccggagcgcuaccagacuggaaaacaucauguggcgccagauuuccaacgagcuuaaucauauccugcucgaaaacgacaugaaguucacgguggucgugggagauguggucggcauucuggcccaggggaaaaagaugauccggccgcaacccauggagcacaaauacucuuggaaaagcuggggaaaggcuaagauuaucggcgccgacguucagaauacaaccuuuaucauugaugggccuaacacccccgaauguccugacgaucagagagccuggaauaucugggagguggaggacuauggauucggcauuuuuacaaccaacaucuggcugaaacuucgcgauuccuacacacaggugugcgaccaccggcucaugagcgcugcgauuaaagauucuaaggccguccaugcugacaugggcuauuggaucgaauccgagaaaaaugaaacauggaagcuggccagagccagcuucaucgaggugaagaccuguauuuggcccaaaucucacacacugugguccaacgggguucucgaaagcgagaugaucauuccgaagaucuacggaggcccuauuucucaacauaauuaucgccccggguacuucacccagacagcuggaccuuggcaccugggcaaacuugagcuggauuuugaccucugcgaagggaccacgguggucguggaugagcacugcggaaaccggggccccagccugagaaccacaaccguuacaggcaagaucauccaugaaugguguugccgguccuguacccugccuccccuucgcuucaaaggggaggacggaugcugguacggcauggagauuagaccggugaaggaaaaggaggaaaaucucgucaaaagcauggugucugccggguccggagagguugacagcuuuucccugggccugcucuguaucucuauuaugaucgaagaggugaugcggagcagauggucccgcaagaugcugaugacggggacacuugcggucuucuuucugcucauuaugggacagcugaccuggaacgaucugauccggucuugcauuauggugggcgcuaaugccagcgacagaaugggcauggggacaaccuaucuugcccugauggcuaccuucaaaaugcgcccuauguuugccgugggacuccuguucagacggcucacaucccgcgagguccugcuucugacgaucggccucucucugguugcgagcguggaacugcccaacucccuugaggaacugggggauggacucgcuaugggcaucaugauucugaagcuccugaccgacuuucaaagcuaccagcuuugggccacacugcucucucugaccuucaucaaaacaaccuuuucccugcacuaugccuggaagacgauggcuauggugcuuagcauugucucucugcucccccugugucucuccacaaccagccagaagaccacauggcugccugugcuucuggggucucugggaugcaaaccgcucaccauguuccugaucgccgagaauaagauuuggggcagaaaauccuggccccuuaacgaaggcaucauggcuguugggaucgugagcauucugcucuccagccugcucaagaacgaugucccucuggccggaccccuuaucgcgggcgggaugcugauugccuguuacgugaucucuggaagcuccgcugaccugucucucgagaaagccgcugagguuagcugggaagaggaagccgagcauuccggcgccucucacaauauucugguggaaguccaggaugacgggacaaugaagaucaaagaugaggagcgggacgauacgcuuaccauccugcucaaggcuacacugcucgcggugagcggagucuauccucuguccauucccgccacccuuuuugugugguacuucuggcaaaagaaaaagcagcgcucuggcguucugugggacacaccuagcccucccgaaguggagagagcuguccuggaugacggcaucuaucggauuaugcagcgcgggcuccugggaagaucccaggugggcguugggguguuccaagaaaacgucuuucauaccauguggcacgugacgcggggagccgugcuuauguaccagggcaaacgccuggagcccagcugggccucuguuaagaaagaccucaucuccuacgggggaggcuggagacugcagggcagcuggaauaccggggaggaaguccaggugauugcuguggagcccggaaagaacccuaagaauguccaaacagcccccggcaccuucaaaacaccggaaggggaggugggagcgaucgcucucgauuuuaagccuggcaccucugggucccccauuguuaaccgggaaggaaaaaucgugggccuguauggcaauggggucgugacaacgagcggaaccuacguuuccgccaucgcccaggcuaaggccucucaggagggcccucuucccgagauugaagacgagguguucagaaaacgcaaccugacaaucauggaucugcaccccgggagcggaaagaccaagcgguaucucccugcgauugucagagaagcuaucaaacgcaagcugcggacccuuauucuggccccgacaagagugguugccuccgagauggcugaagcccucaaaggcaugcccauccgcuaccaaacgaccgcugucaagagcgagcauacagggcgggagaucgucgaccugaugugccacgccaccuuuacaaugagacugcucucuccugugcgcgugcccaauuauaacaugauuaucauggaugaagcgcauuucaccgacccuuccagcauugccgcucggggcuacaucucuacgagagucggaaugggcgaggccgcugccauuuuuaugacagccacacccccugggagcguugaggcuuucccgcaguccaaugcggugauccaggaugaggaacgggacauccccgagcgcucuuggaacagcggauaugaguggauuaccgauuuuccuggcaaaacagugugguucguccccuccaucaagucugggaaugacauugccaacugucuuagaaagaauggaaaacgggugauccagcugagccgcaagaccuuugauacagaauaccagaagaccaagaacaacgacugggacuacguugugacgacagauauuuccgagaugggcgcuaauuucagagccgaccgggucaucgauccuagacgcugccugaaacccgugauucucaaggacgggccggaacggguuauccuggccggcccuaugcccgugaccgucgcuagcgccgcgcagagacgcggacggaucggcagaaaccacaauaaggagggggaucaguauauuuacaugggacagccccuuaacaaugacgaggaucaugcucacuggacagaagccaaaaugcugcucgacaacaucaauaccccugagggcauuauccccgcccuguucgaaccugagcgcgaaaagucugcugccauugauggggaguaucggcugagaggagaggcgcgcaaaacguuuguggaacucaugagacggggcgaccuuccggucuggcuguccuacaagguggccagcgagggguuccaauauuccgaucgcagauggugcuuugacggcgaacggaacaaucagguucuggaggaaaacauggauguggagaucuggaccaaagagggagaacgcaagaaacucagaccccgguggcuggacgcuagaacauacucugacccucuugcccugcgcgaguucaaggaauuugcugccggccggagaagcguguccggggaucucauccuggagauuggaaagcugccccagcaccucacccagcgcgcucaaaaugcccuugacaaccuggucaugcugcauaauucugaacagggcgggcgggcguauagacacgccauggaggagcucccugauacaaucgaaacccugaugcuucuggcucucauugccguucugacaggaggcgugacccuguucuuucucagcggccgggggcuuggaaaaacguccaucggccugcugugugugauggcuagcucugcccuccuguggauggccuccgucgagccccauuggauugcugcgagcaucauccuugaguucuuucugauggugcuccugauuccggagccugaccgccagagaacaccccaggauaaccaacuggccuacguugugaucgggcuccuuuucaugauucugaccgucgcugccaaugagaugggacugcucgaaaccacaaagaaagaccugggcaucgggcacguggccgucgagaaccaccaucacgcuaccaugcuugauguggaccugcauccugccucugcguggacacucuacgccguugcuacgaccauuaucacacccaugaugcggcacaccauugaaaacacaaccgccaauaucucccugacggcuaucgccaaccaggcggccauucugaugggacucgauaagggcuggccuaucagcaaaauggacauuggcgugccccuucuggcucuggggugcuauucucaggucaauccgcucacccugacagccgcugugcuuaugcugguugcccauuacgcuaucauuggaccuggccuccaagccaaggcgacccgcgaggcccagaagagaacagcugccgggaucaugaaaaaccccaccguggauggaaucgucgcuauugaccuggaucccgugguguaugacgccaaguuugaaaaacagcugggccagaucaugcuccuuauucuguguacgagccaaauccugcucaugcggacaaccugggcccugugcgaguccauuacacuugcgaccgggccucugaccacacucugggagggaucuccgggcaaguucuggaauacgaccaucgcuguuagcauggccaacaucuuucgcggcuccuaccuggcuggggccggacuggccuucagccucaugaaaucccuuggcgggggaagacggggcacaggggcucagggagaaacccugggcgagaaguggaagcgccagcugaaucagcucucuaaaagcgaguucaacacauauaagagauccggcauuauggaggucgaccggucugaagccaaagaggggcugagacgcggagagaccacgaagcacgcggugagccggggcacagccaaacuuagaugguuuguggaacgcaaucuggucaagcccgaggggaagguuaucgaucucggauguggcagaggcgggugguccuacuauugcgcugggcugaaaaaggugaccgaagugaaaggcuacaccaaagggggaccuggccacgaggaacccauuccuauggccacauacggguggaaccuggucaaacuccauucuggaaaggacguguucuuuauucccccugagaaaugugauacccuucugugcgacaucggcgagagcuccccgaaucccacaaucgaagaggggagaacgcugcgcguucucaagaugguggaaccuuggcugcggggaaaccaauucuguauuaagauccuuaaucccuauaugccuagcgucguggagacccuggagcagaugcagagaaaacacggcggcaugcucguucgcaacccccugucuagaaauuccacacaugaaauguacugggugagcugcgggaccggaaacaucgucucugcugugaauaugacauccagaaugcugcucaaccgcuuuaccauggcccaccggaagccgacguaugagagagauguggaccugggcgcggggacccgccacgucgccguugaaccugagguggcuaaccuugauauuaucggacagagaauugaaaauaucaaacaugagcacaagagcacauggcauuacgacgaggauaaccccuauaaaaccugggccuaccacggcucuuaugaagugaagcccuccgggagcgcuuccagcauggucaauggagugguuaagcugcucacaaaaccuugggacgugauucccauggucacccaaaucgccaugacagauaccacgccuuucggccagcagcggguguuuaaggagaaaguugacacacgcaccccgaaggcuaaaagaggcaccgcccaaaucauggaagugacagcgcgguggcuguggggguuccuuucuagaaacaagaagccccggauuuguacgcgcgaggaauuuaccagaaaaguccggagcaaugccgcuaucggagccguguucguugacgagaaccaguggaacuccgcuaaggaggccguggaagaugagcgcuuuugggaccugguccauagagaacgggagcuccacaaacagggcaagugcgccacaugcguguacaacaugauggggaaacgcgaaaagaagcugggagaguucggcaaagcgaaggggucuagagcuauuugguacauguggcugggcgcccgguuucucgaguucgaagcccugggauucaugaaugaggaucacugguuuagccgcgaaaacucccuuucuggcgucgagggggagggacugcauaaacucggcuauauccugagagacauuagcaagaucccugggggaaauauguacgcugaugacaccgccggcugggauacacggaucaccgaagacgaucuucagaacgaggcuaaaauuacagacaucauggaacccgagcacgcccugcucgcgaccuccauuuucaagcugacguaucaaaauaaagugguucgcgugcagagaccugcccggaacgggaccgucauggaugugaucucucgcagagaccagcggggcagcggacaggugggcacauacgggcugaauaccuuuacaaacauggaagcucaacucauuagacagauggaguccgagcgcaucuucagccccucugaacuggagaccccgaaccuugccgaacggguucuggauuggcucgagaagcauggaguggaaagacugaagcgcauggcuaucuccggcgacgacugugucgugaaaccuauugaugaccgguuugccacggcgcuuagcgcccugaaugauauggggaagguuagaaaagacaucccccagugggagccuucuaagggauggaacgauuggcagcaagugcccuucugcucccaccacuuucaucagcucauuaugaaagacggccgcgagaucgucgugccuugucggaaucaggaugaacuggucgggagagcucgcgugagccagggcgccggauggucccugcgggagacagcuugccucggcaagucuuaugcccaaauguggcagcugauguacuuccacagacgcgaccuucggcuggcugccaacgcgauuuguagcgccguucccguggauugggucccgaccuccagaacaaccuggagcauccaugcucaccaucaguggaugacgaccgaagacaugcucucuguguggaaucggguuuggauugaggaaaacccuuggauggaggauaagacacacaucuccagcuggggagacgugcccuaucugggaaaaagagaggaccaauggugcggcucucuuaucgggcugaccgcccgcgccacaugggcuaccaauauucaggucgccaucaaccaggugcggagacucauuggaaaugaaaacuaccuggauuacaugacaagcaugaagcgcuuuaaaaaugacuccgaucccgagggcgcgcugugguga

SEQ ID NO: 18845 - RNA, 9879 nt, Artificial Sequence
  derived and/or modified CDS sequence (opt5) from DENV-1__EU726780__SS-prME
agcgugaccaugcugcucaugcugaugcccacagcccuugcuuuccaccugacgaccagaggcggggaaccucauaugaucgucuccaagcaggaacggggaaaaucucuccuguuuaagacaagcgccggcguuaauaugugcacccuuaucgcgauggaccugggggaacucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagagaaaacccuuaagcucucuugguucaagaaaggcagcuccauugggaagauguuugaggccacagcuagaggcgcccgccggauggcuauccugggagauaccgccugggacuucggcucuaucgggggaguuuuuacgagcgucggcaaacuggugcaucagauuuucgggaccgcguacggagugcucuuuuccggcgucagcuggacaaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacguggacagaacaauauaaguuucaggccgacuccccuaaacggcugucugcugccauuggcaaggcgugggaggagggggugugcggcaucagaagcgccacccgccucgaaaacaucauguggaaacagauuuccaacgagcugaaucauauccuucuggaaaacgacaugaaguucaccguuguggucggagauguggcuggcauucucgcccaggggaaaaagaugauccggccgcaacccauggaguacaaauauucuuggaaaagcuggggaaaggcuaagauuaucggcgccgacgugcagaauacaaccuuuaucauugaugggccuaacacgcccgaauguccugacgaucagagagccuggaauaucugggaggucgaggacuacggauucggcauuuuuacaaccaacaucuggcugaagcugcgcgauuccuauacacagguuugcgaccaccggcuuaugagcgcugcgauuaaagauucuaaggccgugcacgcugacaugggcuacuggaucgaauccgagaaaaaugaaaccuggaagcucgccagagccagcuucaucgaggugaagacauguauuuggcccaaaucucauacccugugguccaacgggguccuggaaagcgagaugaucauuccgaagaucuauggaggcccuauuucucaacacaauuaccgccccggguacuucacgcagaccgcuggaccuuggcaucucggcaaacuggagcuugauuuugaccugugcgaagggacaaccgugguuguggaugagcacugcggaaaccggggccccagccucagaacaaccacggucacaggcaagaucauccacgaaugguguugccgguccuguacccugccuccccugcgcuucagaggggaggacggaugcugguauggcauggagauucggccggugaaagaaaaggaggaaaaucuuguuaagagcauggugucugccggguccggagaggucgacagcuuuucccucggccugcuguguaucucuauuaugaucgaagaggugaugagaagccgcuggucccggaaaaugcucaugacagggacccuggcgguuuucuuucuucugauuaugggacagcucaccuggaacgaucugaucagacugugcauuauggugggcgcuaaugccucugaccgcaugggcauggggacaacguaccuugcccugauggcuaccuucaagaugagaccuauguuugccgucggacuccuguuccggcgccucacaagcagagaggugcugcuucugaccaucggccucucccugguggcgucugucgaacugcccaacagccuugaggaacugggggauggacucgcuaugggcaucaugauucugaaacuccugacagacuuucaaucccaucagcuuuggguuacccugcucagccugacguucaucaagacaaccuuuucucugcacuaugccuggaaaaccauggccauggugcuuuccauugugagccuguucccccucugucugucuacaaccucccagaagacaacguggcucccuguccugcuugggagccugggaugcaagccgcugaccauguuucucaucgcugagaauaaaauuuggggccggcgcucuuggccccugaacgaaggcaucauggccguggggaucguuuccauucuucugagcucccuccugaagaacgaugugccucucgcuggaccccugaucgccggcgggaugcuuauugcguguuacgucaucagcggaucuagcgccgaccugucccuggagaaagcugccgaggugucuugggaagaggaagcugagcauagcggcgccucccacaauauucucguugaagugcaggaugacgggacaaugaagaucaaagaugaggagagagacgauacccugacaauccuucugaaggccacccuccuggcugucucuggaguguauccucucagcauucccgcgacgcuguucgucugguacuucuggcagaaaaagaagcagcgguccggcgugcuuugggacaccccuucucccccggaaguugagcgcgccgugcuggaugacggcaucuauagaauuaugcagcgggggcugcucggacgcagccaggucggcguggggguuuuucaagaaaacguguuccauacaauguggcacgucaccagaggagcugugcugauguaccagggcaaacggcuugagccuuccugggccagcgugaagaaagaccugaucucuuacgggggaggcuggagacuccagggcuccuggaauacaggggaggaaguucaggucauugccguggagcccggaaagaacccuaaaaaugugcaaaccgcucccggcacauuuaagacgccggaaggggaggucggagccaucgcgcuggauuucaagccuggcaccagcgggucucccauugugaaccgcgaaggaaaaaucguuggccucuauggcaaugggguggucacaaccuccggaaccuacgugagcgcuaucgcccaggccaaggcuucccaggagggcccucugcccgagauugaagacgagguuuuucggaaaagaaaccuuacaaucauggaucugcaccccgggucuggaaagacgcgccgguaucugccugccauugugagagaagcgaucaaacgcaagcuccggacccugauucuugcuccgacaagagucguggccagcgagauggccgaagcucugaagggcaugcccauccgcuaccaaaccacagccguuaaauccgagcauaccgggaaggagaucguggaccucaugugccacgcuacguucacaaugcggcugcugagcccugucagagugcccaauuauaacaugauuaucauggaugaagcccauuuuaccgacccuucuuccauugcggcccggggcuacaucagcacccgcgugggaaugggcgaggcugccgcuauuuucaugacagccacacccccugggucugucgaagccuuuccgcagagcaaugcuguuauccaggaugaggaaagagacauccccgagcgguccuggaacucuggauaugaguggauuaccgauuucccuggcaaaaccgugugguuugugcccagcaucaaguccgggaaugacauugcgaacugucuccgcaaaaauggaaagagagucauccagcuuucucggaagacguucgauacagaauaccagaaaaccaagaacaacgacugggacuacgugguuacaaccgauauuagcgagaugggcgccaauuucagagcugaccgcgugaucgauccucggagaugccugaaacccgucauucugaaggacgggccggaacgcgugauccucgccggcccuaugcccguuacgguggccuccgcugcccagcggagaggacgcaucggccggaaccacaauaaagagggggaucaguauauuuacaugggacagccccugaacaaugacgaggaucaugcgcacuggaccgaagcuaagaugcuucuggacaacaucaauacaccugagggcauuauccccgcccucuuugaaccugagagagaaaagagcgccgcuauugauggggaguaucgccugagaggagaggcccggaaaaccuucgucgaacugaugcgcagaggcgaccucccgguguggcuuucuuacaaggucgcguccgagggguuucaauauagcgaucggcgcuggugcuucgacggcgaaagaaacaaucaggugcuggaggaaaacauggauguugagaucuggacaaaagagggagaacggaagaaacugagaccccgcuggcucgacgcccggaccuacuccgacccucuggcucuuagagaguuuaaggaguucgccgcuggccgccggucugugagcggggaucugaucuccgagauuggaaaacucccccagcaccugacacagagagcccaaaaugcucuggacaaccucgugaugcuucauaauucugaacagggcgggcgggccuaucgccacgcgauggaggagcugccugauaccaucgaaacgcugaugcuccuggcccuuauugcuguccugacaggaggcguuacccucuuuuuccugagcggcagagggcugggaaagaccuccaucggccuccuuugugugauggccagcucugugcugcuguggauggcuuccgucgagccccauuggauugccgccagcaucauccucgaauuuuuccugauggugcuucugauuccggagccugaccggcagcgcacaccccaggauaaccaacucgcuuacguugugaucgggcugcuguuuaugauucucaccgucgcggccaaugagaugggacuucuggaaacaacgaagaaagaccugggcaucgggcacguggcugucgagaaccaccaucacgccgccaugcucgauguggaccugcauccugcuucugccuggacccuuuacgcgguugccacaaccauuaucacacccaugaugagacacaccauugaaaacacgaccgcuaauaucucccugacagccaucgcuaaccaggccgcgauucucaugggacuggauaagggcuggccuaucagcaaaauggacauuggcgugccccugcucgcccuugggugcuauucucaggucaauccgcugacccugacagcugccgugcucaugcugguugcucauuacgccaucauuggaccuggccuucaagcuaaggccacccgggaggcgcagaaacgcacggccgcugggaucaugaagaaccccacaguggauggaaucgucgccauugaccuggaucccgugguguaugacgcuaaguucgaaaaacagcucggccagaucaugcugcugauucucuguaccagccaaauccuucugaugagaacaaccugggcccugugcgaguccauuacccucgccacagggccucugacgacccuuugggagggaucuccgggcaaguuuuggaauacaaccaucgcgguuagcauggcuaacaucuuccggggcuccuaccuggccggggcuggacucgccuucagccugaugaaaucccugggcgggggacgcagaggcacaggggcccagggagaaacccucggcgagaaguggaaacggcagcuuaaucagcugucuaagagcgaauuuaacacguauaagagauccggcauuauggaggucgaccgcucugaagcuaaagaggggcugaagcggggagagacaaccaaacacgccgugagcagaggcaccgcgaagcuccgcugguucguggaacggaaucuggucaaacccgaggggaagguuaucgaucuuggauguggcagagggggaugguccuacuauugcgccggccugaagaaagugacagaagugaagggcuacaccaaagggggaccuggccacgaggaacccauuccuauggcuacauacggguggaaccucgucaagcugcauucuggaaaagacguguuuuucauucccccugagaagugugauacgcugcucugcgacauuggcgagagcuccccgaaucccaccaucgaagaggggcgcacacuucggguucugaaaaugguggaaccuuggcugagaggaaaccaauuuuguauuaagauccucaaucccuauaugccuagcgucguggagacccuggagcagaugcagcgcaagcacggcggcaugcuuguucggaacccccugucuagaaauuccacacaugaaauguacugggugagcugcgggaccggaaacaucgucucugccgugaauaugacgucccgcaugcuccugaaccgguucaccauggcucacagaaaaccgacauaugagcgcgauguggaccugggcgccgggaccagacacgucgcgguugaaccugagguggccaaccucgauauuaucggacagcggauugaaaauaucaagcaugagcacaaaagcacauggcauuacgacgaggauaaccccuauaagaccugggcuuaccacggcucuuaugaagugaaacccuccgggagcgccuccagcauggucaauggagugguuaagcugcuuacaaagccuugggacgugauucccauggucacccaaaucgcuaugacggauacaaccccuuuuggccagcagcgcguguucaaagagaagguugacaccagaacaccgaaagccaagcggggcacggcucaaaucauggaagugaccgccaaauggcuguggggguuucucucuagaaacaagaagccccggauuuguacacgcgaggaguucaccagaaaaguccggagcaaugcggccaucggagcuguguuuguugacgagaaccaguggaacuccgccaaggaggcuguggaagaugagcgcuucugggaccugguccauagagaacgggagcuucacaaacagggcaagugcgccacaugcguguacaacaugauggggaaacgcgaaaagaagcugggagaguuuggcaaagccaaggggucuagagcgauuugguacauguggcucggcgcucgguuccuggaguucgaagcccugggauuuaugaaugaggaucacugguucagccgcgaaaacucccucucuggcgucgagggggagggacugcauaaacuuggcuauauccugagagacauuagcaagaucccugggggaaauauguacgccgaugacaccgcuggcugggauacacggaucaccgaagacgaucuccagaacgaggcccgcauuacggacaucauggaacccgagcacgcucugcuugccaaauccauuuuuaagcugaccuaucaaaauaaagugguuagagugcagcggccugcgaagaacgggacagucauggaugugaucucucgcagagaccagcggggcagcggacaggugggcaccuacgggcucaauacauucaccaacauggaagcccaacugauuagacagauggaguccgagggaaucuuuagccccucugaacuggagacgccgaaccucgcugaacgcguucuggauuggcuugagaaguauggcaucgaacggcugaaaagaauggccauuuccggggacgacuguguggucaagccuaucgaugaccgcuucgcuacagcccucaccgcgcugaaugauaugggaaaagugcggaaggacauuccccagugggagccuagcaaaggcuggaacgauuggcagcaaguucccuuuugcucucaucacuuccaccagcuuaucaugaaggacgggagagagauuguggucccuugucgcaaucaggaugaacuggugggccgggccagagucucccagggagcuggcuggagccuccgcgagacagccugccuggggaaguccuacgcucaaauguggcagcugauguauuuucaucggagagaccuccgccuggccgcuaacgccaucuguucugcggugcccguugauuggauuccgaccagccggacgaccugguccauccacgcccaucaccaguggaugacaaccgaagacaugcuuagcguguggaauagagucuggaucgaggaaaacccuuggauggaggauaaaacacauauuucuuccuggggagacgugcccuaccugggcaagcgggaggaccaauggugcgggagccucaucggacugaccgcuagagccacaugggccaccaauauucagguugcuaucaaccaggugcgccggcuuauuggcaaugaaaacuaccuggauuauaugacgucuaugaaaagauucaagaaugagagcgaccccgaaggggcccucugguga

SEQ ID NO: 18846 - RNA, 9879 nt, Artificial Sequence
  derived and/or modified CDS sequence (opt5) from DENV-1__EU726781__SS-prME
agcgugaccaugcugcugaugcugaugcccaccgcccuugcuuuccaccugacgaccagaggcggggaaccucauaugaucgucuccaagcaggaacggggaaagucucuccuguuuaagacaagcgccggcguuaacaugugcacccuuauugcgauggaccugggggaguucugugaagauacaaugaccuacaagugcccgcgcaucacagaggcugaacccgacgauguggacuguuggugcaaugccaccgauacgugggugaccuauggaacauguucccagaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauuguugugggccuggucacacuguaccuuggggugaugguucaggccgauagcggaugcgugaucaacuggaagggccgcgaacucaaguguggguccggaauuuuugucaccaaugaggugcacacauggaccgaacaguauaaauuccaagcugacucuccuaagcggcugagcgccgcgaucggcaaagccugggaggaggggguuugcggcauuagauccgcuacgcgccuggaaaacaucauguggaagcagaucucuaacgagcucaaucauauucugcuugaaaacgacaugaaauuuacaguggucgugggagauguggccggcauccuggcucaggggaagaaaaugauucggccgcagcccauggaguacaaguauagcuggaaguccuggggaaaagccaagaucauuggcgccgacguccaaaauaccaccuucaucaucgaugggccuaacacacccgaauguccugacgaucagagagcuuggaauauuugggagguugaggacuacggauuuggcaucuucaccacgaacauuuggcucaaacugcgcgauagcuauacacaggugugcgaccaccggcugaugucugcggccaucaaggauuccaaagcugugcacgccgacaugggcuacuggauugaaagcgagaagaaugaaaccuggaaacuugccagagcuucuuucaucgaggucaaaacauguaucuggcccaagucccauacccucuggagcaacggggugcuggaaucugagaugauuaucccgaaaaauuauggaggcccuauuagccagcacaacuaccgccccggguacuuuacacaaaccgccggaccuuggcaucugggcaagcucgagcuggauuucgaccuuugcgaagggacgaccguuguggucgaugagcacugcggaaaucggggccccucccugagaacaaccacagugaccggcaaaaucauucacgaaugguguugccggagcuguacgcucccuccccugcgcuuuaagggggaggacggaugcugguauggcauggagaucagaccgguuaaggaaaaagaggaaaaccuggugaagucuauggucuccgcggggagcggagagguggacuccuucucucuuggccuccuguguaucagcauuaugaucgaagagguuaugcgguccagauggucucgcaaaaugcugaugacagggacccucgcugugcuguuucuucugauuaugggacagcucacauggaaugaucugauccggcugugcauuauggucggcgccaacgccagcgacagaaugggcauggggaccaccuaccuugcucugauggccacauucaagaugcgcccuauguuugcggugggacuccuguucagacggcucacgucccgcgaggugcugcuucugaccaucggccucucucuggucgcuagcguugaacugcccaauucccuugaggaacugggggauggacucgccaugggcauuaugauccugaaacuccugacagacuuucagagccaucaacuuugggccacccugcucucucugacauucaucaagaccacguuuucccugcacuaugcuuggaagacaauggccauggugcuuagcauugugucucuguucccccucugucuguccaccaccagccagaaaacaaccuggcucccuguccugcuugggucucugggaugcaagccgcugacaauguuucucaucgcugagaacaaaauuuggggcagaaaguccuggccccugaacgaaggcaucauggccguggggauuguuagcauccuucuguccagccuccugaaaaaugaugugccucucgcgggaccccugaucgccggcgggaugcuuauugcuuguuacgucaucucuggaagcuccgccgaccugucucuggagaaggcugccgaggugagcugggaagaggaagccgagcauuccggcgcuucucacaacauucucguugaagugcaggaugacgggacgaugaaaaucaaggaugaggagcgggacgauacccugacaauucuucugaaggcgacccuccuggccgucagcggaguguauccucucuccauccccgcuacacuguucgucugguacuucuggcagaaaaagaaacaacgcucuggcgugcuuugggacaccccuuccccucccgaaguugagagagccgugcuggaugacggcaucuaucggauuaugcagcgcgggcugcucggaagaucccaggucggcguggggguuuuucaggaaaauguguuccauacgauguggcacgucacccggggagccgugcugauguaccaaggcaagcgccuugagcccagcugggcuucugugaaaaaggaccugaucuccuacgggggaggcuggagacuccagggcagcuggaacacaggggaggaaguucaggucauugccguggagcccggaaagaauccuaaaaacgugcagaccgcgcccggcacauuuaagaccucugaaggggaggucggagcuaucgcccuggauuucaaaccgggcacauccgggagcccuauugugaaucgggaaggaaagaucguuggccucuauggcaacgggguggucacgaccuccggaacauacgugucugccauugcucaagccaaagcgagccaggagggcccccugccugagaucgaagacgagguuuuuagaaagcgcaaucuuaccaucauggaucugcaccccggguccggaaagacccggagauaucugcccgcuauugugcgcgaagccaucaaacggaagcucagaacacugauucuugccccuacgcgcgucguggcuagcgagauggccgaagcucugaaaggcaugccgauccgguaccagaccacagccguuaagucugagcauaccgggaaagagauuguggaccucaugugccacgcgacauucaccaugagacugcugucccccguccgcgugccuaacuauaauaugaucaucauggaugaagcccauuuuacggaccccagcucuauugcugcccggggcuacaucagcacaagagugggaaugggcgaggcugccgccauuuucaugaccgcuaccccucccggguccgucgaagcguuuccucaaucuaacgccguuauccaggaugaggaacgggacauuccggagcgcagcuggaacuccggauaugaguggaucacagauuuccccggcaagaccgugugguuugugccuucuaucaagagcgggaacgacauugcuaauugucuccgcaagaauggaaagcgggucauccagcuuucccgcaaaacauucgauaccgaauaccagaagacgaaaaacaaugacugggacuacgugguuacaaccgauauuagcgagaugggcgccaacuucagagccgaccgggugaucgaucccagacgcugccugaagccugucauucugaaggacgggcccgaacgggugauccucgcuggcccgaugccuguuacaguggccucugcggcucaaagacgcggacggauuggcagaaaucacaacaaagagggggaucaguauaucuacaugggacagccccugaauaacgacgaggaucaugcccacuggaccgaagccaagaugcuucuggacaauaucaacacgcccgagggcauuaucccugcucucuuugaacccgagcgcgaaaaauccgccgcgauugauggggaguaucggcugagaggagaggcccgcaagaccuucgucgaacugaugagacggggcgaccucccuguguggcuuagcuacaaagucgcuuccgagggguuucaguauucugaucgcagauggugcuucgacggcgaacggaauaaccaagugcuggaggaaaauauggauguugagaucuggacaaaggagggagaacgcaaaaagcugagaccgcgguggcucgacgccagaaccuacagcgacccccuggcucuuagagaguuuaaggaguucgccgcuggccggagauccgugucuggggaucugauucucgagaucggaaaacugccucagcaccugacacagcgcgcccagaacgcgcucgacaaucuugugaugcugcauaacagcgaacaaggcgggcgggccuauagacacgcuauggaggagcugcccgauaccaucgaaacacucaugcugcuugcccugauugcuguccucaccggaggcguuacgcuguuuuuccuguccggccgggggcucggaaagacaagcaucggccuucugugugugauggccucuuccgugcugcucuggauggccagcgucgagccucauuggauugcugcgucuaucauucuggaauuuuuccuuauggugcugcucauccccgagccggaccgccagagaaccccucaggauaaucagcuggccuacguugugaucgggcugcucuuuaugauucuuaccgucgcugccaacgagaugggacugcuggaaacaaccaaaaaggaccucggcaucgggcacguggccgucgagaaccaccaucacgcugccaugcuggauguggaccuucaucccgcguccgccuggacacuguacgcuguugccacgaccauuaucacaccuaugaugcggcacaccauugaaaauacaaccgcuaacaucagccucacggccauugcgaaucaagccgcuauccugaugggacuggauaaaggcuggcccaucucuaagauggacauuggcgugccucuccuugcccuggggugcuauagccaggucaacccccugacccucacagcugccgugcugaugcuuguugcucauuacgccaucauuggaccgggccugcaggcgaaggccacccgcgaggcucagaagagaacagccgcugggaucaugaagaauccuaccguggauggaauugucgccaucgaccucgaucccgugguguaugacgccaaauucgaaaagcagcugggccagaucaugcugcucauucuuuguacgucccagauccugcugaugcggacaaccugggcgcucugcgagucuauuacacuggcuaccgggccccuuaccacacugugggagggaagcccuggcaaauuuuggaacacgaccaucgccguuuccauggcuaauauuuuccgcggcagcuaccucgccggggccggacuggcuuucucccugaugaagucucucggcgggggaagacggggcacaggggcccaaggagaaacccuuggcgagaaguggaaacgccagcugaaccagcugagcaaguccgaauuuaauacauauaaaagaucuggcaucauggaggucgaccggagcgaagcgaaggaggggcucaaaagaggagagaccacgaagcacgccgugucccgcggcacagcuaagcugcggugguucguggaaagaaaccuugucaaaccggaggggaagguuaucgaucugggauguggccgcgggggauggucuuacuauugcgccggccucaaaaaggugaccgaagugaaaggcuacaccaaagggggacccggccacgaggaaccuauucccauggcuacauacggguggaaucuggucaaacugcauagcggaaaggacguguuuuucaucccucccgagaagugugauacccuccuuugcgacauuggcgaguccagcccuaacccgacaaucgaagaggggcggacgcugagaguucugaaaaugguggaacccuggcuccgcggaaaucaguuuuguauuaagauccugaacccuuauaugcccucugucguggagacccuugagcaaaugcagcggaaacacggcggcaugcugguuagaaauccucucucccgcaacagcacacaugaaauguacugggugucuugcgggaccggaaauauugucuccgccgugaacaugacaagccggaugcugcugaacagauucaccauggcgcaccgcaagcccacguaugagcgggauguggaccucggcgccgggaccagacacgucgcuguugaaccggagguggccaaucuggauaucaucggacagcgcauugaaaacaucaaacaugagcacaagucuacauggcauuacgacgaggauaauccuuauaagaccugggcuuaccacggcuccuaugaagugaaacccagcggguccgccagcucuauggucaacggagugguuaaacuucugacaaaacccugggacgugauuccuauggucacccagaucgcuaugacagauaccacgcccuuuggccaacagagaguguucaaggagaaaguugacacacggaccccuaaggccaagcgcggcaccgcgcagauuauggaagugacagccaaauggcucuggggguuucugagcagaaauaagaaaccgcggaucuguacgagagaggaguucacccggaagguccgcuccaacgcugccaucggagcuguguuuguugacgagaaucaauggaacucugccaaagaggccguggaagaugagagauucugggaccuuguccaucgggaacgcgagcugcacaagcagggcaagugcgcgacaugcguguacaauaugauggggaaaagagaaaagaaacucggagaguuuggcaaggcuaaagggagccgggccauuugguacauguggcugggcgcccgcuuccuggaguucgaagcucucggauuuaugaacgaggaucacugguucuccagagaaaauucucugagcggcgucgagggggagggacuucauaagcugggcuauauccuccgggacauuuccaaaauccccgggggaaacauguacgccgaugacaccgcuggcugggauacacgcauuaccgaagacgaucugcagaaugaggccaagaucacagacaucauggaaccugagcacgcgcuucuggccaagucuauuuuuaaacucaccuaucagaacaaggugguuagagugcaacggcccgcuaaaaaugggacggucauggaugugaucagccgcagagaccagcggggcuccggacaggugggcaccuacgggcugaacacauucaccaacauggaagcccagcugauucgccaaauggagagcgagggaaucuuuucuccuuccgaacucgagacacccaaucuggcuggcagaguucuugauuggcuggaaaagcaugggguggagcggcucaaaagaauggccauuagcggagacgacugugucgugaagccgaucgaugaccgcuucgcgaccgcccugacggcucuuaacgauaugggcaagguucggaaagacaucccucagugggaacccucuaagggguggaaugauuggcaacaggugccuuuuugcucccaccacuuccaucaacugauuaugaaagacggcagagagaucgucgugcccugucgcaaccaggaugagcucgucggacgggccagagugagccagggcgcuggguggucccugcgcgaaacagccugccugggaaagucuuaugcucagauguggcaacucauguacuuucaccggagagaccugcgccuugccgcgaaugccauuuguagcgcuguuccuguggauuggguccccaccucccggacaaccuggagcauccaugcccaccaucaguggaugacgaccgaggacaugcugucuguguggaacagaguuuggauugaagagaauccguggauggaagauaaaacacacaucuccagcuggggcgacgugccuuaucucgggaagcgcgaggaccaguggugcggaucucugauuggccuuaccgcccgggcuacaugggccaccaacauccaagucgcgaucaaucaggugagacggcugauugggaacgagaauuaccucgauuacaugacaagcaugaagagauucaaaaacgaauccgaccccgagggcgcucugugguga

SEQ ID NO: 18847 - RNA, 9879 nt, Artificial Sequence
  derived and/or modified CDS sequence (opt5) from DENV-1__EU726782__SS-prME
uccgugaccaugcugcucaugcugaugcccacagcccuugcuuuccaccugacgaccagaggcggggaaccucauaugaucguguccaagcaggaacggggaaaaucucuccuguuuaagacaagcgccggcguuaauaugugcacccuuauugcgauggaccugggggagcucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuuccugacacaagaugaaaagggggugacgcagaacggacggcuuaucaccgcgaaucccauugucacagacaaagagaagccugugaacaucgaagcugagccgcccuuuggcgaguccuauauuaucauuggggccggagaaaaagcccucaagcugagcugguucaagaaaggcucuagcaucgggaagauguuugaggcuaccgccagaggcgcucgccggauggccauccugggagauacagcgugggacuucggcuccauugggggaguguuuaccucuguuggcaaacucguccaucagaucuucgggacggccuacggagugcuguuuagcggcguguccuggaccaugaagauugggaucggcguccuucugacauggcucggacugaauagcagaucuaccucccugagcaugacauguauugcugugggccuuguuacccucuaccugggggugaugguccaggccgauucuggaugcgugaucaacuggaaaggccgcgaacugaaguguggguccggaauuuucguuacaaaugaggugcacaccuggacggaacaauauaaguuucaggcugacagcccuaaacggcucuccgccgcgaucggcaaggccugggaggagggggucugcggcaucagaucugcuacacgccuggaaaacauuauguggaaacagaucagcaacgagcuuaaucauauucugcucgaaaacgacaugaaguucaccgugguugugggagaugucgccggcauccuggcucaggggaaaaagaugauucggccgcaacccauggaguacaaauauuccuggaagucuuggggaaaggccaaaaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaaacuucgcgauagcuauacccaggucugcgaccaccggcucauguccgcggccaucaaagauagcaaggcuguucacgccgacaugggcuacuggaucgaaucugagaaaaaugaaacauggaagcuggccagagcuuccuucauugaggugaagaccuguaucuggcccaaaagccauacacuguggucuaacggggugcucgaauccgagaugauuaucccgaagauuuauggaggcccuaucagccaacacaauuaccgccccggguacuucacccagacggccggaccuuggcaucugggcaaacuugagcuggauuuugaccucugcgaagggaccacagucgugguugaugagcacugcggaaaccggggccccucucugagaaccacaaccgugacgggcaagaucauucacgaaugguguugccggagcuguacacugccuccccuucgcuucagaggggaggacggaugcugguauggcauggagauccggccggucaaagaaaaggaggaaaaucucgugaaguccaugguuagcgcggggucuggagagguggacuccuuuagccugggccugcucuguauuuccaucauuaucgaagaggucaugagaucucgcuggagccggaaaaugcugaugaccgggacacuugcuguguucuuucugcucauuaugggacagcugaccuggaacgaucugaucagacuuugcaucaugguuggcgccaaugccuccgaccgcaugggcauggggaccacauaccuggcucucauggccacguucaagaugagaccuauguuugcggugggacuccuguuccggcgccugaccucuagagagguccuucugcucacaauuggccugagccugguggcuuccguggaacuucccaacucucuggaggaacucggggauggacuggccaugggcaucaugauucucaaacugcuuaccgacuuucaaagccaucagcugugggccacacuccugucccugaccuucaucaagacgacauuuagccuucacuaugcuuggaaaaccauggccaugguccugucuauuguuucccucuucccccugugucucagcaccacaucucagaagaccacauggcugccugugcuucuggggucccugggaugcaagccgcucacgauguuucugaucgcugagaauaaaaucuggggccggcgcagcuggccccuuaacgaaggcauuauggccguggggaucgucucuauucugcucuccagccugcucaagaacgaugugccucuggcgggaccccuuaucgccggcgggaugcugauugcuuguuacguuaucuccggaagcucugccgaccugagccucgagaaagcugccgagguguccugggaagaggaagccgagcauucuggcgcuagccacaauauccuggucgaagugcaggaugacgggaccaugaagauuaaagaugaggagagagacgauacacuuaccauccugcucaaggcgacacugcucgccguuuccggaguguauccucugucuauucccgcuacccuuuucgucugguacuucuggcagaagaagaagcagcggagcggcgugcugugggacacgccuagcccucccgaagucgagcgcgccgugcuggaugacggcaucuauagaauuaugcagcgggggcuccugggacgcucucagguuggcgugggggucuuucaagaaaacguguuccauaccauguggcacguuacaagaggagccgugcuuauguaccagggcaaacggcuggagcccagcugggcuuccgucaagaaagaccucaucagcuacgggggaggcuggagacugcagggcucuuggaauaccggggaggaaguccaggugauugccguugagcccggaaagaacccuaaaaauguccaaacagcgcccggcaccuuuaagacaccggaaggggaggugggagcuaucgcccucgauuucaagccuggcacguccgggagccccaucgugaaccgcgaaggaaaaauugucggccuguauggcaauggggugguuaccacaucuggaaccuacguguccgccaucgcucaggccaaggcgagccaggagggcccucuucccgagauugaagacgaggucuuucggaaaagaaaccugaccaucauggaucugcaccccggguccggaaagacacgccgguaucucccugcuauugugagagaagccaucaaacgcaagcugcggacgcuuauccuggccccgaccagaguuguggcuucugagauggccgaagcucucaagggcaugcccauucgcuaccaaacaaccgccgucaaaagcgagcauacagggaaggagaucguggaccugaugugccacgcgaccuucacgaugcggcugcucuccccuguuagagugcccaauuauaacaugauuaucauggaugaagcccauuuuacagacccuagcucuauugcugcccggggcuacaucuccacccgcgucggaaugggcgaggcugccgccaucuucaugaccgcuacacccccugggagcguggaagcguuuccgcagucuaaugccgugauucaggaugaggaaagagacauccccgagcggagcuggaacuccggauaugaguggauuaccgauuucccuggcaaaacagucugguuuguucccucuaucaagagcgggaaugacauugcuaacugucuucgcaaaaauggaaagagagugauccagcugucccggaagaccuucgauacggaauaccagaagaccaagaacaacgacugggacuacguggucaccacagauauuucugagaugggcgccaauuucagagccgaccgcgugaucgauccucggagaugccugaaacccguuauccucaaggacgggccggaacgcgugauucuggcuggcccuaugcccgucaccguggccagcgcggcucagcggagaggacgcaucggccggaaccacaauaaagagggggaucaguauauuuacaugggacagccccuuaacaaugacgaggaucaugcccacuggacggaagccaagaugcugcucgacaacaucaauaccccugagggcauuauccccgcucuguuugaaccugagagagaaaaguccgccgcgaucgauggggaguaucgccugagaggagaggcccggaaaacauucguugaacucaugcgcagaggcgaccuuccgguguggcugagcuacaaggucgcuucugagggguuucaauauuccgaucggcgcuggugcuucgacggcgaaagaaacaaucaggugcuggaggaaaacauggaugucgagauuuggaccaaagagggagaacggaagaaacucagaccccgcuggcuggacgcccggacauacagcgacccucuugcucugagagaguuuaaggaguucgccgcuggccgccgguccgugucuggggaucucauccuggagauuggaaaacugccccagcaccucacccagagagcccaaaaugcgcuugacaaccugguuaugcugcauaauagcgaacagggcgggcgggccuaucgccacgcuauggaggagcucccugauacaaucgaaacccugaugcuucuggcccucauugcugugcugacgggaggcgugacacuguuuuuccucuccggcagagggcuuggaaagaccucuaucggccugcugugugucauggccagcuccguucuccuguggauggccagcguggagccccauuggaucgcugcgucuauuauccuugaauuuuuccugauggugcuccugauuccggagccugaccggcagcgcacaccccaggauaaccaacuggccuacgucgugaucgggcuccuuuuuaugauucugacaguugcugccaaugagaugggacugcucgaaaccacaaagaaagaccugggcaucgggcacguggccgucgagaaccaccaucacgcugccaugcuugauguggaccugcauccugcguccgccuggacgcucuacgcugucgccaccacaauuaucacccccaugaugagacacacaaucgaaaacaccacggcuaauauuagccugaccgccaucgcgaaccaggccgcuauucugaugggacucgauaagggcuggccuaucucuaaaauggacauuggcgugccccuucuggcccuggggugcuauucccagguuaauccgcucacacugaccgcugccgugcuuaugcuggucgcucauuacgccaucaucggaccuggccuccaagcgaaggccacacgggaggcucagaaacgcaccgccgcugggauuaugaagaaccccacgguggauggaaucguugccauugaccuggaucccguggucuaugacgccaaguucgaaaaacagcugggccagaucaugcuccuuauucuguguacaagccaaauccugcucaugagaaccacaugggcgcugugcgagucuaucacccuugcuaccgggccucugacaacgcucugggagggaagcccgggcaaguuuuggaauaccacaauugccguguccauggcuaacaucuuccggggcucuuaccuggccggggccggacuggcuuucagccucaugaaaucccuuggcgggggacgcagaggcaccggggcccagggagaaacacugggcgagaaguggaaacggcagcugaaucagcucagcaaguccgaauuuaacaccuauaagagaucuggcauuauggagguggaccgcagcgaagcgaaagaggggcugaagcggggagagacgacaaaacacgccguuuccagaggcaccgcuaaacuucgcugguucgucgaacggaaucuggugaaacccgaggggaaggugaucgaucucggauguggcagagggggauggucuuacuauugcgccggccugaagaaagucaccgaaguuaagggcuacacaaaagggggaccuggccacgaggaacccauuccuauggcuaccuacggguggaaccuggugaagcuccauagcggaaaagacguguuuuucauucccccugagaagugugauacacuucugugcgacaucggcgaguccucuccgaaucccacgaucgaagaggggcgcacccugcggguccucaaaaugguggaaccuuggcugagaggaaaccaauuuuguaucaagauucuuaaucccuauaugccuagcguuguggagacacuggagcagaugcagcgcaagcacggcggcaugcucguccggaacccccuguccagaaauagcacccaugaaauguacugggugucuugcgggacaggaaacaucguuuccgccgugaauaugaccagccgcaugcugcucaaccgguucacgauggcgcacagaaaaccgaccuaugagcgcgaugucgaccugggcgccgggacaagacacguggcuguggaaccugaggucgccaaccuugauauuaucggacagcggauugaaaauaucaagcaugagcacaaaucuaccuggcauuacgacgaggauaaccccuauaagacaugggcuuaccacggcuccuaugaaguuaaacccagcgggucugccuccagcauggugaauggaguggucaagcugcucaccaagccuugggacgugauccccaugguuacacaaauugcuaugaccgauacgacaccuuuuggccagcagcgcguguucaaagagaaggucgacaccagaaccccgaaagccaagcggggcacagcgcaaaucauggaagugacggccaaauggcuguggggguuucuuuccagaaacaagaagccccggauuuguacccgcgaggaguucacaagaaaaguucggagcaaugcugccaucggagcuguguuugucgacgagaaccaguggaacucugccaaggaggccguggaagaugagcgcuucugggaccugguucauagagaacgggagcuccacaaacagggcaagugcgcgaccugcguguacaacaugauggggaaacgcgaaaagaagcugggagaguuuggcaaagcuaaggggagcagagccauuugguacauguggcugggcgcccgguuccucgaguucgaagcucugggauuuaugaaugaggaucacugguucucccgcgaaaacucucuuagcggcgucgagggggagggacugcauaaacucggcuauauccugagagacaucuccaagauuccugggggaaauauguacgccgaugacacagcuggcugggauacccggaucacagaagacgaucuucagaacgaggcccgcauuaccgacaucauggaacccgagcacgcgcugcucgccaaaucuauuuuuaagcugacguaucaaaauaaaguggucagagugcagcggccugcuaagaacgggaccguuauggaugugaucagccgcagagaccagcggggcuccggacaggucggcacauacgggcugaauaccuucacaaacauggaagcccaacucaucagacagauggagucugagggaauuuuuagccccuccgaacuggagaucccgaaccuugcugaacgcgugcuggauuggcucgagaaguauggcguggaacggcugaaaagaauggccauuagcggggacgacuguguugugaagccuaucgaugaccgcuucgcgaccgcccuuacggcucugaaugauaugggaaaaguccggaaggacauuccccagugggagccuucuaaaggcuggaacgauuggcagcaagugcccuuuugcucccaucacuuccaccagcucaucaugaaggacgggagagagauuguugugccuugucgcaaucaggaugaacuggucggccgggccagagugagccagggagcuggcuggucucugcgcgagacagccugccucgggaaguccuacgcucaaauguggcagcugauguauuuucaucggagagaccuucgccuggccgcgaacgccaucuguagcgcuguccccguggauuggaucccgaccucccggacaaccuggucuauucacgcccaucaccaguggaugacgaccgaagacaugcucagcguuuggaauagaguguggaucgaggaaaacccuuggauggaggauaaaacacauauuuccagcuggggagacguccccuaccugggcaagcgggaggaccaauggugcgggucucuuaucggacugaccgccagagcuacaugggccaccaauauucagguggcgaucaaccagguucgccggcucaucggcaaugaaaacuaccuggauuauaugacauccaugaaaagauucaagaaugagggggaccccgaaggcgcucugugguga

SEQ ID NO: 18848 - RNA, 9879 nt, Artificial Sequence
  derived and/or modified CDS sequence (opt5) from DENV-1__EU677178__SS-prME
uccgugaccaugcugcucaugcugaugcccacagcccuugcuuuccaccugacgaccagaggcggggaaccucauaugaucguguccaagcaggaacggggaaaaucucuccuguuuaagaccagcgccggcguuaauaugugcacccuuauugcgauggaccugggggaacucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuuccugacacaagaugaaaagggggugacgcagaacggacggcuuaucaccgcgaaucccauugucacagacaaagagaagccugugaacaucgaagcugagccgcccuuuggcgaguccuauauuaucauuggggccggagaaaaagcccucaagcugagcugguucaagaaaggcucuagcaucgggaagauguuugaggcuaccgccagaggcgcucgccggauggccauccugggagauacagcgugggacuucggcuccauugggggaguguuuaccucuguuggcaaacucguccaucagaucuucgggacggccuacggagugcuguuuagcggcguguccuggaccaugaagauugggaucggcguccuucugacauggcucggacugaauagcagaucuaccucccugagcaugacauguauugcugugggccuuguuacccucuaccugggggugaugguccaggccgauucuggaugcgugaucaacuggaaaggccgcgaacugaaguguggguccggaauuuucguuacaaaugaggugcacaccuggacggaacaauauaaguuucaggcugacagcccuaaacggcucuccgccgcgaucggcaaggccugggaggagggggucugcggcaucagaucugcuacacgccuggaaaacauuauguggaaacagaucagcaacgagcuuaaucauauucugcucgaaaacgacaugaaguucaccgugguugugggagaugucgccggcauccuggcucaggggaaaaagaugauucggccgcaacccauggaguacaaauauuccuggaagucuuggggaaaggccaaaaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaaacuucgcgauagccacacccaggucugcgaccaccggcucauguccgcggccaucaaagauagcaaggcuguucaugccgacaugggcuauuggaucgaaucugagaaaaaugaaacauggaagcuggccagagcuuccuucauugaggugaagaccuguaucuggcccaaaagccacacacuguggucuaacggggugcucgaauccgagaugauuaucccgaagauuuacggaggcccuaucagccaacauaauuaucgccccggguacuucacccagacggccggaccuuggcaccugggcaaacuugagcuggauuuugaccucugcgaagggaccacagucgugguugaugagcacugcggaaaccggggccccucucugagaaccacaaccgugacgggcaagaucauucaugaaugguguugccggagcuguacacugccuccccuucgcuucagaggggaggacggaugcugguacggcauggagauccggccggucaaagaaaaggaggaaaaucucgugaaguccaugguuagcgcggggucuggagagguggacuccuuuagccugggccugcucuguauuuccaucaugauugaagaggucaugagaucucgcuggagccggaaaaugcugaugaccgggacacuugcuguguucuuucugcucaucaugggacagcugaccuggaacgaucugauuagacuuugcaucaugguuggcgccaauaccuccgaccgcaugggcauggggacaacguaucuggcccucauggcuaccuucaagaugagaccuauguuugccgugggacuccuguuccggcgccugacaucuagagagguccuucugcucaccaucggccugagccugguggcguccguggaacuucccaacucucuggaggaacucggggauggacuggcuaugggcauuaugauccucaaacugcuuacagacuuucaaagccaccagcugugggccacccuccugucccugacguucauuaagacaaccuuuagccuucauuacgccuggaaaaccauggcuaugguccugucuaucguuucccucuucccccugugucucagcacaaccucucagaagacaacguggcugccugugcuucuggggucccugggaugcaagccgcucaccauguuucugauugccgagaauaaaaucuggggccggcgcagcuggccccuuaacgaaggcaucauggcuguggggauugucucuauccugcucuccagccugcucaagaacgaugugccucuggccggaccccuuauugcgggcgggaugcugaucgccuguuauguuauuuccggaagcucugcugaccugagccucgagaaagccgcugagguguccugggaagaggaagccgagcacucuggcgccagccauaauauccuggucgaagugcaggaugacgggacaaugaagaucaaagaugaggagagagacgauacccuuacaauucugcucaaggcuacccugcucgcgguuuccggaguguacccucugucuauccccgccacgcuuuucgucugguauuucuggcagaagaagaagcagcggagcggcgugcugugggacaccccuagcccucccgaagucgagcgcgcugugcuggaugacggcauuuacagaaucaugcagcgggggcuccugggacgcucucagguuggcgugggggucuuucaagaaaacguguuccacacaauguggcacguuaccagaggagccgugcuuauguaucagggcaaacggcuggagcccagcugggccuccgucaagaaagaccucauuagcuacgggggaggcuggagacugcagggcucuuggaauacaggggaggaaguccaggugaucgcuguugagcccggaaagaacccuaaaaauguccaaaccgcccccggcacauuuaagacgccggaaggggaggugggagcgauugcucucgauuucaagccuggcaccuccgggagccccaucgugaaccgcgaaggaaaaaucgucggccuguacggcaauggggugguuacaaccucuggaaccuauguguccgccauugcccaggcuaaggccagccaggagggcccucuucccgagaucgaagacgaggucuuucggaaaagaaaccugacaauuauggaucugcaucccggguccggaaagacgcgccgguaccucccugcgaucgugagagaagcuauuaaacgcaagcugcggacccuuauccuggccccgacaagaguuguggccucugagauggcugaagcccucaagggcaugcccauccgcuaucaaaccacagcugucaaaagcgagcacaccgggaaggagauuguggaccugaugugccaugccacguucacaaugcggcugcucuccccuguuagagugcccaauuacaacaugaucauuauggaugaagcgcacuuuaccgacccuagcucuaucgccgcucggggcuauauuuccacccgcgucggaaugggcgaggccgcugccaucuucaugacagccacacccccugggagcguggaggcuuuuccgcagucuaaugcggugauccaggaugaggaaagagacauucccgagcggagcuggaacuccggauacgaguggaucacagauuucccuggcaaaaccgucugguuuguucccucuauuaagagcgggaaugacaucgccaacugucuucgcaaaaauggaaagagagugauucagcugucccggaagacguucgauacagaauaucagaagaccaagaacaacgacugggacuacguggucacaaccgauaucucugagaugggcgcuaauuucagagccgaccgcgugauugauccucggagaugccugaaacccguuauccucaaggacgggccggaacgcgugauccuggccggcccuaugcccgucacgguggcuagcgccgcgcagcggagaggacgcauuggccggaaccauaauaaagagggggaucaguacaucuauaugggacagccccuuaacaaugacgaggaucacgcucacuggaccgaagccaagaugcugcucgacaacauuaauacaccugagggcaucauucccgcccuguuugaaccugagagagaaaaguccgcugccaucgauggggaguaccgccugagaggagaggcgcggaaaaccuucguugaacucaugcgcagaggcgaccuuccgguguggcugagcuauaaggucgccucugagggguuucaauacuccgaucggcgcuggugcuucgacggcgaaagaaacaaucaggugcuggaggaaaacauggaugucgagaucuggacaaaagagggagaacggaagaaacucagaccccgcuggcuggacgcucggaccuauagcgacccucuugcccugagagaguuuaaggaguucgcugccggccgccgguccgugucuggggaucucauucuggagaucggaaaacugccccagcaucucacacagagagcucaaaaugcccuugacaaccugguuaugcugcacaauagcgaacagggcgggcgggcguaccgccaugccauggaggagcucccugauaccauugaaacgcugaugcuucuggcucucaucgccgugcugacaggaggcgugacccuguuuuuccucuccggcagagggcuuggaaagaccucuauuggccugcugugugucauggcuagcuccguucuccuguggauggccagcguggagccccacuggaucgccgcuucuaucauucuugaauuuuuccugauggugcuccugaucccggagccugaccggcagcgcacaccccaggauaaccaacuggcguaugucgugauugggcuccuuuuuaugauccugaccguugccgcuaaugagaugggacugcucgaaacaacgaagaaagaccugggcauugggcacguggccgucgagaaccaucaccaugccgcuaugcuugauguggaccugcacccugccuccgcguggacccucuacgccgucgcuacaaccaucauuacacccaugaugagacauaccaucgaaaacacgaccgccaauaucagccugacagcuauugccaaccaggcggccauccugaugggacucgauaagggcuggccuauuucuaaaauggacaucggcgugccccuucuggcucuggggugcuacucccagguuaauccgcucacccugacagccgcugugcuuaugcuggucgcccacuaugcuauuaucggaccuggccuccaagccaaggcgacccgggaggcccagaaacgcacggcugccgggaucaugaagaaccccacaguggauggaauuguugcuaucgaccuggaucccguggucuacgacgccaaguucgaaaaacagcugggccagauuaugcuccuuauccuguguaccagccaaauucugcucaugagaacaaccugggcccugugcgagucuaucacccuugcgacagggccucugacgacccucugggagggaagcccgggcaaguuuuggaauacaaccaucgcuguguccauggccaacauuuuccggggcucuuaucuggcuggggccggacuggccuucagccucaugaaaucccuuggcgggggacgcagaggcacaggggcucagggagaaacccugggcgagaaguggaaacggcagcugaaucagcucagcaaguccgaauuuaacacguacaagagaucuggcaucauggagguggaccgcagcgaagccaaagaggggcugaagcggggagagacaaccaaacacgcgguuuccagaggcaccgccaaacuucgcugguucgucgaacggaaucuggugaaacccgaggggaaggugauugaucucggauguggcagagggggauggucuuauuacugcgcuggccugaagaaagucacagaaguuaagggcuauaccaaagggggaccuggccaugaggaacccaucccuauggccacauacggguggaaccuggugaagcuccacagcggaaaagacguguuuuucauucccccugagaagugugauacgcuucugugcgacaucggcgaguccucuccgaaucccaccauugaagaggggcgcacacugcggguccucaaaaugguggaaccuuggcugagaggaaaccaauuuuguaucaagauccuuaaucccuacaugccuagcguuguggagacccuggagcagaugcagcgcaagcauggcggcaugcucguccggaacccccuguccagaaauagcacacacgaaauguauugggugucuugcgggaccggaaacauuguuuccgcugugaauaugacgagccgcaugcugcucaaccgguucaccauggcccacagaaaaccgacauacgagcgcgaugucgaccugggcgcggggaccagacauguggccguggaaccugagaucgcuaaccuugauauuaucggacagcggauugaaaauaucaagcacgagcauaaaucuacauggcacuaugacgaggauaaccccuacaagaccugggccuaucauggcuccuacgaagucaaacccagcgggucugcuuccagcaugguuaauggaguggugaagcugcucacaaagccuugggacgucauccccauggugacccaaauugccaugacggauacaaccccuuuuggccagcagcgcguuuucaaagagaagguggacaccagaacaccgaaagcuaagcggggcacggcccaaaucauggaagucaccgcgaaauggcuguggggguuucuuuccagaaacaagaagccccggauuuguacacgcgaggaguucaccagaaaagugcggagcaaugccgcuaucggagccguuuuuguggacgagaaccaguggaacucugcuaaggaggccgucgaagaugagcgcuucugggaccuggugcacagagaacgggagcuccacaaacagggcaagugcgccacaugcguuuauaacaugauggggaaacgcgaaaagaagcugggagaguuuggcaaagcgaaggggagcagagcuauuugguacauguggcugggcgcccgguuccucgaguucgaagcccugggauuuaugaaugaggaucauugguucucccgcgaaaacucucuuagcggcguggagggggagggacugcacaaacucggcuacauccugagagacaucuccaagauuccugggggaaauauguaugcugaugacaccgccggcugggauacacggaucaccgaagacgaucuucagaacgaggcucgcauuacggacaucauggaacccgagcaugcccugcucgcgaaaucuauuuuuaagcugaccuaccaaaauaaagucgugagaguccagcggccugccaagaacgggacagugauggauguuaucagccgcagagaccagcggggcuccggacaggugggcaccuaugggcugaauacauucaccaacauggaagcucaacucaucagacagauggagucugagggaauuuuuagccccuccgaacuggagacgccgaaccuugccgaacgcguccuggauuggcucgagaaguacggcguggaacggcugaaaagaauggcuaucagcggggacgacugugugguuaagccuauugaugaccgcuucgccacagcgcuuaccgcccugaaugauaugggaaaagugcggaaggacaucccccagugggagccuucuaaaggcuggaacgauuggcagcaaguccccuuuugcucccaccacuuccaucagcucauuaugaaggacgggagagagaucgugguuccuugucgcaaucaggaugaacuggugggccgggcuagagucagccagggagccggcuggucucugcgcgagacagcuugccucgggaaguccuaugcccaaauguggcagcugauguacuuucaccggagagaccuucgccuggcugccaacgcgauuuguagcgccgugcccgucgauuggaucccgaccucccggacgaccuggucuauccaugcucaccaucaguggaugacaaccgaagacaugcucagcguguggaauagaguuuggauugaggaaaacccuuggauggaggauaaaacacacaucuccagcuggggagacgugcccuaucugggcaagcgggaggaccaauggugcgggucucuuauuggacugaccgccagagccacaugggcuaccaauauccaggucgccauuaaccaggugcgccggcucaucggcaaugaaaacuaccuggauuacaugacguccaugaaaagauucaagaaugagggggaccccgaaggcgcgcugugguga

SEQ ID NO: 18849 - RNA, 9879 nt, Artificial Sequence
  derived and/or modified CDS sequence (opt5) from DENV-1__EU687251__SS-prME
agcgugaccaugcugcucaugcugaugcccacagcccuugcuuuccaccugacgaccagaggcggggaaccucauaugaucguguccaagcaggaacggggaaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauuaucauuggggccggagaaaaagcccuuaagcucucuugguucaagaaaggcagcuccaucgggaagauguuugaggcuaccgccagaggcgcucgccggauggccauccugggagauacagcgugggacuucggcucuauugggggaguguuuaccagcguuggcaaacugguccaucagaucuucgggacggccuacggagugcucuuuuccggcgugagcuggaccaugaagauugggaucggcguccugcuuacauggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcugucugccgcgaucggcaaggccugggaggagggggucugcggcaucagaagcgcuacacgccucgaaaacauuauguggaaacagaucuccaacgagcugaaucauauucuucuggaaaacgacaugaaguucaccgugguugugggagaugucgccggcauccucgcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaagcugcgcgauucccacacccaggucugcgaccaccggcuuaugagcgcggccaucaaagauucuaaggcuguucaugccgacaugggcuauuggaucgaauccgagaaaaaugaaacauggaagcucgccagagcuagcuucauugaggugaagaccuguaucuggcccaaaucucacacacugugguccaacggggugcuggaaagcgagaugauuaucccgaagauuuacggaggcccuaucucucaacauaauuaucgccccggguacuucacccagacggccggaccuuggcaccucggcaaacuggagcuugauuuugaccugugcgaagggaccacagucgugguugaugagcacugcggaaaccggggccccagccucagaaccacaaccgugacgggcaagaucauucaugaaugguguugccgguccuguacacugccuccccugcgcuucagaggggaggacggaugcugguacggcauggagauccggccggucaaagaaaaggaggaaaaucuugucaagagcaugguuucugcgggguccggagagguggacagcuuuucccucggccugcuguguauuucuaucaugauugaagaggucaugagaagccgcuggucccggaaaaugcucaugaccgggacacuggcuguguucuuucuucugaucaugggacagcucaccuggaacgaucugauuagacugugcaucaugguuggcgccaaugccucugaccgcaugggcauggggaccacauaucuugcucugauggccacguucaagaugagaccuauguuugcggugggacuccuguuccggcgccucaccagcagagagguccugcuucugacaaucggccucucccugguggcuucuguggaacugcccaacagccuugaggaacugggggauggacucgccaugggcauuaugauccugaaacuccugaccgacuuucaaucccaccagcuuugggccacacugcucagccugaccuucauuaagacgacauuuucucugcauuacgcuuggaaaaccauggccaugguccuuuccaucguuagccuguucccccucugucugucuaccacaucccagaagaccacauggcucccugugcugcuugggagccugggaugcaagccgcugacgauguuucucauugcugagaauaaaaucuggggccggcgcucuuggccccugaacgaaggcaucauggccguggggauugucuccauccuucugagcucccuccugaagaacgaugugccucucgcgggaccccugauugccggcgggaugcuuaucgcuuguuauguuauuagcggaucuagcgccgaccugucccuggagaaagcugccgaggugucuugggaagaggaagccgagcacagcggcgcuucccauaauauccucgucgaagugcaggaugacgggaccaugaagaucaaagaugaggagagagacgauacacugaccauucuucugaaggcgacacuccuggccguuucuggaguguacccucucagcauccccgcuacccuguucgucugguauuucuggcagaagaagaagcagcgguccggcgugcuuugggacacgccuucucccccggaagucgagcgcgccgugcuggaugacggcauuuacagaaucaugcagcgggggcugcucggacgcagccagguuggcgugggggucuuucaagaaaacguguuccacaccauguggcacguuacaagaggagccgugcugauguaucagggcaaacggcuugagccuuccugggcuagcgucaagaaagaccugauuucuuacgggggaggcuggagacuccagggcuccuggaauaccggggaggaaguccaggugaucgccguugagcccggaaagaacccuaaaaauguccaaacagcgcccggcaccuuuaagacaccggaaggggaggugggagcuauugcccuggauuucaagccuggcacgagcgggucucccaucgugaaccgcgaaggaaaaaucgucggccucuacggcaauggggugguuaccacauccggaaccuaugugagcgccauugcucaggccaaggcgucccaggagggcccucugcccgagaucgaagacgaggucuuucggaaaagaaaccuuaccauuauggaucugcaucccgggucuggaaagacacgccgguaccugccugcuaucgugagagaagccauuaaacgcaagcuccggacgcugauccuugccccgaccagaguuguggcuagcgagauggccgaagcucugaagggcaugcccauccgcuaucaaacaaccgccgucaaauccgagcacacagggaaggagauuguggaccucaugugccaugcgaccuucacgaugcggcugcugagcccuguuagagugcccaauuacaacaugaucauuauggaugaagcccacuuuacagacccuucuuccaucgcugcccggggcuauauuagcacccgcgucggaaugggcgaggcugccgccaucuucaugaccgcuacacccccugggucuguggaagcguuuccgcagagcaaugccgugauccaggaugaggaaagagacauucccgagcgguccuggaacucuggauacgaguggaucaccgauuucccuggcaaaacagucugguuuguucccagcauuaaguccgggaaugacaucgcuaacugucuccgcaaaaauggaaagagagugauucagcuuucucggaagaccuucgauacggaauaucagaaaaccaagaacaacgacugggacuacguggucaccacagauaucagcgagaugggcgccaauuucagagccgaccgcgugauugauccucggagaugccugaaacccguuauccugaaggacgggccggaacgcgugauccucgcuggcccuaugcccgucaccguggccuccgcggcucagcggagaggacgcauuggccggaaccauaauaaagagggggaucaguacaucuauaugggacagccccugaacaaugacgaggaucacgcccacuggacggaagccaagaugcuucuggacaacauuaauaccccugagggcaucauucccgcucucuuugaaccugagagagaaaagagcgccgcgaucgauggggaguaccgccugagaggagaggcccggaaaacauucguugaacugaugcgcagaggcgaccucccgguguggcuuucuuauaaggucgcuuccgagggguuucaauacagcgaucggcgcuggugcuucgacggcgaaagaaacaaucaggugcuggaggaaaacauggaugucgagaucuggaccaaagagggagaacggaagaaacugagaccccgcuggcucgacgcccggacauauuccgacccucuggcucuuagagaguuuaaggaguucgccgcuggccgccggucugugagcggggaucugauucucgagaucggaaaacugccccagcaucugacccagagagcccaaaaugcgcucgacaaccuuguuaugcugcacaauuccgaacagggcgggcgggccuaccgccaugcuauggaggagcugccugauacaauugaaacccucaugcugcuugcccugaucgcugugcucacgggaggcgugacacuguuuuuccugucuggcagagggcucggaaagaccagcauuggccuucugugugucauggccuccagcguucugcucuggauggccucuguggagccccacuggaucgcugcguccaucauucuggaauuuuuccuuauggugcugcucaucccggagccugaccggcagcgcacaccccaggauaaccaacuggccuaugucgugauugggcugcucuuuaugauccuuacaguugcugccaaugagaugggacugcuggaaaccacaaagaaagaccucggcauugggcacguggccgucgagaaccaucaccaugcugccaugcuggauguggaccuucacccugcgagcgccuggacgcuguacgcugucgccaccacaaucauuacccccaugaugagacauacaaucgaaaacaccacggcuaauaucucucucaccgccauugcgaaccaggccgcuauccugaugggacuggauaagggcuggccuauuuccaaaauggacaucggcgugccccuccuugcccuggggugcuacagccagguuaauccgcugacacucaccgcugccgugcugaugcuugucgcucacuaugccauuaucggaccuggccugcaagcgaaggccacacgggaggcucagaaacgcaccgccgcugggaucaugaagaaccccacgguggauggaauuguugccaucgaccucgaucccguggucuacgacgccaaguucgaaaaacagcugggccagauuaugcugcucauccuuuguacaucucaaauucugcugaugagaaccacaugggcgcucugcgagagcaucacccuggcuaccgggccucuuacaacgcugugggagggauccccgggcaaguuuuggaauaccacaaucgccgugucuauggcuaacauuuuccggggcagcuaucucgccggggccggacuggcuuucucccugaugaaaagccucggcgggggacgcagaggcaccggggcccagggagaaacacuuggcgagaaguggaaacggcagcugaaucagcuguccaagucugaauuuaacaccuacaagagaagcggcaucauggagguggaccgcuccgaagcgaaagaggggcucaagcggggagagacgacaaaacacgccguuucuagaggcaccgcuaagcugcgcugguucgucgaacggaaucuugugaaacccgaggggaaggugauugaucugggauguggcagagggggauggagcuauuacugcgccggccucaagaaagucaccgaaguuaagggcuauacaaaagggggaccuggccaugaggaacccaucccuauggcuaccuacggguggaaccuggugaagcugcacuccggaaaagacguguuuuucauucccccugagaagugugauacacuccuuugcgacaucggcgagucuagcccgaaucccacgauugaagaggggcgcacccugcggguccugaaaaugguggaaccuuggcucagaggaaaccaauuuuguaucaagauccugaaucccuacaugccuuccguuguggagacacuugagcagaugcagcgcaagcauggcggcaugcugguccggaacccccucagcagaaauucuacccacgaaauguauuggguguccugcgggacaggaaacauuguuagcgccgugaauaugaccucucgcaugcugcugaaccgguucacgauggcgcacagaaaaccgaccuacgagcgcgaugucgaccucggcgccgggacaagacauguggcuguggaaccugaggucgccaaccuggauaucauuggacagcggaucgaaaauauuaagcacgagcauaaauccaccuggcacuaugacgaggauaaccccuacaagacaugggcuuaucauggcagcuacgaaguuaaacccucuggguccgccagcuccauggugaauggaguggucaaacuucugaccaagccuugggacgugauccccaugguuacacaaaucgcuaugaccgauacgacaccuuuuggccagcagcgcguguucaaagagaaggucgacaccagaaccccgaaagccaagcggggcacagcgcaaauuauggaagugacggccaaauggcucuggggguuucugagcagaaacaagaagccccggaucuguacccgcgaggaguucacaagaaaaguucggucuaaugcugccauuggagcuguguuugucgacgagaaccaguggaauagcgccaaggaggccguggaagaugagcgcuucugggaccuuguucacagagaacgggagcugcacaaacagggcaagugcgcgaccugcguguauaacaugauggggaaacgcgaaaagaagcucggagaguuuggcaaagcuaagggguccagagccaucugguacauguggcugggcgcccgguuccuggaguucgaagcucucggauuuaugaaugaggaucauugguucucucgcgaaaacagccuguccggcgucgagggggagggacuucacaaacugggcuacauucucagagacaucucuaagaucccugggggaaauauguaugccgaugacacagcuggcugggauacccggauuacagaagacgaucugcagaacgaggcccgcaucaccgacauuauggaacccgagcaugcgcuucuggccaaaagcaucuuuaagcucacguaccaaaauaaaguggucagagugcagcggccugcuaagaacgggaccguuauggaugugauuucccgcagagaccagcggggcucuggacaggucggcacauaugggcugaauaccuucacaaacauggaagcccaacugaucagacagauggagagcgagggaaucuuuucccccagcgaacucgagaccccgaaccuggcugaacgcgugcuugauuggcugaagaaauacggcguggagcggcucaagagaauggccauuucuggggacgacuguguugugaaaccuaucgaugaccgcuucgcgacggcccugacagcucuuaaugauaugggaaagguccggaaagacauuccccagugggaaccuuccaagggcuggaacgauuggcagcaagugcccuuuugcagccaccacuuccaucagcugaucaugaaggacgggagagagauuguugugccuugucgcaaucaggaugagcucgucggccgggccagagugucucagggagcuggcuggucccugcgcgaaaccgccugccuggggaaaagcuaugcucaaauguggcagcucauguacuuucaccggagagaccugcgccuugccgcgaacgccaucuguuccgcuguccccguggauuggauuccgacaucucggaccacguggagcauccaugcccaccaucaguggaugaccacagaggacaugcuguccguuuggaauagaguguggaucgaagagaacccuuggauggaagauaagacccacauuagcucuuggggagacguccccuaucucggcaaacgggaggaccaauggugcgggucccugaucggacuuacagccagagcuaccugggccacaaauauucagguggcgaucaaccagguucgccggcugauuggcaaugagaacuaccucgauuacaugaccagcaugaagagauucaaaaaugaaucugaccccgagggggcucugugguga

SEQ ID NO: 18850 - RNA, 9879 nt, Artificial Sequence
  derived and/or modified CDS sequence (opt5) from DENV-1__FJ024427__SS-prME
agcgugaccaugcugcucaugcugaugcccaccgcccuugcuuuccaccugacgaccagaggaggggaaccucauaugaucguguccaagcaggaacggggaaaaucucuccuguuuaagaccagcgccggaguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccagacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacaggcuacggcgcccugacccuggacuguucuccccggacggggcucgauuucaacgaaauggugcugcuuacaaugaaggagaaauccuggcugguccauaagcagugguuucucgaccugccucuucccuggaccagcggagccuccacaucucaagagaccuggaaucgccaggaucugcucgugaccuucaaaacagcucacgcgaagaagcaggaagucgugguucugggcagccaagagggggccaugcacacggcucugaccggagccacagaaauucagaccuccggcacaaccacgaucuuugccgggcaucucaaaugcagacugaagauggacaaacuuacacugaagggcaugagcuaugugauguguaccggaucuuucaaacucgagaaggaagucgcugagacccagcacggcacagugcugguucagauuaaguacgagggggccgaugcgccgugcaaaaucccuuucuccacccaagacgaaaagggaaucacacagaacggccggcugauuacggcuaaucccaucgugaccgauaaagagaagccugucaacauugaagccgagccgcccuuuggggagagcuauaucgugauuggagccggcgaaaaagcucuuaagcucucuugguucaagaaagggagcuccaucggcaagauguuugaggccacagcuagaggagcccgccggauggcgauccugggcgacaccgccugggauuucgggucuauuggaggcguguuuacaagcguugggaaacugguccaucagaucuucggaaccgcuuacggcgugcucuuuuccggggugagcuggacgaugaagauuggcaucggaguccugcuuaccuggcugggccucaauucuagauccacaagccugucuaugaccuguauugccguggggcugguuacacuuuaccucggagugaugguccaggcugacuccggcugcgugaucaacuggaaagggcgcgaacugaaguguggaagcggcauuuucguuaccaaugaggugcacacauggaccgaacaauauaaguuucaggccgauuccccuaaacggcugucugcggccaucgggaaggcuugggaggagggcgucugcggaaucagaagcgccacgcgccucgaaaacauuauguggaaacagaucuccaacgagcugaaucauauucuucuggaaaacgacaugaaguucacagugguugugggcgacgucgcugggauccucgcccagggcaagaagaugauucggccgcaacccauggaguacaaauauucuuggaaaagcuggggcaaggccaagaucaucggggcugaugugcagaauaccaccuuuauuaucgacggaccuaacacacccgaauguccugaugaccagagagcguggaauauuugggagguggaggauuacggcuucggcaucuuuaccacgaacauuuggcugaagcugcgcgacuccuauacacaggucugcgaucaccggcuuaugagcgccgcuaucaaagacucuaaggccguucacgccgauaugggguacuggaucgaauccgagaaaaaugaaaccuggaagcucgcuagagccagcuucauugaggugaagacauguaucuggcccaaaucucauacccugugguccaacggagugcuggaaagcgagaugauuaucccgaagauuuauggcgggccuaucucucaacacaauuaccgccccggauacuucacacagaccgcgggcccuuggcaucucgggaaacuggagcuugacuuugaucugugcgaaggaacgaccgucgugguugacgagcacugcggcaaccggggccccagccucagaacaaccacagugaccgggaagaucauucacgaaugguguugccgguccuguacgcugccuccccugcgcuucagaggagaggauggcugcugguaugggauggagauccggccggucaaagaaaaggaggaaaaucuugucaagagcaugguuucugcuggauccggcgagguggacagcuuuucccucgggcugcuguguauuucuaucaugauugaagaggucaugagaagccgcuggucccggaaaaugcucaugacaggaacccuggccguguucuuucuucugaucaugggccagcucacauggaacgaccugauuagacugugcaucaugguuggcgccaaugcuucugaucgcauggggaugggaaccaccuaccuugcccugauggcgacauucaagaugagaccuauguuugcugugggccuccuguuccggcgccucacgagcagagagguccugcuucugaccaucgggcucucccugguggccucuguggaacugcccaacagccuugaggaacugggagacggccucgccauggggauuaugauccugaaacuccugacagauuuucaaucccaucagcuuugggcuacccugcucagccugacauucauuaagaccacguuuucucugcacuaugccuggaaaacaauggcuaugguccuuuccaucguuagccuguucccccucugucugucuaccaccucccagaagacaaccuggcucccugugcugcuuggaagccugggcugcaagccgcugacaauguuucucauugccgagaauaaaaucuggggccggcgcucuuggccccugaacgaagggaucauggcggugggaauugucuccauccuucugagcucccuccugaagaacgacgugccucucgccggcccccugauugcugggggaaugcuuaucgccuguuacguuauuagcggcucuagcgcugaucugucccuggagaaagccgccgaggugucuugggaagaggaagcugagcauagcggggcgucccacaauauccucgucgaagugcaggacgauggaacgaugaagaucaaagacgaggagagagaugacacccugacaauucuucugaaggccacccuccuggcuguuucuggcguguauccucucagcauccccgccacacuguucgucugguacuucuggcagaaaaagaagcagcgguccggcgugcuuugggauaccccuucucccccggaagucgagcgcgccgugcuggacgaugggauuuauagaaucaugcagcggggacugcucggccgcagccagguuggggugggagucuuucaagaaaacguguuccauacgauguggcacguuaccagaggcgcugugcugauguaccaggggaaacggcuugagccuuccugggccagcgucaagaaagaccugauuucuuacggaggcggcuggagacuccagggguccuggaauacaggagaggaaguccaggugaucgcgguugagcccggcaagaacccuaaaaauguccaaaccgcucccgggacauuuaagaccccggaaggagaggugggcgccauugcccuggacuucaagccugggacaagcggaucucccaucgugaaccgcgaaggcaaaaucgucggccucuaugggaauggagugguuacgaccuccggcacauacgugagcgcuauugcccaggcgaaggcuucccaggaggggccucugcccgagaucgaagaugaggucuuucggaaaagaaaccuuaccauuauggaccugcaccccggaucuggcaagacccgccgguaucugccugccaucgugagagaagccauuaaacgcaagcuccggacacugauccuugcuccgacgagaguuguggccagcgagauggcugaagcccugaaggggaugcccauccgcuaccaaaccacagcggucaaauccgagcauaccggcaaggagauuguggaucucaugugccacgccacauucaccaugcggcugcugagcccuguuagagugcccaauuauaacaugaucauuauggacgaagcucauuuuacggauccuucuuccaucgccgcucggggauacauuagcacacgcgucggcaugggggaggccgccgcuaucuucaugaccgcgacacccccuggaucuguggaagccuuuccgcagagcaaugcugugauccaggacgaggaaagagauauucccgagcgguccuggaacucuggcuaugaguggaucacagacuucccugggaaaaccgucugguuuguucccagcauuaaguccggaaaugauaucgccaacugucuccgcaaaaauggcaagagagugauucagcuuucucggaagacauucgacaccgaauaccagaaaacgaagaacaacgauugggacuacguggucacaaccgacaucagcgagaugggggccaauuucagagcugaucgcgugauugacccucggagaugccugaaacccguuauccugaaggauggcccggaacgcgugauccucgccggaccuaugcccgucacaguggcguccgcugcccagcggagaggccgcauugggcggaaccacaauaaagagggagaccaguauaucuacaugggccagccccugaacaaugaugaggaccaugcccacuggaccgaagcuaagaugcuucuggauaacauuaauacgccugaggggaucauucccgcccucuuugaaccugagagagaaaagagcgcggccaucgacggagaguaucgccugagaggcgaggcucggaaaaccuucguugaacugaugcgcagaggggaucucccgguguggcuuucuuacaaggucgccuccgagggcuuucaauauagcgaccggcgcuggugcuucgauggagaaagaaacaaucaggugcuggaggaaaacauggacgucgagaucuggacaaaagagggcgaacggaagaaacugagaccccgcuggcucgaugcucggaccuacuccgacccucuggcccuuagagaguuuaaggaguucgcugccgggcgccggucugugagcggagaccugauucucgagaucggcaaacugccccagcaccugacacagagagcgcaaaaugcccucgauaaccuuguuaugcugcauaauuccgaacaagggggacgggcuuaucgccacgccauggaggagcugccugacaccauugaaacacucaugcugcuugcucugaucgccgugcucaccggcggcgugacgcuguuuuuccugucugggagaggacucggcaagacaagcauugggcuucugugugucauggccuccagcguucugcucuggauggcuucuguggagccccauuggaucgcggccuccaucauucuggaauuuuuccuuauggugcugcucaucccggagccugaucggcagcgcacaccccaggacaaccaacuggcuuacgucgugauuggacugcucuuuaugauccuuaccguugccgccaaugagaugggccugcuggaaacaaccaagaaagaucucgggauuggacacguggcugucgagaaccaccaucacgccgcgaugcuggacguggaucuucauccugccagcgcuuggacacuguacgccgucgcuacgaccaucauuacacccaugaugagacacaccaucgaaaacacaaccgccaauaucucucucacggcgauugccaaccaggcugccauccugaugggccuggacaagggcuggccuauuuccaaaauggauaucggggugccccuccuugcucugggaugcuauagccagguuaauccgcugacccucacagccgcugugcugaugcuugucgcccauuacgcgauuaucggcccugggcugcaagccaaggcuacccgggaggcccagaaacgcacagcugccggaaucaugaagaaccccaccguggacggcauuguugccaucgaucucgaccccguggucuaugaugcgaaguucgaaaaacagcuggggcagauuaugcugcucauccuuuguacgucucaaauucugcugaugagaacaaccugggcucucugcgagagcaucacacuggccaccggaccucuuaccacacugugggagggcuccccgggcaaguuuuggaauacgaccaucgcugugucuauggccaacauuuuccgggggagcuaccucgccggagcuggccuggccuucucccugaugaaaagccucgggggaggccgcagagggacaggagcgcagggcgaaacccuuggcgagaaguggaaacggcagcugaaucagcuguccaagucugaauuuaacacauauaagagaagcgggaucauggagguggaccgcuccgaagccaaagagggacucaagcggggcgagaccacgaaacacgcuguuucuagagggacagccaagcugcgcugguucgucgaacggaaucuugugaaacccgagggaaaggugauugaccugggcugugggagaggaggcuggagcuacuauugcgcuggccucaagaaagucaccgaaguuaagggguacaccaaaggaggcccugggcacgaggaacccaucccuauggccacauacggauggaaccuggugaagcugcauuccggcaaagauguguuuuucauucccccugagaagugugacacccuccuuugcgauaucggggagucuagcccgaaucccacaauugaagagggacgcacgcugcggguccugaaaaugguggaaccuuggcucagaggcaaccaauuuuguaucaagauccugaaucccuauaugccuuccguuguggagacccuugagcagaugcagcgcaagcacggcgggaugcugguccggaacccccucagcagaaauucuacacaugaaauguacuggguguccugcggaaccggcaacauuguuagcgcggugaauaugacaucucgcaugcugcugaaccgguucaccauggcccacagaaaaccgacguaugagcgcgacgucgaucucggggcuggaaccagacacguggccguggaaccugaggucgcuaaccuggacaucauuggccagcggaucgaaaauauuaagcaugagcacaaauccacauggcauuacgaugaggacaaccccuauaagaccugggccuaccacgggagcuaugaaguuaaacccucuggauccgcuagcuccauggugaauggcguggucaaacuucugacaaagccuugggaugugauccccaugguuacccaaaucgccaugacagacaccacgccuuuuggccagcagcgcguguucaaagagaaggucgauacaagaaccccgaaagcgaagcgggggaccgcccaaauuauggaagugacagcuaaauggcucuggggauuucugagcagaaacaagaagccccggaucuguacgcgcgaggaguucaccagaaaaguucggucuaaugccgcuauuggcgccguguuugucgacgagaaccaguggaauagcgccaaggaggcgguggaagacgagcgcuucugggaucuuguucauagagaacgggagcugcacaaacaggggaagugcgcuacaugcguguacaacaugaugggaaaacgcgaaaagaagcucggcgaguuugggaaagccaagggcuccagagccaucugguacauguggcugggagcucgguuccuggaguucgaagcccucggcuuuaugaaugaggaccacugguucaaccgcgaaaauucucugagcggggucgagggagagggccuucauaaacugggguauauucucagagauaucuccaagaucccuggaggcaacauguacgcugacgauaccgccgggugggacacacggauuaccgaagaugaccugcagaaugaggcgcgcaucacagauauuauggaacccgagcacgcccuucuggcuagaucuaucuuuaaacucaccuaucaaaacaaggugguccgggugcagcgcccugccaaaaauggcacgguuauggacgugauuagcagacgggaucagagaggauccggccaggucgggaccuacggacugaacacauucaccaacauggaagcucaacugauccgccagauggagucugagggcaucuuuagccccuccgaacucgagacaccgaaucuggccgaacgggugcuugacuggcuggagaaguaugggguggaaagacucaagcgcauggcgauuagcggagaugacuguguugugaaaccuaucgacgaucgguucgccaccgcucugacggcccuuaacgacaugggcaaggucagaaaagauauuccccagugggagccuucuaagggguggaaugacuggcagcaagugcccuuuugcucccaucacuuccaccagcugaucaugaaagauggccgcgagauuguugugccuugucggaaccaggacgaacucgucggcagagcucgcgugagccagggcgccggguggucucugcgggagacagcuugccugggaaaguccuacgcccaaauguggcagcucauguauuuucauagacgcgaucugcggcuugcggccaaugcuaucuguagcgccguccccguggacuggauuccgaccuccagaacaaccuggucuauccacgcccaucaccaguggaugacgaccgaagauaugcugagcguuuggaaccggguguggaucgaggaaaauccuuggauggaggacaagacacauauuuccagcuggggcgauguccccuaccucgggaaaagagaggaccaauggugcggaucucugaucggccuuaccgcucgcgccacaugggcgaccaacauucagguggcuaucaaucagguucggagacugauugggaacgaaaauuaccucgacuauaugacauccaugaagcgcuucaaaaacgagagcgaucccgaaggcgcccugugguga

SEQ ID NO: 18851 - RNA, 9879 nt, Artificial Sequence
  derived and/or modified CDS sequence (opt5) from DENV-1__FJ024428__SS-prME
agcgugaccaugcugcucaugcugaugcccacagcccuugcuuuccaccugacgaccagaggcggggaaccucauaugaucguguccaagcaagaacgggggaaaucucuccuguuuaagaccagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaccgcucuuuuucuggcccaugcgaucgggaccucuauuacacagaagggaaucaucuucauucuccugaugcuugucacgccuagcauggccaugagaugcgugggcaucgggucccgggauuuuguugagggacugagcggcgcuaccuggguggacgucgugcucgagcacgggucuugugugacaaccauggccaaggauaaacccacacuggacauugaacugcucaagaccgaggucacgaacccugcuguucugcgcaaacuuugcaucgaagccaagauuuccaauacaaccaccgauagcagauguccgacacaaggagaggcgacccugguggaagaacaagacgccaacuucgugugccggcgcacauuugucgauagaggcuggggcaauggguguggacucuucggcaaagggucucugaucacgugcgcuaaguuuaagugcgugaccaaacuugagggaaagauuguucaguacgaaaaccugaaauauuccgugaucgucacagugcacaccggcgaccagcaucaaguugggaaugagagcacagaacacggaaccacggccaccaucacaccccaggcuccuaccacagagauucagcucaccgacuacggcgcccugacgcuggauuguucuccccggacaggccucgacuucaacgaaauggugcugcuuaccaugaaggagaaauccuggcugguccauaagcagugguuucucgaucugccucuucccuggacaagcggggccuccaccucucaagagaccuggaaucgccaggaccugcucgugacauucaaaacggcucacgcgaagaagcaggaagucgugguucugggaagccaagagggcgccaugcacaccgcucugacaggggccaccgaaauccagacauccggaaccacgacaauuuuugccggccaucucaaaugcagacugaagauggauaaacuuacccugaaggggaugagcuaugugauguguaccggcucuuucaaacucgagaaggaacuggcugagacacagcacggaaccguccuggugcagaucaaguacgagggcacagacgccccgugcaaaauuccuuucuccacgcaagaugaaaaggggguuacccagaacggacggcuuaucacagcgaaucccaucgugaccgacaaagagaagccugucaacauugaagcugagccgcccuuuggcgagagcuauaucgugauuggggccggagaaaaagcccucaagcugucuugguucaagaaaggcagcuccaucgggaagauguuugaggcuacagccagaggcgcucgccggauggccauucugggagauaccgcgugggacuucggcucuaucgggggaguguuuacgagcguuggcaaacucguccaucagaucuucgggaccgccuacggagugcuguuuuccggcgugagcuggacaaugaagauugggaucggcguccuucugaccuggcucggacucaauucuagauccacaagccugucuaugaccuguauugcugugggccuuguuacacucuaccugggggugaugguccaggccgauuccggaugcgugaucaacuggaaaggccgcgaacugaagugugggagcggaauuuucguuaccaaugaggugcacacguggacagaacaauauaaguuucaggcugacuccccuaaacggcucucugccgcgaucggcaaggccugggaggagggggucugcggcauuagaagcgcuacccgccuggaaaacaucauguggaaacagaucuccaacgagcuuaaucauauucugcucgaaaacgacaugaaguucaccgugguugugggagaugucgccggcauccuggcucaggggaaaaagaugauucggccgcaacccauggagcacaaauacucuuggaaaagcuggggaaaggccaagaucauuggcgccgacgugcagaauacaaccuuuaucaucgaugggccuaacacgcccgaauguccugacgaucagagagcuuggaauauuugggagguggaggacuauggauucggcaucuuuacaaccaacauuuggcugaaacuucgcgauuccuacacacaggucugcgaccaccggcucaugagcgcggccaucaaagauucuaaggcuguucaugccgacaugggcuauuggauugaauccgagaaaaaugaaaccuggaagcuggccagagcuagcuucaucgaggugaagacauguaucuggcccaaaucucacacccugugguccaacggggugcucgaaagcgagaugauuaucccgaagauuuacggaggcccuaucucucaacauaauuaucgccccggguacuucacgcagaccgccggaccuuggcaccugggcaaacuugagcuggauuuugaccucugcgaagggacaaccgucgugguugaugagcacugcggaaaccggggccccagccugagaacaaccacggugacaggcaagauuauccaugaaugguguugccgguccuguacccugccuccccuucgcuucagaggggaggacggaugcugguacggcauggagauccggccggucaaagaaaaggaggaaaaucucgucaagagcaugguuucugcgggguccggagagguggacagcuuuucccugggccugcucuguauuucuaucaugauugaagaggucaugagaagccgcuggucccggaaaaugcugaugacagggacccuugcuguguucuuucugcucaucguuggacagcugaccuggaacgaucugauuagacuuugcaucauggugggcgccaaugccucugaccgcaugggcauggggacaacguaucuggcucucauggccaccuucaagaugagaccuauguuugcggucggacugcuguuccggcgccugacaagcagagaggugcuucugcucaccauuggccugucccugguggcuucugucgaacuucccaacagccuggaggaacucggggauggacuggccaugggcaucaugauccucaaacugcuuacagacuuucaaucccaccagcugugggccacccuccugagccugacguucauuaagacaaccuuuucucuucauuacgcuuggaaaaccauggccaugguucuguccguggugagccucuucccccugugucucucuacaaccucccagaagacaacguggcugccuguccuucuggggagccugggaugcaagccgcucaccauguuucugaucgcugagaauaaaauuuggggccggcgcucuuggccccuuaacgaaggcaucauggccguggggauuguuuccauccugcucagcucccugcucaagaacgaugugccucuggcgggaccccuuaucgccggcgggaugcugauugcuuguuaugucaucagcggaucuagcgccgaccugucccucgagaaagcugccgaggugucuugggaagaggaagccgagcacagcggcgcuucccauaauauucugguugaagugcaggaugacgggacaaugaagaucaaagaugaggagagagacgauacccuuacaauucugcucaaggcgacccugcucgccgucucuggaguguacccucugagcauccccgcuacgcuuuucgucugguauuucuggcagaagaagaagcagcgguccggcgugcugugggacaccccuucucccccggaaguugagcgcgccgugcuggaugacggcaucuacagaauuaugcagcgggggcuccugggacgcagccaggucggcguggggguuuuucaagaaaacguguuccacacaauguggcacgucaccagaggagccgugcuuauguaucagggcaaacggcuggagccuuccugggcuagcgugaagaaagaccucaucucuuacgggggaggcuggagacugcagggcuccuggaauacaggggaggaaguucaggucauugccguggagcccggaaagaacccuaaaaaugugcaaaccgcgcccggcacauuuaagacgccggaaggggaggucggagcuaucgcccucgauuucaagccuggcaccagcgggucucccauugugaaccgcgaaggaaaaaucguuggccuguacggcaaugggguggucacaaccuccggaaccuaugugagcgccauugcucaggccaaggcgucccaggagggcccucuucccgagaucgaagacgagguuuuucggaaaagaaaccugacaaucauggaucugcaucccgggucuggaaagacgcgccgguaccucccugcuauugugagagaagccaucaaacgcaagcugcggacccuuauucuggccccgacaagagucguggcuagcgagauggccgaagcucucaagggcaugcccauccgcuaucaaaccacagccguuaaauccgagcacaccgggaaggagauuguggaccugaugugccaugcgacguucacaaugcggcugcucagcccugucagagugcccaauuacaacaugaucaucauggaugaagcccacuuuaccgacccuucuuccauugcugcccggggcuauaucagcacccgcgugggaaugggcgaggcugccgccauuuucaugacagcuacacccccugggucugucgaagcguuuccgcagagcaaugccguuauccaggaugaggaaagagacauucccgagcgguccuggaacucuggauacgaguggaucacagauuucccuggcaaaaccgugugguuugugcccagcaucaaguccgggaaugacauugcuaacugucuucgcaaaaauggaaagagagucauccagcugucucggaagacguucgauacagaauaucagaagaccaagaacaacgacugggacuacgugguuacaaccgauauuagcgagaugggcgccaauuucagagccgaccgcgugaucgauccucggagaugccugaaacccgucauucucaaggacgggccggaacgcgugauccuggcuggcccuaugcccguuacgguggccuccgcggcucagcggagaggacgcauuggccggaaccauaauaaagagggggaucaguacaucuauaugggacagccccuuaacaaugacgaggaucacgcccacuggaccgaagccaagaugcugcucgacaacaucaauacaccugagggcauuauccccgcucuguuugaaccugagagagaaaagagcgccgcgauugauggggaguaccgccugagaggagaggcccggaaaaccuucgucgaacucaugcgcagaggcgaccuuccgguguggcugucuuauaaggucgcuuccgagggguuucaauacagcgaucggcgcuggugcuucgacggcgaaagaaacaaucaggugcuggaggaaaacauggauguugagaucuggacaaaagagggagaacggaagaaacucagaccccgcuggcuggacgcccggaccuauuccgacccucuugcucugagagaguuuaaggaguucgccgcuggccgccggucugugagcggggaucucauucuggagaucggaaaacugccccagcaucucacacagagagcccaaaaugcgcuugacaaccuggugaugcugcacaauuccgaacagggcgggcgggccuaccgccaugcuauggaggagcucccugauaccaucgaaacgcugaugcuucuggcccucauugcuguccugacaggaggcguuacccuguuuuuccucucuggcagagggcuuggaaagaccagcaucggccugcugugugugauggccuccagcgugcuccuguggauggccucugucgagccccacuggauugcugcguccaucauucuugaauuuuuccugauggugcuccugaucccggagccugaccggcagcgcacaccccaggauaaccaacuggccuauguugugaucgggcuccuuuuuaugauucugaccgucgcugccaaugagaugggacugcucgaaacaacgaagaaagaccugggcaucgggcacguggccgucgagaaccaucaccaugcugccaugcuugauguggaccugcacccugcgagcgccuggacccucuacgcuguugccacaaccauuaucacacccaugaugagacauaccauugaaaacacgaccgcuaauaucucucugacagccauugcgaaccaggccgcuauccugaugggacucgauaagggcuggccuaucuccaaaauggacauuggcgugccccuucuggcccuggggugcuacagccaggucaauccgcucacccugacagcugccgugcuuaugcugguugcucacuaugccaucauuggaccuggccuccaagcgaaggccacccgggaggcucagaaacgcacggccgcugggaucaugaagaaccccacaguggauggaauugucgccaucgaccuggaucccgugguguacgacgccaaguucgaaaaacagcugggccagaucaugcuccuuauucuguguaccucucaaauccugcucaugagaacaaccugggcgcugugcgagagcauuacccuugcuacagggccucugacgacccucugggagggauccccgggcaaguuuuggaauacaaccaucgccguuucuauggcuaacauuuuccggggcagcuaucuggccggggccggacuggcuuucucccucaugaaaagccuuggcgggggacgcagaggcacaggggcccagggagaaacccugggcgagaaguggaaacggcagcugaaucagcucuccaagucugaauuuaacacguacaagagaagcggcaucauggaggucgaccgcuccgaagcgaaagaggggcugaagcggggagagacaaccaaacacgccgugucuagaggcaccgcuaaacuucgcugguucguggaacggaaucuggucaaacccgaggggaagguuaucgaucucggauguggcagagggggauggagcuauuacugcgccggccugaagaaagugacagaagugaagggcuauaccaaagggggaccuggccaugaggaacccauuccuauggcuacauacggguggaaccuggucaagcuccacuccggaaaagacguguuuuucauucccccugagaagugugauacgcuucugugcgacaucggcgagucuagcccgaaucccaccaucgaagaggggcgcacacugcggguucucaaaaugguggaaccuuggcugagaggaaaccaauuuuguauuaagauccuuaaucccuacaugccuuccgucguggagacccuggagcagaugcagcgcaagcauggcggcaugcucguucggaacccccugagcagaaauucuacacacgaaauguauuggguguccugcgggaccggaaacauugucagcgccgugaauaugacgucucgcaugcugcucaaccgguucaccauggcgcacagaaaaccgacauacgagcgcgauguggaccugggcgccgggaccagacaugucgcuguugaaccugagguggccaaccuugauaucaucggacagcggauugaaaauaucaagcacgagcauaaauccacauggcacuaugacgaggauaaccccuacaagaccugggcuuaucauggcagcuacgaagugaaacccucuggguccgccagcuccauggucaauggagugguuaagcugcucacaaagccuugggacgugauucccauggucacccaaaucgcuaugacggauacaaccccuuuuggccagcagcgcguguucaaagagaagguugacaccagaacaccgaaagccaagcggggcacggcgcaaauuauggaagugaccgccaaauggcuguggggguuucuuagcagaaacaagaagccccggaucuguacacgcgaggaguucaccagaaaaguccggucuaaugcugccaucggagcuguguuuguugacgagaaccaguggaauagcgccaaggaggccguggaagaugagcgcuucugggaccugguccacagagaacgggagcuccacaaacagggcaagugcgcgacaugcguguauaacaugauggggaaacgcgaaaagaagcugggagaguuuggcaaagcuaagggguccagagccauuugguacauguggcugggcgcccgguuccucgaguucgaagcucugggauuuaugaaugaggaucauugguucucucgcgaaaacagccuuuccggcgucgagggggagggacugcacaaacucggcuacauccugagagacauuucuaagaucccugggggaaauauguaugccgaugacaccgcuggcugggauacacggauuaccgaagacgaucuucagaacgaggcccgcaucacggacaucauggaacccgagcaugcgcugcucgccaaaagcauuuuuaagcugaccuaccaaaauaaagugguuagagugcagcggccugcuaagaacgggacagucauggaugugaucucccgcagagaccagcggggcucuggacaggugggcaccuaugggcugaauacauucaccaacauggaagcccaacucauuagacagauggagagcgagggaaucuuuucccccagcgaacuggagacgccgaaccuugcugaacgcguucuggauuggcucgagaaguacggcguggaacggcugaaaagaauggccauuucuggggacgacugugucgugaagccuaucgaugaccgcuucgcgacagcccuuaccgcucugaaugauaugggaaaaguucggaaggacaucccccagugggagccuuccaaaggcuggaacgauuggcagcaagugcccuuuugcagccaccacuuccaucagcucauuaugaaggacgggagagagaucgucgugccuugucgcaaucaggaugaacuggucggccgggccagagugucucagggagcuggcuggucccugcgcgagacagccugccucggaaagagcuaugcucaaauguggcagcugauguacuuucaccggagagaccuucgccuggccgcgaacgccauuuguuccgcuguucccguggauuggaucccgaccucucggacgaccuggagcauucaugcccaccaucaguggaugacaaccgaagacaugcucuccgucuggaauagaguguggaucgaggaaaacccuuggauggaggauaaaacacacauuagcucuuggggagacguucccuaucugggcaagcgggaggaccaauggugcgggucccuuaucggacugaccgccagagcuacaugggccaccaauauccagguggcgauuaaccagguccgccggcucaucggcaaugaaaacuaccuggauuacaugacgagcaugaaaagauucaagaaugagucugaccccgaaggggcucugugguga

SEQ ID NO: 18852 - RNA, 9879 nt, Artificial Sequence
  derived and/or modified CDS sequence (opt5) from DENV-1__FJ024429__SS-prME
agcgugaccaugcugcucaugcugaugcccaccgcccuugcuuuccaccugacgacccggggcggggagccucauaugaucguguccaagcaggaacgggggaaaucucuccuguuuaagaccagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcguuggcaaacucguccaucagauuuucgggacggccuacggagugcuguuuuccggcgugagcuggaccaugaagaucgggauuggcguccuuaugacauggcugggacucaauucuagauccaccagccugucuaugacauguaucgcugugggccugguuacccuuuaccucggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcugucugccgcgauuggcaaggccugggaggagggggucugcggcaucagaagcgcuacacgccucgaaaacaucauguggaaacagauuuccaacgagcugaaucauauccuucuggaaaacgacaugaaguucaccgugguugugggagaugucgccggcauucucgcucaggggaaaaagaugauccggccgcaacccauggagcacaaauacucuuggaaaagcuggggaaaggccaagauuaucggcgccgacgugcagaauaccacauuuaucauugaugggccuaacacccccgaauguccugacgaucagagagcuuggaauaucugggagguggaggacuauggauucggcauuuuuacgacaaacaucuggcugaagcugcgcgauuccuacacccaggucugcgaccaccggcuuaugagcgcggccauuaaagauucuaaggcuguucaugccgacaugggcuauuggaucgaauccgagaaaaaugaaacauggaagcucgccagagcuagcuucaucgaggugaagaccuguauuuggcccaaaucucacacacugugguccaacggggugcuggaaagcgagaugaucauuccgaagaucuacggaggcccuauuucucaacauaauuaucgccccggguacuucacccagaucgccggaccuuggcaccucggcaaacuggagcuugauuuugaccugugcgaagggacgaccgucgugguugaugagcacugcggaaaccggggccccagccucagaacaaccacagugaccggcaagaucauucaugaaugguguugccgguccuguacgcugccuccccugcgcuucagaggggaggacggaugcugguacggcauggagauccggccggucaaagaaaaggaggaaaaucuugucaagagcaugguuucugcgggguccggagagguggacagcuuuucccucggccugcuguguauuucuaucaugauugaagaggucaugagaagccgcuggucccggaaaaugcucaugacagggacccuggcuguguucuuucuucugaucguuggacagcucacauggaacgaucugauuagacugugcaucauggugggcgccaaugccucugaccgcaugggcauggggaccaccuaucuugcucugauggccacauucaagaugagaccuauguuugcggucggacuccuguuccggcgccucacgagcagagaggugcugcuucugaccaucggccucucccugguggcuucugucgaacugcccaacagccuugaggaacugggggauggacucgccaugggcauuaugauccugaaacuccugacagacuuucaaucccaccagcuuugggccacccugcucagccugacauucauuaagaccacguuuucucugcauuacgcuuggaaaacaauggccaugguucuuuccguggugagccuguucccccucugucugucuaccaccucccagaagacaaccuggcucccuguccugcuugggagccugggaugcaagccgcugacaauguuucucaucgcugagaauaaaauuuggggccggcgcucuuggccccugaacgaaggcaucauggccguggggaucguuuccauucuucugagcucccuccugaagaacgaugugccucucgcgggaccccugaucgccggcgggaugcuuauugcuuguuaugucaucagcggaucuagcgccgaccugucccuggagaaagcugccgaggugucuugggaagaggaagccgagcacagcggcgcuucccauaauauucucguugaagugcaggaugacgggacgaugaagaucaaagaugaggagagagacgauacccugacaauccuucugaaggcgacccuccuggccgucucuggaguguacccucucagcauucccgcuacacuguucgucugguauuucuggcagaagaagaagcagcgguccggcgugcuuugggacaccccuucucccccggaaguugagcgcgccgugcuggaugacggcaucuacagaauuaugcagcgggggcugcucggacgcagccaggucggcguggggguuuuucaagaaaacguguuccacacgauguggcacgucaccagaggagccgugcugauguaucagggcaaacggcuugagccuuccugggcuagcgugaagaaagaccugaucucuuacgggggaggcuggagacuccagggcuccuggaauacaggggaggaaguucaggucauugccguggagcccggaaagaacccuaaaaaugugcaaaccgcgcccggcacauuuaagaccccggaaggggaggucggagcuaucgcccuggauuucaagccuggcacaagcgggucucccauugugaaccgcgaacggaaaaucguuggacucuacggcaauggcguggucacgaccuccgggacauaugugagcgccaucgcucaggccaaggcgucccaggagggaccucugcccgagauugaagacgagguuuuuagaaaacgcaaccuuaccaucauggaucugcaucccggcucugggaagacccggagauaccugccugcuauugugcgcgaagccaucaaacggaagcucagaacacugauucuugccccgacgcgcgucguggcuagcgagauggccgaagcucugaagggaaugcccauccgguaucaaaccacagccguuaaauccgagcacaccggcaaggagaucguggaccucaugugccaugcgacauucaccaugagacugcugagcccuguccgggugcccaauuacaacaugauuaucauggaugaagcccacuuuacggacccuucuuccauugcugcccgcggguauaucagcacaagagugggcaugggagaggcugccgccauuuucaugaccgcuacacccccuggcucugucgaagcguuuccgcagagcaaugccguuauccaggaugaggaacgggacauccccgagcgcuccuggaacucuggguacgaguggauuacagauuucccuggaaaaaccgugugguuugugcccagcaucaaguccggcaaugacauugcuaacugucuccgcaaaaaugggaagcgggucauccagcuuucuagaaagacauucgauaccgaauaucagaaaacgaagaacaacgacugggacuacgugguuacaaccgauauuagcgagaugggagccaauuuccgcgccgaccgggugaucgauccuagacgcugccugaaacccgucauucugaaggacggcccggaacgggugauccucgcugggccuaugcccguuacaguggccuccgcggcucagagacgcggccggaucggaagaaaccauaauaaagagggcgaucaguacauuuauauggggcagccccugaacaaugacgaggaucacgcccacuggaccgaagccaagaugcuucuggacaacaucaauacgccugagggaauuauccccgcucucuuugaaccugagcgcgaaaagagcgccgcgauugauggcgaguacagacugagaggggaagcccgcaaaaccuucgucgaacugaugagacggggagaccucccgguguggcuuucuuauaaggucgcuuccgagggcuuucaauacagcgaucgcagauggugcuucgacggggaacggaacaaucaggugcuggaggaaaacauggauguugagaucuggacaaaagagggcgaaagaaagaaacugcgcccccgguggcucgacgccagaaccuauuccgacccucuggcucuuagagaguuuaaggaguucgccgcuggacggagaucugugagcggcgaucugauccucgagauugggaaacugccccagcaucugacacagcgggcccaaaaugcgcucgacaaccuugugaugcugcacaauuccgaacagggaggccgcgccuacagacaugcuauggaggagcugccugauaccaucgaaacacucaugcugcuugcccugauugcuguccucaccgggggaguuacgcuguuuuuccugucuggccggggccucgggaagacaagcaucggacuucugugugugauggccuccagcgugcugcucuggauggccucugucgagccccacuggauugcugcguccaucauccuggaauuuuuccuuauggugcugcucauuccggagccugaccgccagagaacaccccaggauaaccaacuggccuauguugugaucggccugcucuuuaugauucuuaccgucgcugccaaugagauggggcugcuggaaacaaccaagaaagaccucggaaucggccacguggccgucgagaaccaucaccaugcugccaugcuggauguggaccuucacccugcgagcgccuggacacuguacgcuguugccacgaccauuaucacacccaugaugcggcauaccauugaaaacacaaccgcuaauaucucucucacggccaucgcgaaccaggccgcuauucugauggggcuggauaagggauggccuaucuccaaaauggacauuggcgugccccuccuugcccugggcugcuacagccaggucaauccgcugacccucacagcugccgugcugaugcuuguugcucacuaugccaucauugggccuggacugcaagcgaaggccacccgcgaggcucagaaaagaacagccgcuggcaucaugaagaaccccaccguggaugggaucgucgccauugaccucgaucccgugguguacgacgccaaguucgaaaaacagcugggacagaucaugcugcucauucuuuguacgucucaaauccugcugaugcggacaaccugggcgcucugcgagagcauuacacuggcuaccggcccucuuaccacacugugggagggguccccgggaaaguuuuggaauacgaccaucgccguuucuauggcuaacaucuuccgcggcagcuaucucgccggcgccgggcuggcuuucucccugaugaaaagccucggaggcgggagacggggaacaggcgcccagggggaaacccuuggagagaaguggaaaagacagcugaaucagcuguccaagucugaauuuaacacauacaagcgcagcggcauuauggaggucgaccgguccgaagcgaaagagggccucaagagaggggagaccacgaaacacgccgugucucgcggaacagcuaagcugcggugguucguggaaagaaaucuugucaaacccgagggcaagguuaucgaucugggguguggacgcggcggguggagcuauuacugcgccggacucaagaaagugaccgaagugaagggcuauaccaaaggcgggccuggacaugaggaacccauuccuauggcuacauacggcuggaaccuggucaagcugcacuccgggaaagacguguuuuucauucccccugagaagugugauacccuccuuugcgacauuggagagucuagcccgaaucccacaaucgaagagggccggacgcugagaguucugaaaaugguggaaccuuggcuccgcgggaaccaauuuuguauuaagauccugaaucccuacaugccuuccgucguggagacccuugagcagaugcagcggaagcauggaggcaugcugguuagaaacccccucagccgcaauucuacacacgaaauguauuggguguccugcggcaccgggaacaucgucagcgccgugaauaugacaucucggaugcugcugaacagauucaccauggcgcaccgcaaaccgacguacgagagagauguggaccucggagccggcacccggcaugucgcuguugaaccugagguggccaaccuggauauuaucgggcagcgcauugaaaauaucaagcacgagcauaaauccacauggcacuaugacgaggauaaccccuacaagaccugggcuuaucauggaagcuacgaagugaaacccucuggcuccgccagcuccauggucaauggggugguuaaacuucugacaaagccuugggacgugauucccauggucacccaaaucgcuaugacagauaccacgccuuuuggacagcagagaguguucaaagagaagguugacacacggaccccgaaagccaagagaggcaccgcgcaaaucauggaagugacagccaaauggcucuggggcuuucugagccggaacaagaagccccgcauuuguacgagagaggaguucacccggaaaguccgcucuaaugcugccaucggggcuguguuuguugacgagaaccaguggaauagcgccaaggaggccguggaagaugagagauucugggaccuuguccaccgggaacgcgagcugcacaaacagggaaagugcgcgacaugcguguauaacaugaugggcaaaagagaaaagaagcucggggaguuuggaaaagcuaagggcucccgggccauuugguacauguggcugggggcccgcuuccuggaguucgaagcucucggcuuuaugaaugaggaucauugguucucuagagaaaacagccuguccggagucgagggcgaggggcuucacaaacugggauacauccuccgggacauuucuaagaucccuggcgggaauauguaugccgaugacaccgcuggaugggauacacgcaucaccgaagacgaucugcagaacgaggccagaauuacagacaucauggaacccgagcaugcgcuucuggccaaaagcauuuuuaagcucaccuaccaaaauaaagugguucgggugcagcgcccugcuaagaacggcacggucauggaugugaucuccagacgggaccagagagggucuggccaggugggaaccuauggccugaauacauucaccaacauggaagcccaacugauucgccagauggagagcgaggggaucuuuucccccagcgaacucgagacaccgaaccuggcugaacggguucuugauuggcuggagaaguacggaguggaaagacucaaacgcauggccaucucuggcgacgacugugucgugaagccuauugaugaccgguucgcgaccgcccugacggcucuuaaugauauggggaaaguuagaaaggacaucccccagugggagccuuccaaaggauggaacgauuggcagcaagugcccuuuugcagccaccacuuccaucagcugauuaugaaggacggccgcgagaucgucgugccuugucggaaucaggaugaacucgucgggagagcccgcgugucucagggcgcuggauggucccugcgggagacagccugccugggcaagagcuaugcucaaauguggcagcucauguacuuucacagacgcgaccugcggcuugccgcgaacgccauuuguuccgcuguucccguggauuggaucccgaccucuagaacaaccuggagcauucaugcccaccaucaguggaugacgaccgaagacaugcuguccgucuggaaucggguguggaucgaggaaaacccuuggauggaggauaaaacacacaucagcucuuggggagacguucccuaucucggaaagagagaggaccaauggugcggcucccugauugggcuuaccgcccgcgcuacaugggccaccaauauccagguggcgauuaaccagguccggagacugaucggaaaugaaaacuaccucgauuacaugacaagcaugaaacgcuucaagaaugagucugaccccgaaggcgcucugugguga

SEQ ID NO: 18853 - RNA, 9879 nt, Artificial Sequence
  derived and/or modified CDS sequence (opt5) from DENV-1__FJ024430__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccagacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccagacggccggaccuuggcaucucggcaaacuggagcuugauuuugaccugugcgaagggaccacagugguuguggaugagcacugcggaaaccggggccccagccucagaaccacaaccgucacgggcaagaucauccacgaaugguguugccgguccuguacacugccuccccugcgcuucagaggggaggacggaugcugguauggcauggagauucggccggugaaagaaaaggaggaaaaucuuguuaagagcauggugucugcgggguccggagaggucgacagcuuuucccucggccugcuguguaucucuauuaugaucgaagaggugaugagaagccgcuggucccggaaaaugcucaugaccgggacacuggcuguuuucuuucuucugauuaugggacagcucaccuggaacgaucugaucagacugugcauuauggugggcgccaaugccucugaccgcaugggcauggggaccacauaccuugcucugauggccacguucaagaugagaccuauguuugcggucggacuccuguuccggcgccucaccagcagagaggugcugcuucugacaaucggccucucccugguggcuucugucgaacugcccaacagccuugaggaacugggggauggacucgccaugggcaucaugauucugaaacuccugaccgacuuucaaucccaucagcuuugggccacacugcucagccugaccuucaucaagacgacauuuucucugcacuaugcuuggaaaaccauggccaugguucuuuccauugugagccuguucccccucugucugucuaccacaucccagaagaccacauggcucccugugcugcuugggagccugggaugcaagccgcugacgaugcuccugaucgcugagaauaaaauuuggggccggcgcucuuggccccuuaacgaaggcaucauggccgucgggaucguguccauucugcucagcucccugcucaagaacgauguuccucuggcgggaccccuuaucgccggcgggaugcugauugcuuguuacgugaucagcggaucuagcgccgcucugucccucgagaaagccgccgaggucucuugggaagaggaagcugagcauagcggcgcgucccacaauauucugguggaaguucaggacgaugggaccaugaagaucaaagacgaggagagagaugacacacuuaccauccugcucaaggccacacugcucgcugugucuggagucuauccucugagcauucccgccacccuuuuugugugguacuucuggcagaagaagaagcagcgguccggcguccugugggauacgccuucucccccggaagugggccgcgccguucuggacgaugggaucuauagaauuaugcagcggggacuccugggccgcagccaggugggggucggaguguuccaagagaacguuuuucauaccauguggcacgugacaagaggcgcuguccuuauguaccaggggaaacggcuggaaccuuccugggccagcgugaagaaagaccucaucucuuacggaggcggcuggagacugcagggguccuggaauaccggagaggaggugcagguuauugcggucgaacccggcaagaacccuaaaaaugugcaaacagcucccgggaccuucaagacaccggagggagaagugggcgccaucgcccucgacuuuaagccugggacgagcggaucucccauugucaaccgcgagggcaaaaucgugggccuguaugggaauggaguugugaccacauccggcaccuacgucagcgcuaucgcccaggcgaaggcuucccaggaagggccucuucccgagauugaggaugaaguguuccggaaaagaaaccugaccaucauggaccugcaccccggaucuggcaagacacgccgguaucucccugccauuguuagagaggccaucaaacgcaagcugcggacgcuuauucuggcuccgaccagaguggucgccagcgaaauggcugaggcccucaaggggaugcccauccgcuaccaaacaaccgcggugaaauccgaacauacaggcaaggagaucguugaucugaugugccacgccaccuuuacgaugcggcugcucagcccugugagaguccccaauuauaacaugauuaucauggacgaggcucauuucacagauccuucuuccauugccgcucggggauacaucagcacccgcgugggcaugggggaagccgccgcuauuuuuaugaccgcgacacccccuggaucuguggaggccuucccgcagagcaaugcugucauccaggacgaagagagagauauccccgaacgguccuggaacucuggcuaugaguggauuaccgacuuuccugggaaaacaguuugguucgugcccagcaucaaguccggaaaugauauugccaacugucuucgcaaaaauggcaagagagugauccagcugucucggaagaccuuugacacggaguaccagaaaaccaagaacaacgauugggacuacgucgugaccacagacauuagcgaaaugggggccaauuucagagcugaucgcguuaucgacccucggagaugccugaaacccgugauucucaaggauggcccggagcgcgucauccuggccggaccuaugcccgugaccguugcguccgcugcccagcggagaggccgcaucgggcggaaccacaauaaagaaggagaccaguauauuuacaugggccagccccuuaacaaugaugaggaccaugcccacuggacggaggcuaagaugcugcucgauaacaucaauaccccugaagggauuauccccgcccuguucgagccugaaagagaaaagagcgcggccauugacggagaauaucgccugagaggcgaggcucggaaaacauuuguggagcucaugcgcagaggggaucuuccggucuggcugucuuacaagguggccuccgaaggcuuccaauauagcgaccggcgcuggugcuuugauggagagagaaacaaucagguccuggaagagaacauggacguggaaaucuggaccaaagagggcgagcggaagaaacucagaccccgcuggcuggaugcucggacauacuccgacccucuugcccugagagaguucaaggaguuugcugccgggcgccggucuguuagcggagaccucauccuggaaauuggcaaacugccccagcaccucacccagagagcgcaaaaugcccuugauaaccuggugaugcugcauaauuccgagcaagggggacgggcuuaucgccacgccauggaggaacucccugacacaaucgagacccugaugcuucuggcucucauugccgugcugacgggcggcgucacacuguucuuucucucugggagaggacuuggcaagaccagcaucgggcugcuguguguuauggccuccagcgugcuccuguggauggcuucuguggaaccccauuggauugcggccuccaucauccuugaguucuuucugaugguccuccugauuccggaaccugaucggcagcgcacaccccaggacaaccaacuggcuuacgugguuaucggacuccuuuucaugauucugacaguggccgccaaugagaugggccugcucgagaccacaaagaaagaucuggggaucggacacgucgcuguggaaaaccaccaucacgccgcgaugcuugacgucgaucugcauccugccagcgcuuggacgcucuacgccguggcuaccacaauuaucacccccaugaugagacacacaauugagaacaccacggccaauaucucucugaccgcgaucgccaaccaggcugccauucugaugggccucgacaagggcuggccuaucuccaaaauggauauugggguuccccuucuggcucugggaugcuauagccaggugaauccgcucacacugaccgccgcuguccuuaugcugguggcccauuacgcgaucauuggcccugggcuccaagccaaggcuacacgggaagcccagaaacgcaccgcugccggaaucaugaagaaccccacgguugacggcaucguggccauugaucuggaccccgucguguaugaugcgaaguuugagaaacagcuggggcagaucaugcuccuuauucuguguacaucucaaauccugcucaugagaaccacaugggcucugugcgaaagcauuacccuugccaccggaccucugacaacgcucugggagggcuccccgggcaaguucuggaauaccacaaucgcugugucuauggccaacaucuuucgggggagcuaccuggccggagcuggccuggccuucucccucaugaaaagccuugggggaggccgcagagggaccggagcgcagggcgagacacugggcgaaaaguggaaacggcagcugaaucagcucuccaagucugaguucaacaccuauaagagaagcgggauuauggaaguugaccgcuccgaggccaaagaaggacugaagcggggcgagacgacaaaacacgcugucucuagagggaccgccaaacuucgcugguuuguggagcggaaucuggugaaacccgaaggaaaggucaucgaccucggcugugggagaggaggcuggagcuacuauugcgcuggccugaagaaaguuaccgaggugaagggguacacaaaaggaggcccugggcacgaggaacccauuccuauggccaccuacggauggaaccuggugaagcuccauuccggcaaagaugucuucuuuauucccccugaaaagugugacacacuucugugcgauauuggggagucuagcccgaaucccacgaucgaggaaggacgcacccugcgggugcucaaaaugguugagccuuggcugagaggcaaccaauucuguauuaagauccuuaaucccuauaugccuuccguggucgaaacacuggagcagaugcagcgcaagcacggcgggaugcucgugcggaacccccugagcagaaauucuacccaugagauguacuggguuuccugcggaacaggcaacaucgugagcgcggucaauaugaccucucgcaugcugcucaaccgguuuacgauggcccacagaaaaccgaccuaugaacgcgacguggaucugggggcuggaacaagacacguggccgucgagccugaaguugcuaaccuugacauuaucggccagcggauugagaauaucaagcaugaacacaaauccaccuggcauuacgaugaggacaaccccuauaagacaugggccuaccacgggagcuaugaggugaaacccucuggauccgcuagcuccauggugaauggcgucgugaagcugcucaccaagccuugggauguuauucccauggugacacaaaucgccaugaccgacacgacaccuuucggccagcagcgcgucuuuaaagaaaagguggauaccagaaccccgaaagcgaagcgggggacagcccaaaucauggagguuacggcuaaauggcuguggggauuccuuagcagaaacaagaagccccggauuuguacccgcgaagaguuuacaagaaaagugcggucuaaugccgcuaucggcgccgucuucguggacgaaaaccaguggaauagcgccaaggaggcgguugaggacgaacgcuuuugggaucuggugcauagagagcgggaacuccacaaacaggggaagugcgcuaccugcgucuacaacaugaugggaaaacgcgagaagaagcugggcgaguucgggaaagccaagggcuccagagccauuugguacauguggcugggagcucgguuucucgaguucgaggcccugggcuucaugaaugaagaccacugguuuucucgcgagaacagccuuuccgggguggaaggagagggccugcauaaacucggguauauccugagagauauuucuaauaucccuggaggcaacauguacgcugacgauacagccgggugggacacccggaucacagaggaugaccuucagaaugaagcgcgcauuaccgauaucauggagcccgaacacgcccugcucgcuaagagcauuuucaaacugacguaucaaaacaaggucgugagaguucagcggccuaccaaaaauggcacagugauggacgucaucucccgcagagaucagcggggaucuggccagguggggaccuacggacugaacacauuuaccaacauggaggcccaacucauuagacagauggaaagcgagggcaucuucucccccagcgagcuggaaacgccgaaucuugcugagcgcgugcuggacuggcucgaaaaguaugggguugagcggcugaagagaauggccaucucuggagaugacuguguggucaaaccuguggacgaucgcuuugcgacagcccuuaccgcucugaacgacaugggcaagguucggaaagauauuccccagugggaaccuuccaagggguggaaugacuggcagcaagugcccuucugcagccaucacuuucaccagcucaucaugaaagauggcagagagauugucgugccuugucgcaaccaggacgagcuggucggacgggccagagugucucagggcgcuggguggucccugcgcgaaacagccugccucggaaagagcuacgcucaaauguggcagcugauguauuuccaucggagagaucuucgccuggccgcgaaugccaucuguuccgcuguucccguggacuggauuccgaccucucggacgaccuggagcauccacgcccaucaccaguggaugacaaccgaggauaugcucuccgucuggaacagaguguggauugaagagaauccuuggauggaagacaagacacauaucagcucuuggggcgauguucccuaccuggggaaacgggaggaccaauggugcggaucccuuaucggccugaccgccagagcuacaugggccaccaacauucagguggcgaucaaucagguccgccggcucauugggaacgagaauuaccuggacuauaugacgagcaugaagagauuuaaaaacgaaucugaucccgagggcgcucugugguga

SEQ ID NO: 18854 - RNA, 9879 nt, Artificial Sequence
  derived and/or modified CDS sequence (opt5) from DENV-1__FJ024433__SS-prME
agcgugaccaugcugcucaugcugaugcccaccgcccuugcuuuccaccugacgaccagaggaggggaaccucauaugaucgucuccaagcaggaacggggaaaaucucuccuguuuaagaccagcgccggcguuaacaugugcacccuuauugcgauggaccugggggagcucugugaagauaccaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccauuucucaagagacauggaaucgccaggaccugcucgugaccuucaaaaccgcucacgcgaagaagcaggaagucgugguucugggaagccaagagggcgccaugcacacagcucugacgggggccaccgaaauccagacauccggaaccacaaccauuuuugccggccaucucaaaugcagacugaagauggauaaacuuacgcugcgggggaugagcuaugugauguguacaggcucuuucaagcucgagaaagaagucgcugagacccagcacggaaccgugcugguucagaucaaguacgagggcacagacgccccgugcaagaucccuuucuccacccaagaugaaaaaggggugacacagaacggaagacugauuacggcgaaucccaucgucaccgacaaggagaaaccugugaacauugaagcugagccgcccuuuggcgagagcuauaucgugauuggggccggagaaaaggcccuuaaacucucuugguucaagaagggcagcuccaucgggaaaauguuugaggcuacagcccgcggcgcucggagaauggccauccugggagauaccgcgugggacuucggcucuauugggggaguuuuuacaagcgucggcaagcuggugcaucagaucuucgggaccgccuacggagugcucuuuuccggcgucagcuggacgaugaaaauugggaucggcgugcugcuuaccuggcugggacucaauucucgcuccacaagccugucuaugaccuguauugcuguuggccuggugacacuuuaccucggggucauggugcaggccgauuccggaugcguuaucaacuggaagggccgggaacugaaaugugggagcggaauuuucgugaccaaugagguccacacauggaccgaacaauauaaguuucaggcugacuccccuaagagacugucugccgcgaucggcaaagccugggaggagggggugugcggcauccgcagcgcuacgcggcucgaaaacauuauguggaagcagaucuccaacgagcugaaucauauucuucuggaaaacgacaugaaauucacaguuguggucggagauguggccggcauccucgcucaggggaagaaaaugauuagaccgcaacccauggagcacaaguacucuuggaaaagcuggggaaaggccaagaucaucggcgccgacgugcagaauaccaccuuuauuaucgaugggccuaacacacccgaauguccugacgaucagcgcgcuuggaauauuugggaggucgaggacuauggauucggcaucuuuaccacgaacauuuggcugaaacugcgggauuccuacacacagguuugcgaccacagacuuaugagcgcggccaucaaggauucuaaagcugugcaugccgacaugggcuauuggaucgaauccgagaagaaugaaaccuggaaacucgcccgcgcuagcuucauugaggugaagacauguaucuggcccaagucucacacccugugguccaacgggguccuggaaagcgagaugauuaucccgaaaauuuacggaggcccuaucucucaacauaauuaucggcccggguacuucacacagaccgccggaccuuggcaccucggcaagcuggagcuugauuuugaccugugcgaagggacgaccgugguuguggaugagcacugcggaaacagaggccccagccuccggacaaccacagucaccggcaaaaucauucaugaaugguguugccgcuccuguacgcugccuccccugagauucagaggggaagacggaugcugguacggcauggagauccggccggugaaggaaaaagaggaaaaucuuguuaagagcauggugucugcgggguccggagaggucgacagcuuuucccucggccugcuguguauuucuaucaugauugaagaggugaugcgcagccggugguccagaaagaugcucaugacagggacccuggcuguuuucuuucuucugaucaugggacagcucacauggaacgaucugauucgccugugcaucauggugggcgccaaugccucugacagaaugggcauggggaccaccuaucuugcucugauggccacauucaaaaugcggccuauguuugcggucggacuccuguuccgcagacucacgagccgggaggugcugcuucugaccaucggccucucccugguggcuucugucgaacugcccaacagccuugaggaacugggggauggacucgccaugggcauuaugauccugaagcuccugacagacuuucaaucccaccagcuuugggccacccugcucagccugacauucauuaaaaccacguuuucucugcauuacgcuuggaagacaauggccaugguucuuuccaucgugagccuguucccccucugucugucuaccaccucccagaaaacaaccuggcucccugugcugcuugggagccugggaugcaagccgcugacaauguuucucauugcugagaauaagaucuggggccgcagaucuuggccccugaacgaaggcaucauggccgucgggauuguguccauccuucugagcucccuccugaaaaacgauguuccucucgcgggaccccugauugccggcgggaugcuuaucgcuuguuaugugauuagcggaucuagcgccgaccugucccuggagaaggcugccgaggucucuugggaagaggaagccgagcacagcggcgcuucccauaauauccucguggaaguucaggaugacgggacgaugaaaaucaaggaugaggagcgggacgauacccugacaauucuucugaaagcgacccuccuggccgugucuggagucuacccucucagcauccccgcuacacuguucgugugguauuucuggcaaaagaaaaagcagcgcuccggcguccuuugggacaccccuucucccccggaaguggagagagccguucuggaugacggcauuuaccggaucaugcagcgcgggcugcucggaagaagccaggugggcgucgggguguuucaagaaaacguuuuccacacgauguggcacgugacccggggagccguccugauguaucagggcaagagacuugagccuuccugggcuagcgugaaaaaggaccugauuucuuacgggggaggcuggcgccuccagggcuccuggaauacaggggaggaagugcagguuaucgccgucgagcccggcaagaacccuaagaaugugcaaaccgcgcccggcacauuuaaaaccccggaaggggaggugggagcuauugcccuggauuucaagccuggcacaagcgggucucccaucgucaaccgggaaggaaagaucgugggccucuacggcaaugggguugugacgaccuccggaacauaugucagcgccauugcucaggccaaagcgucccaggagggcccucugcccgagaucgaagacgagguguuuagaaagcgcaaccuuaccauuauggaucugcaucccgggucuggaaaaacccggagauaccugccugcuaucguucgcgaagccauuaagcggaaacucagaacacugauccuugccccgacgcgcguggucgcuagcgagauggccgaagcucugaagggcaugcccauccgguaucaaaccacagccgugaaguccgagcacaccgggaaagagauuguugaccucaugugccaugcgacauucaccaugagacugcugagcccugugcggguccccaauuacaacaugaucauuauggaugaagcccacuuuacggacccuucuuccaucgcugcccgcggcuauauuagcacaagagugggaaugggcgaggcugccgccaucuucaugaccgcuacacccccugggucuguggaagcguuuccgcagagcaaugccgucauccaggaugaggaacgggacauucccgagcgcuccuggaacucuggauacgaguggaucacagauuucccuggcaagaccguuugguuugugcccagcauuaaauccgggaaugacaucgcuaacugucucagaaagaauggaaaacgggugauucagcuuucuagaaagacauucgauaccgaauaucaaaagacgaaaaacaacgacugggacuacgucgugacaaccgauaucagcgagaugggcgccaauuuccgcgccgaccggguuauugauccuagacgcugccugaagcccgugauccugaaagacgggccggaacgggucauccucgcuggcccuaugcccgugacaguugccuccgcggcucagagacgcggacggauuggcagaaaccauaauaaggagggggaucaguacaucuauaugggacagccccugaacaaugacgaggaucacgcccacuggaccgaagccaaaaugcuucuggacaacauuaauacgccugagggcaucauucccgcucucuuugaaccugagcgcgaaaagagcgccgcgaucgauggggaguacagacugcggggagaggcccgcaagaccuucguggaacugaugagacggggcgaccucccggucuggcuuucuuauaaaguggcuuccgagggguuucaauacagcgaucgcagauggugcuucgacggcgaacggaacaaucagguccuggaggaaaacauggauguggagaucuggacaaaggagggagaacgcaagaagcugcgcccccgguggcucgacgccagaaccuauuccgacccucuggcucuuagagaguuuaaagaguucgccgcuggccggagaucuguuagcggggaucugauucucgagaucggaaagcugccccagcaucugacacagcgggcccaaaaugcgcucgacaaccuugugaugcugcacaauuccgaacagggcgggcgcgccuacagacaugcuauggaggagcugccugauaccauugaaacacucaugcugcuugcccugaucgcugugcucaccggaggcgucacgcuguuuuuccugucuggccgggggcucggaaaaacaagcauuggccuucuguguguuauggccuccagcgugcugcucuggauggccucuguggagccccacuggaucgcugcguccaucauucuggaauuuuuccuuaugguccugcucaucccggagccugaccgccagagaacaccccaggauaaccaacuggccuaugugguuauugggcugcucuuuaugauccuuaccguggcugccaaugagaugggacugcuggaaacaaccaagaaggaccucggcauugggcacgucgccguggagaaccaucaccaugcugccaugcuggaugucgaccuucacccugcgagcgccuggacacuguacgcuguggccacgaccaucauuacacccaugaugcggcauaccaucgaaaacacaaccgcuaauaucucucucacggccauugcgaaccaggccgcuauccugaugggacuggauaaaggcuggccuauuuccaagauggacaucggcguuccccuccuugcccuggggugcuacagccaggugaauccgcugacccucacagcugccguccugaugcuuguggcucacuaugccauuaucggaccuggccugcaagcgaaagccacccgcgaggcucagaagagaacagccgcugggaucaugaaaaaccccaccguugauggaauuguggccaucgaccucgaucccgucguguacgacgccaaguucgaaaagcagcugggccagauuaugcugcucauccuuuguacgucucaaauucugcugaugcggacaaccugggcgcucugcgagagcaucacacuggcuaccgggccucuuaccacacugugggagggauccccgggcaaauuuuggaauacgaccaucgccgugucuauggcuaacauuuuccgcggcagcuaucucgccggggccggacuggcuuucucccugaugaaaagccucggcgggggaagacggggcacaggggcccagggagaaacccuuggcgagaaauggaagagacagcugaaucagcuguccaaaucugaauuuaacacauacaagcgcagcggcaucauggagguugaccgguccgaagcgaaggaggggcucaaaagaggagagaccacgaagcacgccgucucucgcggcacagcuaaacugcggugguucguggaaagaaaucuugugaagcccgaggggaaagucauugaucugggauguggccgcgggggauggagcuauuacugcgccggccucaagaagguuaccgaagugaaaggcuauaccaaagggggaccuggccaugaggaacccaucccuauggcuacauacggguggaaccuggugaaacugcacuccggaaaggacgucuuuuucauucccccugagaaaugugauacccuccuuugcgacaucggcgagucuagcccgaaucccacaauugaagaggggcggacgcugagagugcugaagaugguugaaccuuggcuccgcggaaaccaauuuuguaucaaaauccugaaucccuacaugccuuccguggucgagacccuugagcagaugcagcggaagcauggcggcaugcuggugagaaacccccucagccgcaauucuacacacgaaauguauuggguuuccugcgggaccggaaacauugugagcgccgucaauaugacaucucggaugcugcugaacagauucaccauggcgcaccgcaagccgacguacgagagagauguggaccucggcgccgggacccggcauguggcugucgaaccugagguugccaaccuggauaucauuggacagcgcaucgaaaauauuaaacacgagcauaaguccacauggcacuaugacgaggauaaccccuacaaaaccugggcuuaucauggcagcuacgaagugaagcccucuggguccgccagcuccauggugaauggagucgugaaacuucugacaaagccuugggacguuauccccauggugacccaaaucgcuaugacagauaccacgccuuuuggccagcagagagucuucaaggagaaaguggacacacggaccccgaaggccaaaagaggcaccgcgcaaauuauggaaguuacagccaaguggcucuggggguuucugagccggaacaaaaagccccgcaucuguacgagagaggaguucacccggaaggugcgcucuaaugcugccauuggagcugucuuuguggacgagaaccaguggaauagcgccaaagaggccguugaagaugagagauucugggaccuugugcaccgggaacgcgagcugcacaagcagggcaaaugcgcgacaugcgucuauaacaugauggggaagagagagaaaaagcucggagaguuuggcaaggcuaaagggucccgggccaucugguacauguggcugggcgcccgcuuccuggaguucgaagcucucggauuuaugaaugaggaucauugguucucuagagaaaacagccuguccggcguggagggggagggacuucacaagcugggcuacauucuccgggacaucucuaaaaucccugggggaaauauguaugccgaugacaccgcuggcugggauacacgcauuaccgaagacgaucugcagaacgaggccagaaucacagacauuauggaacccgagcaugcgcuucuggccaagagcaucuuuaaacucaccuaccaaaauaaggucgugcggguucagcgcccugcuaaaaacgggacggugauggaugucauuuccagacgggaccagagaggcucuggacaggugggcaccuaugggcugaauacauucaccaacauggaagcccaacugauccgccagauggagagcgagggaaucuuuucccccagcgaacucgagacaccgaaccuggcugaacgggugcuugauuggcuggagaaguacggcguugaaagacucaagcgcauggccauuucuggggacgacuguguggucaaaccuaucgaugaccgguucgcgaccgcccugacggcucuuaaugauaugggaaaggugagaaaagacauuccccagugggagccuuccaagggcuggaacgauuggcagcaaguucccuuuugcagccaccacuuccaucagcugaucaugaaagacgggcgcgagauuguggucccuugucggaaucaggaugaacucgugggcagagcccgcgucucucagggagcuggcuggaaccugcgggagacagccugccuggggaaguccuaugcucaaauguggcagcucauguacuuucacagacgcgaccugcggcuugccgcgaaugccaucuguagcgcugugcccguugauuggauuccgaccuccagaacaaccuggucuauccaugcccaccaucaguggaugacgaccgaagacaugcugagcguguggaaccgggucuggaucgaggaaaauccuuggauggaggauaagacacacauuuccagcugggaggacgugcccuaucucggaaaaagagaagaccaauggugcggcucucugaucgggcuuaccgcccgcgcuacaugggccaccaacauucagguugcgaucaaucaggugcggagacugauuggaaacgagaauuaccucgauuacaugacauccaugaagcgcuucaaaaacgaaagcgaccccgagggcgcucugugguga

SEQ ID NO: 18855 - RNA, 9879 nt, Artificial Sequence
  derived and/or modified CDS sequence (opt5) from DENV-1__FJ024434__SS-prME
agcgugaccaugcugcucaugcugaugcccaccgcccuugcuuuccaccugacgaccagaggaggggaaccucauaugaucguguccaagcaggaacggggaaaaucucuccuguuuaagaccagcgccggcguuaacaugugcacccuuauugccauggaccugggggaacucugugaagauacaaugaccuacaaaugcccccgcaucacagaagcugaacccgacgauguggacuguuggugcaaugccaccgauacgugggugaccuauggaacauguucccagaccggcgagcacagacgggacaagcgcucuguggcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaagcucacaguuguggucggagauguggcuggcauucuggggcagggcaagaaaaugauccggccgcaacccauggaguacaaauauucuuggaaaagcuggggcaaggccaagauuaucggggccgacgcucagaauaccaccuucaucauugauggaccuaacacacccgaauguccugacgaucagagagcguggaauaucugggagguggaggacuacggcuuuggcauuuucaccacgaacaucuggcugaaacuucgcgauuccuauacacaggucugcgaccaccggcucaugagcgccgcuauuaaagauucuaaggccguucacgccgacaugggguacuggaucgaauccgagaaaaaugaaaccuggaagcuggcuagagccagcuuuaucgaggugaagacauguauuuggcccaaaucucauacccugugguccaacggagugcucgaaagcgagaugaucauuccgaagaucuauggcgggccuauuucucaacacaauuaccgccccggauacuucacacagaccgcgggcccuuggcaucuggggaaacuugagcuggauuucgaccucugcgaaggaacgaccgucgugguugaugagcacugcggcaaccggggccccagccugagaacaaccacagugaccgggaagaucauccacgaaugguguugccgguccuguacgcugccuccccuucgcuuuagaggagaggacggcugcugguaugggauggagauucggccggucaaagaaaaggaggaaaaucucgucaagagcaugguuucugcuggauccggcgagguggacagcuucucccuggggcugcucuguaucucuauuaugaucgaagaggucaugagaagccgcuggucccggaaaaugcugaugacaggaacccuugccguguuuuuccugcucauuaugggccagcugacauggaacgaucugaucagacuuugcauuaugguuggcgccaaugcuucugaccgcauggggaugggaaccaccuaccuggcccucauggcgacauuuaagaugagaccuauguucgcugugggccugcucuuucggcgccugacgagcagagagguccuucugcucaccaucgggcugucccugguggccucuguggaacuucccaacagccuggaggaacucggagauggccuggccauggggaucaugauucucaaacugcuuacagacuuccaaucccaucagcugugggcuacccuccugagccugacauuuaucaagaccacguucucucuucacuaugccuggaaaacaauggcuaugguccuguccauuguuagccucuuuccccugugucucucuaccaccucccagaagacaaccuggcugccugugcuucugggaagccugggcugcaagccgcucacaauguuccugaucgccgagaauaaaauuuggggccggaagucuuggccccuuaacgaagggaucauggcggugggaaucgucuccauucugcucagcucccugcucaaaaacgaugugccucuggccggcccccuuaucgcugggggaaugcugauugccuguuacguuaucagcggcucuagcgcugaccugucccucgagaaggccgccgaggugucuugggaagaggaagcugagcauagcggggcgucccacaauauucuggucgaagugcaggaugacggaacgaugaaaaucaaggaugaggagcgcgacgauacccuuacaauccugcucaaagccacccugcucgcuguuucuggcguguauccucugagcauucccgccacacuuuuugucugguacuucuggcaaaagaagaaacagagauccggcgugcugugggacaccccuucucccccggaagucgagcgggccgugcuggaugacgggaucuaucgcauuaugcagagaggacuccugggccggagccagguuggggugggagucuuccaagaaaacguguuucauacgauguggcacguuacccgcggcgcugugcuuauguaccaggggaagagacuggagccuuccugggccagcgucaaaaaggaccucaucucuuacggaggcggcuggcggcugagaggguccuggaauacaggagaggaaguccaggugauugcgguugagcccggcaaaaacccuaagaauguccagaccgcucccgggacauucaagaccccggaaggagaggugggcgccaucgcccucgauuuuaaaccugggacaagcggaucucccauugugaaccgcgaaggcaagaucgucggccuguaugggaauggagugguuacgaccuccggcacauacgugagcgcuaucgcccaagcgaaggcuucccaggaggggccucuucccgagauugaagacgaggucuuccggaagagaaaccugaccaucauggaucugcaccccggaucuggcaaaacccgccgguaucucccugccauugugagagaagccaucaagcgcaagcugcggacacuuauucuggcuccgacgagaguuguggccagcgagauggcugaagcccucaaagggaugcccauccgcuaccagaccacagcggucaaguccgagcauaccggcaaagagaucguggaccugaugugccacgccacauuuaccaugcggcugcucagcccuguuagagugcccaauuauaacaugauuaucauggaugaagcucauuucacggacccuucuuccauugccgcucggggauacaucagcacacgcgucggcaugggggaggccgccgcuauuuuuaugaccgcgacacccccuggaucuguggaagccuucccgcaaagcaaugcugugauccaggaugaggaaagagacauccccgagcgguccuggaacucuggcuaugaguggauuacagauuuuccugggaagaccgucugguucguucccagcaucaaauccggaaaugacauugccaacugucuucgcaagaauggcaagagagugauccagcugucucggaaaacauuugauaccgaauaccagaagacgaaaaacaacgacugggacuacguggucacaaccgauauuagcgagaugggggccaauuucagagcugaccgcgugaucgauccucggagaugccugaagcccguuauucucaaagacggcccggaacgcgugauccuggccggaccuaugcccgucacaguggcguccgcugcccaacggagaggccgcaucgggcggaaccacaauaaggagggagaucaguauauuuacaugggccagccccuuaacaaugacgaggaucaugcccacuggaccgaagcuaagaugcugcucgacaacaucaauacgccugaggggauuauccccgcccuguucgaaccugagagagaaaagagcgcggccguugauggagaguaucgccugagaggcgaggcucggaagaccuuuguggagcucaugcgcagaggggaccuuccggucuggcugucuuacaaaguggccuccgagggcuuccaguauagcgaucggcgcuggugcuuugacggagaaagaaacaaucaaguccuggaggaaaacauggauguggagauuuggacaaaggagggcgaacggaaaaagcucagaccccgcuggcuggacgcucggaccuacuccgacccucuugcccugagagaguauaaagaguucgcugccgggcgccggucuguuagcggagaucucauccuggagaucggcaagcugccccagcaccucacacagagagcgcagaaugcccuugacaaccuggugaugcugcauaauuccgaacaagggggacgggcuuaccgccacgccauggaggagcucccugauaccauugaaacacugaugcuucuggcucucaucgccgugcugaccggcggcgucacgcuguuuuuccucucugggagaggacuuggcaagacaagcauugggcugcuguguguuauggccuccagcgugcuccuguggauggcuucuguggagccccauuggaucgcggccuccauuauccuugaauuuuuccugaugguccuccugaucccggagccugaccggcagcgcacaccccaggauaaccagcuggcuuacgugguuauuggacuccuuuuuaugauccugaccguggccgccaaugagaugggccugcucgaaacaaccaaaaaggaccuggggauuggacacgucgcuguggagaaccaccaucacgccgcgaugcuugaugucgaccugcauccugccagcgcuuggacacucuaugccguggcuacgaccaucauuacacccaugaugagacacaccaucgaaaacacaaccgccaauauuucucugacggcgaucgccaaccaagcugccauccugaugggccucgauaaaggcuggccuauuuccaagauggacaucgggguuccccuucuggcucugggaugcuacagccaggugaauccgcucacccugacagccgcuguccuuaugcugguggcccauuaugcgauuaucggcccugggcuccaggccaaagcuacccgggaggcccaaaagcgcacagcugccggaauuaugaagaaccccaccguugauggcaucguggccaucgaccuggaucccgucguguacgacgcgaaauucgaaaagcagcuggggcagauuaugcuccuuauccuguguacgucucagauucugcucaugagaacaaccugggcucugugcgagagcaucacacuugccgcuggaccucugaccacccucugggagggcuccccgggcaaauuuuggaauacaacgauugccgugucuauggccaacaucuuccgggggagcuaucuggcuggagccggccuggcguuuucccucaugaaaagccuugggggaggccgcagagggaccggagcccaaggcgaaacacugggcgagaaauggaagcggcagcugaaucagcucuccaagucugaguucaacaccuacaaaagaagcgggaucauggagguugaccgcuccgaagcuaaggagggacugaaacggggcgagacaaccaagcacgccgucucuagagggacggcuaaacuucgcugguucguggaacggaaucuggugaagcccgagggaaaggucauugaucucggcugugggagaggaggcuggagcuauuacugcgccggccugaaaaagguuacagaagugaaaggguacaccaagggaggcccugggcacgaggaacccaucccuauggcgaccuauggauggaaccuggugaaacuccauuccggcaaggacgucuuuuucauucccccugagaaaugugauacacuucugugcgacaucggggagucuagcccgaaucccaccauugaagagggacgcacacugcgggugcucaagaugguugaaccuuggcugagaggcaaccaguuuuguaucaagauucuuaaucccuacaugccuuccguggucgaggcccuggagcaaaugcagcgcaaacacggcgggaugcucgugcggaacccccugagcagaaauucuacgcaugaaauguauuggguuuccugcggaaccggcaacaucgugagcgcugucaauaugacaucucgcaugcugcucaaccgguucaccauggcccacagaaagccgacauacgagcgcgauguggaccuggggaccggaacgagacacguggcugucgaaccugagguugccaaccuugauaucauuggccagcggaucgaaaauauuaaacaugagcacaaguccaccuggcauuaugacgaggauaaccccuacaaaacaugggcuuaucacgggagcuacgaagugaagcccucuggauccgccagcuccauggugaauggcgucgugaagcugcucaccaaaccuugggacguuauccccauggugacacagauugcgaugaccgauacaaccccuuuuggccaacagcgcgucuucaaggagaaaguggacacgagaacaccgaaggccaaacgggggaccgcucagaucauggaaguuaccgccagauggcuguggggauuucuuagccggaacaagaagccccgcaucuguacaagagaggaguucacgcggaaagugcgcucuaaugcugccauuggcgccgucuuuguggacgagaaccaauggaauagcgcgaaggaggcuguugaagaugagagauucugggaccuggugcaucgggaacgcgagcuccacaaacaggggaagugcgcgaccugcgucuacaacaugaugggaaaaagagaaaagaagcugggcgaguuugggaaagccaagggcucccgggcuaucugguauauguggcugggagcccgcuuccucgaguuugaagcucugggcuucaugaaugaggaucacugguucucuagagaaaacagccuuuccgggguggagggagagggccugcauaaacucggguacauucugcgggacaucucuaagauuccuggaggcaauauguaugccgaugacacagcggggugggauacccgcaucacagaagacgaucuucagaacgaggccaaaaucaccgacauuauggaacccgagcacgcucugcucgccaaggcuaucuuuaaacugacauaccagaauaaggucgugagaguucaacggccugccaagaacggcaccgugauggaugucauuagccgcagagaccagcggggauccggccagguggggacguauggacugaauaccuucacaaacauggaagcgcagcucaucagacaaauggagucugagggcauuuuuagccccuccgaacuggagaccccgaaccuugccgaacgcgcucuggauuggcucgagaaauacgggguggaacggcugaagagaauggccaucagcggagacgacuguguugugaaaccuaucgaugaccgcuucgcuacagcccuuaccgcucugaaugauaugggcaagguccggaaagacauuccccagugggagccuucuaagggguggaacgauuggcaacaggugcccuuuugcucccaucacuuccaccaacucaucaugaaggacggcagagagauuguugugccuugucgcaaucaggaugaacuggucggacgggccagagugagccagggcgcgggguggucucugcgcgagacggccugccucggaaaauccuaugcucagauguggcaacugauguacuuucaucggagagaccuucgccuggccgccaacgcuaucuguagcgccguccccguggauuggguuccgacaucccggaccacauggucuauucacgcgcaucaccaguggaugaccacggaagacaugcucagcguguggaauagagucuggaucgaggaaaacccuuggauggaggauaagacccauauuuccagcugggaggacgugcccuaccugggcaaacgggaagaccaguggugcgggucucuuaucggacugacagcuagagccaccugggccacaaauauccaaguugcuauuaaccaggugcgccggcucaucggcaaugagaacuaucuggauuacaugauuuccaugaagagauucaaaaaugaaagcgaccccgagggggcccugugguga

SEQ ID NO: 18856 - RNA, 9879 nt, Artificial Sequence
  derived and/or modified CDS sequence (opt5) from DENV-1__FJ024435__SS-prME
agcgugaccaugcugcucaugcugaugcccacagcccuugcuuuccaccugacgaccagaggcggggaaccucauaugaucguguccaagcaagaacgggggaaaucucuccuguuuaagaccagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaccgcucuuuuucuggcccaugcgaucgggaccucuauuacacagaagggaaucaucuucauucuccugaugcuugucacgccuagcauggccaugagaugcgugggcaucgggucccgggauuuuguugagggacugagcggcgcuaccuggguggacgucgugcucgagcacgggucuugugugacaaccauggccaaggauaaacccacacuggacauugaacugcucaagaccgaggucacgaacccugcuguucugcgcaaacuuugcaucgaagccaagauuuccaauacaaccaccgauagcagauguccgacacaaggagaggcgacccugguggaagaacaagacgccaacuucgugugccggcgcacauuugucgauagaggcuggggcaauggguguggacucuucggcaaagggucucugaucacgugcgcuaaguuuaagugcgugaccaaacuugagggaaagauuguucaguacgaaaaccugaaauauuccgugaucgucacagugcacaccggcgaccagcaucaaguugggaaugagagcacagaacacggaaccacggccaccaucacaccccaggcuccuaccacagagauucagcucaccgacuacggcgcccugacgcuggauuguucuccccggacaggccucgacuucaacgaaauggugcugcuuaccaugaaggagaaauccuggcugguccauaagcagugguuucucgaucugccucuucccuggacaagcggggccuccaccucucaagagaccuggaaucgccaggaccugcucgugacauucaaaacggcucacgcgaagaagcaggaagucgugguucugggaagccaagagggcgccaugcacaccgcucugacaggggccaccgaaauccagacauccggaaccacgacaauuuuugccggccaucucaaaugcagacugaagauggauaaacuuacccugaaggggaugagcuaugugauguguaccggcucuuucaaacucgagaaggaacuggcugagacacagcacggaaccguccuggugcagaucaaguacgagggcacagacgccccgugcaaaauuccuuucuccacgcaagaugaaaaggggguuacccagaacggacggcuuaucacagcgaaucccaucgugaccgacaaagagaagccugucaacauugaagcugagccgcccuuuggcgagagcuauaucgugauuggggccggagaaaaagcccucaagcugucuugguucaagaaaggcagcuccaucgggaagauguuugaggcuacagccagaggcgcucgccggauggccauucugggagauaccgcgugggacuucggcucuaucgggggaguguuuacgagcguuggcaaacucguccaucagaucuucgggaccgccuacggagugcuguuuuccggcgugagcuggacaaugaagauugggaucggcguccuucugaccuggcucggacucaauucuagauccacaagccugucuaugaccuguauugcugugggccuuguuacacucuaccugggggugaugguccaggccgauuccggaugcgugaucaacuggaaaggccgcgaacugaagugugggagcggaauuuucguuaccaaugaggugcacacguggacagaacaauauaaguuucaggcugacuccccuaaacggcucucugccgcgaucggcaaggccugggaggagggggucugcggcauuagaagcgcuacccgccuggaaaacaucauguggaaacagaucuccaacgagcuuaaucauauucugcucgaaaacgacaugaaguucaccgugguugugggagaugucgccggcauccuggcucaggggaaaaagaugauucggccgcaacccauggagcacaaauacucuuggaaaagcuggggaaaggccaagaucauuggcgccgacgugcagaauacaaccuuuaucaucgaugggccuaacacgcccgaauguccugacgaucagagagcuuggaauauuugggagguggaggacuauggauucggcaucuuuacaaccaacauuuggcugaaacuucgcgauuccuacacacaggucugcgaccaccggcucaugagcgcggccaucaaagauucuaaggcuguucaugccgacaugggcuauuggauugaauccgagaaaaaugaaaccuggaagcuggccagagcuagcuucaucgaggugaagacauguaucuggcccaaaucucacacccugugguccaacggggugcucgaaagcgagaugauuaucccgaagauuuacggaggcccuaucucucaacauaauuaucgccccggguacuucacgcagaccgccggaccuuggcaccugggcaaacuugagcuggauuuugaccucugcgaagggacaaccgucgugguugaugagcacugcggaaaccggggccccagccugagaacaaccacggugacaggcaagauuaucuacgaaugguguugccgguccuguacccugccuccccuucgcuucagaggggaggacggaugcugguauggcauggagauccggccggucaaagaaaaggaggaaaaucucgucaagagcaugguuucugcgggguccggagagguggacagcuuuucccugggccugcucuguauuucuaucaugauugaagaggucaugagaagccgcuggucccggaaaaugcugaugacagggacccuugcuguguucuuucugcucaucguuggacagcugaccuggaacgaucugauuagacuuugcaucauggugggcgccaaugccucugaccgcaugggcauggggacaacguaccuggcucucauggccaccuucaagaugagaccuauguuugcggucggacugcuguuccggcgccugacaagcagagaggugcuucugcucaccauuggccugucccugguggcuucugucgaacuucccaacagccuggaggaacucggggauggacuggccaugggcaucaugauccucaaacugcuuacagacuuucaaucccaucagcugugggccacccuccugagccugacguucauuaagacaaccuuuucucuucacuaugcuuggaaaaccauggccaugguucuguccguggugagccucuucccccugugucucucuacaaccucccagaagacaacguggcugccuguccuucuggggagccugggaugcaagccgcucaccauguuucugaucgcugagaauaaaauuuggggccggcgcucuuggccccuuaacgaaggcaucauggccguggggauuguuuccauccugcucagcucccugcucaagaacgaugugccucuggcgggaccccuuaucgccggcgggaugcugauugcuuguuacgucaucagcggaucuagcgccgaccugucccucgagaaagcugccgaggugucuugggaagaggaagccgagcauagcggcgcuucccacaauauucugguugaagugcaggaugacgggacaaugaagaucaaagaugaggagagagacgauacccuuacaauucugcucaaggcgacccugcucgccgucucuggaguguauccucugagcauccccgcuacgcuuuucgucugguacuucuggcagaagaagaagcagcgguccggcgugcugugggacaccccuucucccccggaaguugagcgcgccgugcuggaugacggcaucuauagaauuaugcagcgggggcuccugggacgcagccaggucggcguggggguuuuucaagaaaacguguuccauacaauguggcacgucaccagaggagccgugcuuauguaccagggcaaacggcuggagccuuccugggcuagcgugaagaaagaccucaucucuuacgggggaggcuggagacugcagggcuccuggaauacaggggaggaaguucaggucauugccguggagcccggaaagaacccuaaaaaugugcaaaccgcgcccggcacauuuaagacgccggaaggggaggucggagcuaucgcccucgauuucaagccuggcaccagcgggucucccauugugaaccgcgaaggaaaaaucguuggccuguauggcaaugggguggucacaaccuccggaaccuacgugagcgccauugcucaggccaaggcgucccaggagggcccucuucccgagaucgaagacgagguuuuucggaaaagaaaccugacaaucauggaucugcaccccgggucuggaaagacgcgccgguaucucccugcuauugugagagaagccaucaaacgcaagcugcggacccuuauucuggccccgacaagagucguggcuagcgagauggccgaagcucucaagggcaugcccauccgcuaccaaaccacagccguuaaauccgagcauaccgggaaggagauuguggaccugaugugccacgcgacguucacaaugcggcugcucagcccugucagagugcccaauuauaacaugaucaucauggaugaagcccauuuuaccgacccuucuuccauugcugcccggggcuacaucagcacccgcgugggaaugggcgaggcugccgccauuuucaugacagcuacacccccugggucugucgaagcguuuccgcagagcaaugccguuauccaggaugaggaaagagacauucccgagcgguccuggaacucuggauaugaguggaucacagauuucccuggcaaaaccgugugguuugugcccagcaucaaguccgggaaugacauugcuaacugucuucgcaaaaauggaaagagagucauccagcugucucggaagacguucgauacagaauaccagaagaccaagaacaacgacugggacuacgugguuacaaccgauauuagcgagaugggcgccaauuucagagccgaccgcgugaucgauccucggagaugccugaaacccgucauucucaaggacgggccggaacgcgugauccuggcuggcccuaugcccguuacgguggccuccgcggcucagcggagaggacgcauuggccggaaccacaauaaagagggggaucaguauaucuacaugggacagccccuuaacaaugacgaggaucaugcccacuggaccgaagccaagaugcugcucgacaacaucaauacaccugagggcauuauccccgcucuguuugaaccugagagagaaaagagcgccgcgauugauggggaguaucgccugagaggagaggcccggaaaaccuucgucgaacucaugcgcagaggcgaccuuccgguguggcugucuuacaaggucgcuuccgagggguuucaauauagcgaucggcgcuggugcuucgacggcgaaagaaacaaucaggugcuggaggaaaacauggauguugagaucuggacaaaagagggagaacggaagaaacucagaccccgcuggcuggacgcccggaccuacuccgacccucuugcucugagagaguuuaaggaguucgccgcuggccgccggucugugagcggggaucucauucuggagaucggaaaacugccccagcaccucacacagagagcccaaaaugcgcuugacaaccuggugaugcugcauaauuccgaacagggcgggcgggccuaucgccacgcuauggaggagcucccugauaccaucgaaacgcugaugcuucuggcccucauugcuguccugacaggaggcguuacccuguuuuuccucucuggcagagggcuuggaaagaccagcaucggccugcugugugugauggccuccagcgugcuccuguggauggccucugucgagccccauuggauugcugcguccaucauucuugaauuuuuccugauggugcuccugaucccggagccugaccggcagcgcacaccccaggauaaccaacuggccuacguugugaucgggcuccuuuuuaugauucugaccgucgcugccaaugagaugggacugcucgaaacaacgaagaaagaccugggcaucgggcacguggccgucgagaaccaccaucacgcugccaugcuugauguggaccugcauccugcgagcgccuggacccucuacgcuguugccacaaccauuaucacacccaugaugagacacaccauugaaaacacgaccgcuaauaucucucugacagccauugcgaaccaggccgcuauccugaugggacucgauaagggcuggccuaucuccaaaauggacauuggcgugccccuucuggcccuggggugcuauagccaggucaauccgcucacccugacagcugccgugcuuaugcugguugcucauuacgccaucauuggaccuggccuccaagcgaaggccacccgggaggcucagaaacgcacggccgcugggaucaugaagaaccccacaguggauggaauugucgccaucgaccuggaucccgugguguaugacgccaaguucgaaaaacagcugggccagaucaugcuccuuauucuguguaccucucaaauccugcucaugagaacaaccugggcgcugugcgagagcauuacccuugcuacagggccucugacgacccucugggagggauccccgggcaaguuuuggaauacaaccaucgccguuucuauggcuaacauuuuccggggcagcuaccuggccggggccggacuggcuuucucccucaugaaaagccuuggcgggggacgcagaggcacaggggcccagggagaaacccugggcgagaaguggaaacggcagcugaaucagcucuccaagucugaauuuaacacguauaagagaagcggcaucauggaggucgaccgcuccgaagcgaaagaggggcugaagcggggagagacaaccaaacacgccgugucuagaggcaccgcuaaacuucgcugguucguggaacggaaucuggucaaacccgaggggaagguuaucgaucucggauguggcagagggggauggagcuacuauugcgccggccugaagaaagugacagaagugaagggcuacaccaaagggggaccuggccacgaggaacccauuccuauggcuacauacggguggaaccuggucaagcuccauuccggaaaagacguguuuuucauucccccugagaagugugauacgcuucugugcgacaucggcgagucuagcccgaaucccaccaucgaagaggggcgcacacugcggguucucaaaaugguggaaccuuggcugagaggaaaccaauuuuguauuaagauccuuaaucccuauaugccuuccgucguggagacccuggagcagaugcagcgcaagcacggcggcaugcucguucggaacccccugagcagaaauucuacacaugaaauguacuggguguccugcgggaccggaaacauugucagcgccgugaauaugacgucucgcaugcugcucaaccgguucaccauggcgcacagaaaaccgacauaugagcgcgauguggaccugggcgccgggaccagacacgucgcuguugaaccugagguggccaaccuugauaucaucggacagcggauugaaaauaucaagcaugagcacaaauccacauggcauuacgacgaggauaaccccuauaagaccugggcuuaccacggcagcuaugaagugaaacccucuggguccgccagcuccauggucaauggagugguuaagcugcucacaaagccuugggacgugauucccauggucacccaaaucgcuaugacggauacaaccccuuuuggccagcagcgcguguucaaagagaagguugacaccagaacaccgaaagccaagcggggcacggcgcaaauuauggaagugaccgccaaauggcuguggggguuucuuagcagaaacaagaagccccggaucuguacacgcgaggaguucaccagaaaaguccggucuaaugcugccaucggagcuguguuuguugacgagaaccaguggaauagcgccaaggaggccguggaagaugagcgcuucugggaccugguccauagagaacgggagcuccacaaacagggcaagugcgcgacaugcguguacaacaugauggggaaacgcgaaaagaagcugggagaguuuggcaaagcuaagggguccagagccauuugguacauguggcugggcgcccgguuccucgaguucgaagcucugggauuuaugaaugaggaucacugguucucucgcgaaaacagccuuuccggcgucgagggggagggacugcauaaacucggcuauauccugagagacauuucuaagaucccugggggaaauauguacgccgaugacaccgcuggcugggauacacggauuaccgaagacgaucuucagaacgaggcccgcaucacggacaucauggaacccgagcacgcgcugcucgccaaaagcauuuuuaagcugaccuaucaaaauaaagugguuagagugcagcggccugcuaagaacgggacagucauggaugugaucucccgcagagaccagcggggcucuggacaggugggcaccuacgggcugaauacauucaccaacauggaagcccaacucauuagacagauggagagcgagggaaucuuuucccccagcgaacuggagacgccgaaccuugcugaacgcguucuggauuggcucgagaaguauggcguggaacggcugaaaagaauggccauuucuggggacgacugugucgugaagccuaucgaugaccgcuucgcgacagcccuuaccgcucugaaugauaugggaaaaguucggaaggacaucccccagugggagccuuccaaaggcuggaacgauuggcagcaagugcccuuuugcagccaucacuuccaccagcucauuaugaaggacgggagagagaucgucgugccuugucgcaaucaggaugaacuggucggccgggccagagugucucagggagcuggcuggucccugcgcgagacagccugccucggaaagagcuacgcucaaauguggcagcugauguauuuucaucggagagaccuucgccuggccgcgaacgccauuuguuccgcuguucccguggauuggaucccgaccucucggacgaccuggagcauucacgcccaucaccaguggaugacaaccgaagacaugcucuccgucuggaauagaguguggaucgaggaaaacccuuggauggaggauaaaacacauauuagcucuuggggagacguucccuaccugggcaagcgggaggaccaauggugcgggucccuuaucggacugaccgccagagcuacaugggccaccaauauccagguggcgauuaaccagguccgccggcucaucggcaaugaaaacuaccuggauuauaugacgagcaugaaaagauucaagaaugagucugaccccgaaggggcucugugguga

SEQ ID NO: 18857 - RNA, 9879 nt, Artificial Sequence
  derived and/or modified CDS sequence (opt5) from DENV-1__FJ024436__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaauaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaagacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaauacggaaccacagcuaccauuacgccccaggccccuucuaccgagauccagcucacagacuauggcgcccugacccuggauuguagcccccggacaggccucgacuucaacgaaauggugcugcuuaccaugaaggagaaaagcuggcugguccacaagcagugguuucucgaucugccucuucccuggacguccggggcuucuacaagccaagagaccuggaaucgccaggaccugcucgugacauucaaaaccgcgcaugccaagaagcaggaagucgugguucugggaucccaagagggcgcuaugcacaccgcccugacaggggccacggaaauucagaccagcggaacaaccacaaucuuugcuggccaccucaaaugcagacugaagauggauaaacuuacccugaaggggaugucuuacgugauguguacgggcuccuucaaacucgagaaggaagucgccgagacacagcauggaaccgugcugguucagauuaaguaugagggcaccgacgcgccgugcaaaaucccuuucagcacacaagaugaaaagggggugacccagaacggacggcugaucacagcuaaucccauugucacggacaaagagaagccugugaacaucgaagccgagccgcccuuuggcgagucuuacauugugaucggggccggagaaaaagcucuuaagcucagcugguucaagaaaggcuccucuauugggaagauguuugaggccaccgcuagaggcgcccgccggauggcgauccugggagauacagccugggacuucggcagcaucgggggaguuuuuaccuccgucggcaaacuggugcaccagauuuucgggacagcuuacggagugcucuuuagcggcgucucuuggaccaugaagaucgggauuggcgugcugcuuacguggcugggacucaauuccagaagcaccucucuguccaugacauguaucgccguuggccuggugacccuuuaucucggggucauggugcaggcugauagcggaugcguuauuaacuggaaaggccgcgaacugaaguguggguccggaaucuucgugacaaaugagguccauaccuggacagaacaauacaaguuucaggccgacucuccuaaacggcugagcgcggccauuggcaaggcuugggacgagggggugugcggcaucagauccgccacccgccucgagaacaucauguggaaacagauuucuaacgaacugaaucacauccuucuggagaacgauaugaaguucacgguuguggucggagacguggcuggcauucucgcccaggggaaaaagaugauccggccgcaacccauggaauauaaauacagcuggaaguccuggggaaaggccaaaauuaucggcgcugaugugcagaauacaaccuuuaucauugacgggccuaacacccccgaguguccugaugaccagagagcguggaauaucugggaagucgaggauuauggauucggcauuuuuacaaccaacaucuggcugaagcugcgcgacagcuacacgcagguuugcgaucaucggcuuaugucugccgcuauuaaagacuccaaggccgugcacgccgauaugggcuauuggaucgagagcgagaagaaugagacauggaagcucgcuagagccucuuucaucgaagugaagaccuguauuuggcccaaaucccacacacuguggagcaacgggguccuggagucugaaaugaucauuccgaagaucuacggaggcccuauuagccaacauaauuaccgccccggguauuucacccagacagcgggaccuuggcaccucggcaaacuggagcuugacuuuaaccugugcgaggggaccacggugguuguggaugaacauugcggaaaucggggccccucccucagaaccacaaccgucacaggcaagaucauccacgagugguguugccggagcuguacccugccuccccugcgcuucaaaggggaagacggaugcugguacggcauggagauuagaccggugaaggagaaggaagagaaccuuguuaaaucuaugguguccgcugggagcggagaagucgacuccuuuucucucggccugcuguguaucagcauuaugaucgaggaagugaugcgguccagauggucucgcaagaugcucaugacggggacacuggccguuuucuuucuucugauuaugggacagcucaccuggaaugaucugauccggcugugcauuauggugggcgccaacgcuagcgacagaaugggcauggggacaaccuaucuugcccugauggcgaccuucaaaaugcgcccuaugcucgcugucggacugcucuuuagacggcugacaucccgcgaggugcuucugcucacgaucggccugucucugguggccagcgucgagcuucccaauucccuggaagaacucggggauggacuggccaugggcaucaugauucucaagcugcuuaccgacuuccaaagccaccagcugugggcuacacuccugucucugaccuuuaucaaaacaaccuacucccuucauuaugccuggaagacgauggcuaugguucugagcauugugucucucuucccccugugucucuccacaaccagccagaagaccacauggcugccugugcuucuggggucucugggaugcaaaccgcucaccauguuucugaucgccgaaaacaagauuuggggcagaaaauccuggccccuuaacgagggcaucauggcggucgggaucgugagcauucugcucuccagccugcucaagaaugauguuccucuggccggaccccuuaucgcuggcgggaugcugauugccuguuacgugaucucuggaagcuccgcugaccugucucucgaaaaagccgccgaggucagcugggaggaagaggcugaacacuccggcgcgucucauaacauucugguggagguucaggaugacgggacaaugaagaucaaagaugaggaacgggacgauacgcuuaccauccugcucaaggccacacugcucgcugugagcggagucuauccucuguccauucccgccacccuuuucgugugguacuuuuggcaaaagaaaaagcagcgcucuggcguccugugggacacaccuuccccucccgagguggaaagagccguucuggaugacggcaucuaccggauuaugcagcgcgggcuccugggaagaucccaggugggcgucgggguguuccaagagaauguuuuccacaccauguggcaugugacgcggggagcuguccuuauguaucagggcaaacgccuggaacccagcugggccucugugaagaaagaccucaucuccuacgggggaggcuggagacugcagggcagcuggaacaccggggaggaggugcagguuauugcggucgaacccggaaagaauccuaagaacgugcaaacagcucccggcaccuuuaaaacaucugagggggaagugggagccaucgcccucgauuucaagccgggcaccuccgggagcccuauugucaaucgggagggaaaaaucgugggccuguauggcaacgggguugugacaacguccggaaccuacgucucugcuaucgcccaggcgaaggcuagccaggaaggcccccuuccugagauugagaaugaaguguuuagaaaacgcaaccugacaaucauggaccugcaccccggguccggaaagacccggagauaucuccccgccauuguucgcgaggccaucaagcggaaacugagaacccuuauucuggcuccuacacgcguggucgccagcgaaauggcugaggcccucaagggcaugccgauccgguaccaaacgaccgcggugaaaucugaacacacagggaaggagaucguugaucugaugugccaugccaccuucacaaugagacugcucucccccgugcgcgucccuaauuauaacaugauuaucauggacgaggcucacuuuaccgaucccagcucuauugccgcucggggcuacaucagcacgagagugggaaugggcgaagccgccgcuauuuucaugacagcgaccccucccggguccguggaggccuuuccucagucuaaugcugucauccaggacgaggaacgggauaucccggaacgcagcuggaacuccggauacgaguggauuaccgacuuccccggcaaaacaguuugguuugugccuucuaucaagagcgggaaugauauugccaacugucuuagaaagaacggaaaacgggugauccagcugucccgcaagaccuucgacacagaguaucagaagacaaagaauaacgauugggacuacgucgugacgacagacauuagcgaaaugggcgccaauuuuagagcugaucggguuaucgaccccagacgcugccugaaaccugugauucucaaggaugggcccgagcgggucauccuggccggcccgaugccugugaccguugcgucugcugcccagagacgcggacggaucggcagaaaccauaauaaggaaggggaccaguauauuuacaugggacagccccuuaacaaugaugaggaccacgcccauuggacagaggcuaaaaugcugcucgauaacaucaauacccccgaaggcauuaucccugcccuguucgagcccgaacgcgagaaguccgcggccauugacggggaauaucggcugagaggagaggcucgcaaaacguucguggagcucaugagacggggcgaucuuccugucuggcugagcuacaagguggccuccgaaggguuucaauauucugaccgcagauggugcuucgauggcgagcggaacaaucagguccuggaagagaacauggacguggaaaucuggaccaaagagggagagcgcaagaaacucagaccgcgguggcuggaugcuagaacauacagcgacccccuugcccugcgcgaauuuaaggaguucgcugccggccggaaguccguuucuggggaccucauccuggaaauuggaaaacugccucagcaccucacccagagagcgcaaaaugcccuugauaaccuggugaugcugcacaauagcgagcagggcgggcgcgcuuaccggcaugccauggaggaacuccccgacacaaucgagacccugaugcuucuggcucucauugccgugcugacaggaggcgucacccuguuuuuccucuccggcagagggcuuggaaagacgagcaucggccugcuguguguuauggccucuuccgugcuccuguggauggcuagcguggaaccucacuggauugcggccucuaucauccuugaguuuuuccugaugguccuccugauucccgaaccggaucggcagcgcacaccucaggacaaccaacuggcuuaugugguuaucgggcuccuuuuuaugauucugaccguggccgccaacgagaugggacugcucgagaccaccaaaaaggaucugggcaucgggcaugucgcuguggaaaaucaccaccaugccgcgaugcuugacgucgaucugcaccccgccuccgcuuggacccucuacgccguggcuacaacgauuaucaccccuaugaugagacauacaauugagaacaccacagccaauaucagccugaccgcgaucgccaaccaggcugccauucugaugggacucgacaaaggcuggcccaucucuaagauggauauuggcguuccucuucuggcucuggggugcuauagccaggugaauccccucacgcugaccgccgcuguccuuaugcugguggcccacuacgcgaucauuggaccgggccuccaagccaaggcuacacgggaagcccagaaacgcaccgcugccgggaucaugaagaacccuacaguugacggaaucguggccauugaucuggaccccgucguguaugaugcgaaauucgagaagcagcugggccagaucaugcuccuuauucuguguaccucccaaauccugcucaugagaacgacaugggcucugugcgaaucuauuacccuugccacagggccccugaccacccucugggagggaagcccuggcaaauuuuggaauacaacgaucgcuguguccauggccaacaucuuccggggcagcuaccuggccggggcuggacuggccuuuucccucaugaagucucuuggcgggggacgcagaggcaccggggcgcagggagagacacugggcgaaaaguggaaacggcagcugaaucagcucagcaaguccgaguucaacaccuauaaacgcucuggcauuauggaaguugacagaagcgaggccaaggaagggcugaaacggggagagacaaccaagcaugcugucuccagaggcacggccaaacuucgcugguucguggagcggaaucuggugaaaccggaagggaaggucaucgaccucggauguggcagagggggauggucuuacuacugcgcuggccugaaaaagguuacagaggugaaaggcuauaccaaagggggacccggccacgaggagccuauucccauggccaccuacggguggaaccuggugaaacuccacagcggaaaggaugucuuuuucaucccucccgaaaagugugacacacuucugugcgauauuggcgaguccagcccuaauccgaccaucgaggaagggcgcacacugcgggugcucaaaaugguugagcccuggcugagaggaaaccaauuuuguauuaagauccuuaauccuuauaugcccucuguggucgaaacgcuggagcagaugcagcgcaaacauggcggcaugcucgugcggaacccucuguccagaaauagcacccacgagauguacuggguuucuugcgggacaggaaacaucguguccgcggucaacaugaccagccgcaugcugcucaaucgguucacaauggcccauagaaagcccaccuaugaacgcgacguggaucugggcgcugggacgcggcacguggccgucgagccggaaguugcuaaccuugacauuaucggacagagaauugagaauaucaaacacgaacauaagucuaccuggcacuacgaugaggacaacccuuauaagacaugggccuaccauggcuccuacgaggugaaacccagcggguccgcuagcucuauggugaauggagucgugaagcugcucaccaaacccugggauguuauuccuauggugacacaaaucgccaugaccgacacaacccccuuuggccagcagcgcgucuucaaggaaaaaguggauacgagaacaccuaaggcgaagcggggcaccgcccaaaucauggagguuaccgcuaaauggcuguggggguuucuuagccgcaacaagaaaccgagaauuuguacacgggaagaguucacgagaaaggugcgguccaaugccgcuaucggagccgucuuuguggacgaaaaccaguggaacucugccaaagaggcgguugaggacgaacgcuucugggaucuggugcacagagagcgggaacuccauaagcagggcaagugcgcuaccugcgucuauaacaugauggggaaacgcgagaagaaacugggagaauuuggcaaggccaaagggagcagagccauuugguacauguggcugggcgcucgguuccucgaguuugaggcccugggauucaugaaugaagaccacugguucucccgcgagaacucucuuagcggcguggaaggggagggacugcacaagcucggcuauauccugagagauauuuccaaaauccccgggggaaauauguacgcugacgauacagccggcugggacacccggaucacagaggaugaccuucagaacgaagcgaagauuaccgauaucauggagccugaacaugcccugcucgcuaagucuauuuuuaaacugacauaucaaaauaaggucgugcgcguucagagacccgccaaaaacgggaccgugauggacgucaucagccggcgcgaucagagaggcuccggacaggugggcacguacgggcugaacaccuucacaaauauggaggcucaacucauucggcagauggaaagcgagggaaucuuuucuccuuccgagcuggaaacccccaaccuugccggccgcgugcuggacuggcucgagaagcacgggguugaaagacugaaacggauggcgaucagcggagaugacuguguggucaagccgauugacgauagauucgccacagcucuuaccgcccugaaugacaugggcaaggugcgcaaagauaucccucagugggagcccucuaagggguggaacgacuggcagcaaguuccuuuuugcucccaucacuuccaccagcucauuaugaaagauggccgggaaaucgugguccccuguagaaaucaggacgagcuggugggacgcgcucgggucagccagggcgccggguggucccugagagagacggcuugccucggaaagucuuaugcccaaauguggcagcugauguacuuucaucgccgggaucuuagacuggcggccaacgcuauuuguagcgccgugccuguugacugggugcccacaucccgcaccacauggagcauccacgcccaucaccaguggaugaccacggaagauaugcucucugucuggaaucggguguggauugaggaaaacccguggauggaggacaaaacccauaucuccagcuggggcgauguuccuuaccuggggaagagagaagaccaauggugcggaucucuuaucggccugacagcucgcgccaccugggcgacaaauauucagguggcuaucaaccagguccggagacucauugggaaugagaacuaucuggacuacaugaccagcaugaagcgguucaaaaaugaguccgaucccgaaggcgcccugugguga

SEQ ID NO: 18858 - RNA, 9879 nt, Artificial Sequence
  derived and/or modified CDS sequence (opt5) from DENV-1__FJ024472__SS-prME
agcgugaccaugcugcugaugcugaugcccacagcccuugcuuuccaccugacgaccagaggcggggaaccucauaugaucgucuccaagcaggaacgggggaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcguuggcaaacucguccaucagauuuucgggacggccuacggagugcuguuuuccggcgugagcuggaccaugaagaucgggauuggcguccuucugacauggcucggacucaauucuagauccaccagccugucuaugacauguaucgcugugggccuuguuacccucuaccugggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcucucugccgcggucggcaaggccugggaggagggggugugcggcauuagaagcgcuacacgccuggaaaacaucauguggaaacagaucuccaacgagcuuaaucauauucugcucgaaaacgacaugaaguucaccguuguggucggagauguggccggcauccuggcucaggggaaaaagaugauucggccgcaacccauggaguacaaauauucuuggaaaagcuggggaaaggccaagaucauuggcgccgacgugcagaauaccacauuuaucaucgaugggccuaacacccccgaauguccugacgaucagagagcuuggaauauuugggaggucgaggacuacggauucggcaucuuuacgacaaacauuuggcugaaacuucgcgauuccuauacccagguuugcgaccaccggcucaugagcgcggccaucaaagauucuaaggcugugcacgccgacaugggcuacuggauugaauccgagaaaaaugaaacauggaagcuggccagagcuagcuucaucgaggugaagaccuguaucuggcccaaaucucauacacugugguccaacgggguccucgaaagcgagaugauuaucccgaagauuuauggaggcccuaucucucaacacaauuaccgccccggguacuucacccagacggccggaccuuggcaucugggcaaacuugagcuggauuuugaccucugcgaagggaccacagugguuguggaugagcacugcggaaaccggggccccagccugagaaccacaaccgucacgggcaagauuauccacgaaugguguugccgguccuguacacugccuccccuucgcuucagaggggaggacggaugcugguauggcauggagauccggccggugaaagaaaaggaggaaaaucucguuaagagcauggugucugcgggguccggagaggucgacagcuuuucccugggccugcucuguauuucuaucaugauugaagaggugaugagaagccgcuggucccggaaaaugcugaugaccgggacacuugcuguuaucuuccugcucauuaugggacagcugaccuggaacgaucugaucagacuuugcauuauggugggcgccaaugccucugaccgcaugggcauggggaccacauaccuggcucucauggccacguuuaagaugagaccuauguucgcggucggacugcucuuucggcgccugaccagcagagaggugcuucugcucacaaucggccugucccugguggcuucugucgaacuucccaacagccuggaggaacucggggauggacuggccaugggcaucaugauucucaaacugcuuaccgacuuccaaucccaucagcugugggccacacuccugagccugaccuuuaucaagacgacauucucucuucacuaugcuuggaaaaccauggccaugguucuguccauugugagccucuuuccccugugucucucuaccacaucccagaagaccacauggcugccugugcuucuggggagccugggaugcaagccgcucacgauguuccugaucgcugagaauaaaauuuggggccggcgcucuuggccccuuaacgaaggcaucauggccgucgggaucguguccauucugcucagcucccugcucaagaacgauguuccucuggcgggaccccuuaucgccggcgggaugcugauugcuuguuacgugaucagcggaucuagcgccgaccugucccucgagaaagcugccgaggucucuugggaagaggaagccgagcauagcggcgcuucccacaauauucugguggaaguucaggaugacgggaccaugaagaucaaagaugaggagagagacgauacacuuaccauccugcucaaggcgacacugcucgccgugucuggagucuauccucugagcauucccgcuacccuuuuugugugguacuucuggcagaagaagaagcagcgguccggcguccugugggacacgccuucucccccggaaguggagcgcgccguucuggaugacggcaucuauagaauuaugcagcgggggcuccugggacgcagccaggugggcgucgggguguuccaagaaaacguuuuucauaccauguggcacgugacaagaggagccguccuuauguaccagggcaaacggcuggagccuuccugggcuagcgugaagaaagaccucaucucuuacgggggaggcuggagacugcagggcuccuggaauaccggggaggaagugcagguuauugccgucgagcccggaaagaacccuaaaaaugugcaaacagcgcccggcaccuucaagacaccggaaggggaggugggagcuaucgcccucgauuuuaagccuggcacgagcgggucucccauugucaaccgcgaaggaaaaaucgugggccuguauggcaaugggguugugaccacauccggaaccuacgucagcgccaucgcucaggccaaggcgucccaggagggcccucuucccgagauugaagacgagguguuccggaaaagaaaccugaccaucauggaucugcaccccgggucuggaaagacacgccgguaucucccugcuauuguuagagaagccaucaaacgcaagcugcggacgcuuauucuggccccgaccagaguggucgcuagcgagauggccgaagcucucaagggcaugcccauccgcuaccaaacaaccgccgugaaauccgagcauacagggaaggagaucguugaccugaugugccacgcgaccuuuacgaugcggcugcucagcccugugagaguccccaauuauaacaugauuaucauggaugaagcccauuucacagacccuucuuccauugcugcccggggcuacaucagcacccgcgugggaaugggcgaggcugccgccauuuuuaugaccgcuacacccccugggucuguggaagcguucccgcagagcaaugccgucauccaggaugaggaaagagacauccccgagcgguccuggaacucuggauaugaguggauuaccgauuuuccuggcaaaacaguuugguucgugcccagcaucaaguccgggaaugacauugcuaacugucuucgcaaaaauggaaagagagugauccagcugucucggaagaccuuugauacggaauaccagaagaccaagaacaacgacugggacuacgucgugaccacagauauuagcgagaugggcgccaauuucagagccgaccgcguuaucgauccucggagaugccugaaacccgugauucucaaggacgggccggaacgcgucauccuggcuggcccuaugcccgugaccguugccuccgcggcucagcggagaggacgcaucggccggaaccacaauaaagagggggaucaguauauuuacaugggacagccccuuaacaaugacgaggaucaugcccacuggacggaagccaagaugcugcucgacaacaucaauaccccugagggcauuauccccgcucuguucgaaccugagagagaaaagagcgccgcgauugauggggaguaucgccugagaggagaggcccggaaaacauuuguggaacucaugcgcagaggcgaccuuccggucuggcugucuuacaagguggcuuccgagggguuccaauauagcgaucggcgcuggugcuuugacggcgaaagaaacaaucagguccuggaggaaaacauggauguggagaucuggaccaaagagggagaacggaagaaacucagaccccgcuggcuggacgcccggacauacuccgacccucuugcucugagagaguucaaggaauuugccgcuggccgccggucuguuagcggggaucucauccuggagauuggaaaacugccccagcaccucacccagagagcccaaaaugcgcuugacaaccuggugaugcugcauaauuccgaacagggcgggcgggccuaucgccacgcuauggaggagcucccugauacaaucgaaacccugaugcuucuggcccucauugcugugcugacgggaggcgucacacuguucuuucucucuggcagagggcuuggaaagaccagcaucggccugcuguguguuauggccuccagcgugcuccuguggauggccucuguggagccccauuggauugcugcguccaucauccuugaguucuuucugaugguccuccugauuccggagccugaccggcagcgcacaccccaggauaaccaacuggccuacgugguuaucgggcuccuuuucaugauucugacaguggcugccaaugagaugggacugcucgaaaccacaaagaaagaccugggcaucgggcacgucgccguggagaaccaccaucacgcugccaugcuugaugucgaccugcauccugcgagcgccuggacgcucuacgcuguggccaccacaauuaucacccccaugaugagacacacaauugaaaacaccacggcuaauaucucucugaccgccaucgcgaaccaggccgcuauucugaugggacucgauaagggcuggccuaucuccaaaauggacauuggcguuccccuucuggcccuggggugcuauagccaggugaauccgcucacacugaccgcugccguccuuaugcugguggcucauuacgccaucauuggaccuggccuccaagcgaaggccacacgggaggcucagaaacgcaccgccgcugggaucaugaagaaccccacgguugauggaaucguggccauugaccuggaucccgucguguaugacgccaaguuugaaaaacagcugggccagaucaugcuccuuauucuguguacaucucaaauccugcucaugagaaccacaugggcgcugugcgagagcauuacccuugcuaccgggccucugacaacgcucugggagggauccccgggcaaguucuggaauaccacaaucgccgugucuauggcuaacaucuuucggggcagcuaccuggccggggccggacuggcuuucucccucaugaaaagccuuggcgggggacgcagaggcaccggggcccagggagaaacacugggcgagaaguggaaacggcagcugaaucagcucuccaagucugaguucaacaccuauaagagaagcggcauuauggagguugaccgcuccgaagcgaaagaggggcugaagcggggagagacgacaaaacacgccgucucuagaggcaccgcuaaacuucgcugguuuguggaacggaaucuggugaaacccgaggggaaggucaucgaucucggauguggcagagggggauggagcuacuauugcgccggccugaagaaaguuaccgaagugaagggcuacacaaaagggggaccuggccacgaggaacccauuccuauggcuaccuacggguggaaccuggugaagcuccauuccggaaaagacgucuucuuuauucccccugagaagugugauacacuucugugcgacaucggcgagucuagcccgaaucccacgaucgaagaggggcgcacccugcgggugcucaaaaugguugaaccuuggcugagaggaaaccaauucuguauuaagauccuuaaucccuauaugccuuccguggucgagacacuggagcagaugcagcgcaagcacggcggcaugcucgugcggaacccccugagcagaaauucuacccaugaaauguacuggguuuccugcgggacaggaaacaucgugagcgccgucaauaugaccucucgcaugcugcucaaccgguuuacgauggcgcacagaaaaccgaccuaugagcgcgauguggaccugggcgccgggacaagacacguggcugucgaaccugagguugccaaccuugauauuaucggacagcggauugaaaauaucaagcaugagcacaaauccaccuggcauuacgacgaggauaaccccuauaagacaugggcuuaccacggcagcuaugaagugaaacccucuggguccgccagcuccauggugaauggagucgugaagcugcucaccaagccuugggacguuauucccauggugacacaaaucgcuaugaccgauacgacaccuuucggccagcagcgcgucuuuaaagagaagguggacaccagaaccccgaaagccaagcggggcacagcgcaaaucauggaaguuacggccaaauggcuguggggguuccuuagcagaaacaagaagccccggauuuguacccgcgaggaauuuacaagaaaagugcggucuaaugcugccaucggagcugucuucguggacgagaaccaguggaauagcgccaaggaggccguugaagaugagcgcuuuugggaccuggugcauagagaacgggagcuccacaaacagggcaagugcgcgaccugcgucuacaacaugauggggaaacgcgaaaagaagcugggagaguucggcaaagcuaagggguccagagccauuugguacauguggcugggcgcccgguuucucgaguucgaagcucugggauucaugaaugaggaucacugguuuucucgcgaaaacagccuuuccggcguggagggggagggacugcauaaacucggcuauauccugagagacauuucuaagaucccugggggaaauauguacgccgaugacacagcuggcugggauacccggaucacagaagacgaucuucagaacgaggcccgcauuaccgacaucauggaacccgagcacgcgcugcucgccaaaagcauuuucaagcugacguaucaaaauaaagucgugagaguucagcggccugcuaagaacgggaccgugauggaugucaucucccgcagagaccagcggggcucuggacaggugggcacauacgggcugaauaccuuuacaaacauggaagcccaacucauuagacagauggagagcgagggaaucuucucccccagcgaacuggagaccccgaaccuugcugaacgcgugcuggauuggcucgagaaguauggcguugaacggcugaaaagaauggccaucucuggggacgacuguguggucaagccuauugaugaccgcuuugcgacggcccuuacagcucugaaugauaugggaaaagugcggaaggacaucccccagugggagccuuccaaaggcuggaacgauuggcagcaaguucccuucugcagccaucacuuucaccagcucauuaugaaggacgggagagagaucguggucccuugucgcaaucaggaugaacuggugggccgggccagagucucucagggagcuggcuggucccugcgcgagaccgccugccucggaaagagcuacgcucaaauguggcagcugauguauuuccaucggagagaccuucgccuggccgcgaacgccauuuguuccgcugugcccguugauuggaucccgacaucucggaccacguggagcauucacgcccaucaccaguggaugaccacagaagacaugcucuccguguggaauagagucuggaucgaggaaaacccuuggauggaggauaaaacccauaucagcucuuggggagacgugcccuaccugggcaagcgggaggaccaauggugcgggucccuuauuggacugacagccagagcuaccugggccacaaauauccagguugcgauuaaccaggugcgccggcucaucggcaaugaaaacuaccuggauuauaugaccagcaugaaaagauuuaagaaugagucugaccccgaaggggcucugugguga

SEQ ID NO: 18859 - RNA, 9879 nt, Artificial Sequence
  derived and/or modified CDS sequence (opt5) from DENV-1__FJ024439__SS-prME
agcgugaccaugcugcugaugcugaugcccacagcccuugcuuuccaccugacgaccagaggcggggagccucauaugaucguguccaagcaggaacggggaaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauuaucauuggggccggagaaaaagcccuuaagcucucuugguucaagaaaggcagcuccaucgggaagauguuugaggcuaccgccagaggcgcucgccggauggccauccugggagauacagcgugggacuucggcucuauugggggaguguuuaccagcguuggcaaacugguccaucagaucuucgggacggccuacggagugcucuuuuccggcgugagcuggaccaugaagauugggaucggcguccugcuuacauggcugggacucaauucuagauccaccagcuucucuaugacauguauugcugugggccugguuacccuguaccuuggggugaugguccaggccgauuccggaugcgugaucaacuggaaaggccgcgaacucaagugugggagcggaauuuuuguuacaaaugaggugcacaccuggacggaacaauauaaguuccaggcugacuccccuaaacggcugucugccgcgaucggcaaggccugggaggagggggucugcggcaucagaagcgcuacacgccuggaaaacauuauguggaaacagaucuccaacgagcucaaucauauucugcuugaaaacgacaugaaguuuaccgugguugugggagaugucgccggcauccuggcucaggggaaaaagaugauucggccgcaacccauggaguacaaauauucuuggaaaagcuggggaaaggccaagaucaucggcgccgacgugcagaauaccacauucauuaucgaugggccuaacacccccgaauguccugacgaucagagagcuuggaauauuugggagguggaggacuacggauuuggcaucuucacgacaaacauuuggcucaagcugcgcgauuccuauacccaggucugcgaccaccggcugaugagcgcggccaucaaagauucuaaggcuguucacgccgacaugggcuacuggaucgaauccgagaaaaaugaaacauggaaacuugccagagcuagcuucauugaggugaagaccuguaucuggcccaaaucucauacacucugguccaacggggugcuggaaagcgagaugauuaucccgaagauuuauggaggcccuaucucucaacacaauuaccgccccggguacuuuacccagacggccggaccuuggcaucugggcaaacucgagcuggauuucgaccuuugcgaagggaccacagucgugguugaugagcacugcggaaaccggggccccagccugagaaccacaaccgugacgggcaagaucauucacgaaugguguugccgguccuguacacucccuccccugcgcuuuagaggggaggacggaugcugguauggcauggagauccggccggucaaagaaaaggaggaaaaucuggucaagagcaugguuucugcgggguccggagagguggacagcuucucccuuggccuccuguguauuucuaucaugauugaagaggucaugagaagccgcuggucccggaaaaugcugaugaccgggacacucgcuguguuuuuccugcuuaucaugggacagcugaccuggaacgaucucauuagacugugcaucaugguuggcgccaaugccucugaccgcaugggcauggggaccacauaccuggcucuuauggccacguuuaagaugagaccuauguucgcggugggacugcucuuucggcgccugaccagcagagagguccuccugcuuacaaucggccugucccucguggcuucuguggaacugcccaacagccuggaggaacuuggggauggacuggccaugggcauuaugauccucaaacugcucaccgacuuccaaucccaucagcugugggccacacuucugagccucaccuuuauuaagacgacauucucucugcacuaugcuuggaaaaccauggccaugguccuguccaucguuagccuuuuuccccugugucucucuaccacaucccagaagaccacauggcugccugugcuccuggggagccuuggaugcaagccgcugacgauguuccugauugcugagaauaaaaucuggggccggcgcucuuggccccucaacgaaggcaucauggccguggggauugucuccauccugcuuagcucccugcucaagaacgaugugccucuggcgggaccccucauugccggcgggaugcugaucgcuuguuacguuauuagcggaucuagcgccgaccuuucccuggagaaagcugccgaggugucuugggaagaggaagccgagcauagcggcgcuucccacaauauccuggucgaagugcaggaugacgggaccaugaagaucaaagaugaggagagagacgauacacucaccauucugcuuaaggcgacacugcucgccguuucuggaguguauccucugagcauccccgcuacccucuucgucugguacuuuuggcagaagaagaagcagcgguccggcgugcugugggacacgccuucucccccggaagucggccgcgccgugcuugaugacgggauuuauagaaucaugcagcggggacugcugggccgcagccagguuggggugggagucuuccaagagaacguguuucauaccauguggcacguuacaagaggcgccgugcucauguaccaggggaaacggcuggaaccuuccugggcuagcgucaagaaagaccuuauuucuuacggaggcggcuggagacugcagggguccuggaauaccggagaggagguccaggugaucgccguugaacccggcaagaacccuaaaaauguccaaacagcgcccgggaccuucaagacaccggagggagaagugggcgcuauugcccucgauuuuaagccugggacgagcggaucucccaucgugaaccgcgagggcaaaaucgucggccuguaugggaauggagugguuaccacauccggcaccuacgugagcgccauugcucaggccaaggcgucccaggaagggccucuccccgagaucgaggacgaagucuuccggaaaagaaaccugaccauuauggaucuucaccccggaucuggcaagacacgccgguaucugccugcuaucgugagagaggccauuaaacgcaagcugcggacgcucauccuggccccgaccagaguuguggcuagcgaaauggccgaggcucuuaaggggaugcccauccgcuaccaaacaaccgccgucaaauccgaacauacaggcaaggagauuguggaccugaugugccacgcgaccuuuacgaugcggcuccugagcccuguuagagugcccaauuauaacaugaucauuauggaugaggcccauuucacagacccuucuuccaucgcugcccggggauacauuagcacccgcgucggcaugggggaagcugccgccaucuuuaugaccgcuacacccccuggaucuguggaggcguucccgcagagcaaugccgugauccaggaugaagagagagacauucccgaacgguccuggaacucuggcuaugaguggaucaccgauuuuccugggaaaacagucugguucguucccagcauuaaguccggaaaugacaucgcuaacugucugcgcaaaaauggcaagagagugauucagcucucucggaagaccuucgauacggaguaccagaaaaccaagaacaacgacugggacuacguggucaccacagauaucagcgaaaugggggccaauuuuagagccgaccgcgugauugauccucggagaugccuuaaacccguuauccugaaggacggcccggagcgcgugauccuggcuggaccuaugcccgucaccguggccuccgcggcucagcggagaggccgcauugggcggaaccacaauaaagaaggagaucaguauaucuacaugggccagccccucaacaaugacgaggaucaugcccacuggacggaggccaagaugcugcuugacaacauuaauaccccugaagggaucauucccgcucuguucgagccugaaagagaaaagagcgccgcgaucgauggagaauaucgccucagaggcgaggcccggaaaacauuuguugagcugaugcgcagaggggaccugccgguguggcucucuuacaaggucgcuuccgaaggcuuccaauauagcgaucggcgcuggugcuuugacggagagagaaacaaucaggugcuugaagagaacauggaugucgaaaucuggaccaaagagggcgagcggaagaaacugagaccccgcuggcuggacgcccggacauacuccgacccucucgcucugagagaguucaaggaguuugccgcugggcgccggucugugagcggagaucuuauucuggaaaucggcaaacucccccagcaccugacccagagagcccaaaaugcgcuggacaaccucguuaugcuucauaauuccgagcaagggggacgggccuaucgccaggcuauggaggaacugccugauacaauugagacccugaugcuccuggcccuuaucgcugugcugacgggcggcgugacacucuucuuucugucugggagaggacugggcaagaccagcauugggcuccuuugugucauggccuccagcguucugcuguggauggccucuguggaaccccacuggaucgcugcguccaucauucucgaguucuuucugauggugcuucugaucccggaaccugaccggcagcgcacaccccaggauaaccagcucgccuacgucgugauuggacugcuguucaugauccucacaguugcugccaaugagaugggccuucuggagaccacaaagaaagaccuggggauuggacauguggccgucgaaaaccaccaccaugcugccaugcucgauguggaccugcacccugcgagcgccuggacgcuuuacgcugucgccaccacaaucauuacccccaugaugagacauacaaucgagaacaccacggcuaauaucucucugaccgccauugcgaaccaggccgcuauccucaugggccuggauaagggcuggccuauuuccaaaauggacaucggggugccccugcucgcccuuggaugcuauagccaaguuaauccgcugacacugaccgcugccgugcucaugcuggucgcucacuacgccauuaucggcccugggcuucaggcgaaggccacacgggaagcucagaaacgcaccgccgcuggaaucaugaagaaccccacgguggauggcauuguugccaucgaccuggaucccguggucuaugacgccaaguuugagaaacagcucgggcaaauuaugcugcugauccucuguacaucucagauucuucugaugagaaccacaugggcgcugugcgaaagcaucacccucgcuaccggaccucugacaacgcuuugggagggcuccccgggcaaguucuggaauaccacaaucgccgugucuauggcuaacauuuuccgggggagcuaccuggccggagccggccucgcuuuuucccugaugaaaagccucgggggaggccgcagagggaccggagcccagggcgagacacucggcgaaaaguggaaacggcagcuuaaucaacuguccaagucugaguucaacaccuauaagagaagcgggaucauggaaguggaccgcuccgaggcgaaagaaggacugaagcggggcgagacgacaaaacaugccguuucuagagggaccgcuaagcuccgcugguuugucgagcggaaucuggugaaacccgaaggaaaggugauugaucuuggcugugggagaggaggcuggagcuacuauugcgccggccugaagaaagucaccgagguuaagggguacacaaaaggaggcccugggcacgaggaacccaucccuauggcuaccuacggauggaaccucgugaagcugcacuccggcaaagacguguucuuuauucccccugaaaagugugauacacugcucugcgacaucggggagucuagcccgaaucccacgauugaggaaggacgcacccuucggguccugaaaaugguggagccuuggcugagaggcaaccaguucuguaucaagauccucaaucccuauaugccuuccguuguggaaacacuggagcagaugcagcgcaagcauggcgggaugcuuguccggaacccccugagcagaaauucuacccacgagauguacuggguguccugcggaacaggcaacauuguuagcgccgugaauaugaccucucgcaugcuccugaaccgguuuacgauggcgcauagaaaaccgaccuaugaacgcgaugucgaccugggggccggaacaagacacguggcuguggagccugaagucgccaaccucgauaucauuggccaacggaucgagaauauuaagcacgaacauaaauccaccuggcacuacgacgaggauaaccccuauaagacaugggcuuaccaugggagcuaugagguuaaacccucuggauccgccagcuccauggugaauggcguggucaagcugcuuaccaagccuugggacgugauccccaugguuacacagaucgcuaugaccgauacgacaccuuucggccagcaacgcguguuuaaagaaaaggucgacaccagaaccccgaaagccaagcgggggacagcgcagauuauggaggugacggccaaauggcuguggggauuccucagcagaaacaagaagccccggaucuguacccgcgaagaguuuacaagaaaaguucggucuaaugcugccauuggcgcuguguucgucgacgaaaaccaguggaauagcgccaaggaggccguggaggaugaacgcuuuugggaccugguucacagagagcgggaacuucauaaacaggggaagugcgcgaccugcguguacaacaugaugggaaaacgcgagaagaagcugggcgaguucgggaaagcuaagggcuccagagccaucugguacauguggcucggagcccgguuccuggaguuugaggcucugggcuucaugaaugaagaucacugguuuucucgcgagaacagccucuccggggucgaaggagagggccugcacaaacuuggguauauucugagagacaucucuaauaucccuggaggcaacauguacgccgaugacacagcugggugggauacccggauuacagaggacgaucuccaaaaugaagcccgcaucaccgacauuauggagcccgaacaugcgcugcuugccaagagcaucuucaaacugacguaucagaacaagguggucagagugcagcggccugcuaaaaauggcaccguuauggaugugauuucccgcagagaccagcggggaucuggccaagucgggacauacggacucaacaccuuuacaaacauggaggcccagcugaucagacagauggaaagcgagggcaucuucucccccagcgagcuggaaaccccgaaucucgcugagcgcgugcuggauuggcuugaaaaguaugggguggagcggcugaagagaauggccauuucuggagacgacuguguugugaaaccuaucgaugaccgcuuugcgacggcccucacagcucugaacgauaugggcaagguccggaaagacauuccccagugggaaccuuccaagggguggaaugauuggcaacaggugcccuucugcagccaccauuuucaccagcuuaucaugaaagacggcagagagauuguugugccuugucgcaaccaggaugagcuggucggacgggccagagugucucaaggcgcuggguggucccuccgcgaaaccgccugccugggaaagagcuacgcucagauguggcagcugauguauuuccaccggagagaccuccgccuggccgcgaaugccaucuguuccgcuguccccguggauuggauuccgacaucucggaccacguggagcauccaugcccaccaucaauggaugaccacagaggacaugcuuuccguuuggaacagaguguggaucgaagagaauccuuggauggaagauaagacccacauuagcucuuggggcgacguccccuaccuggggaaacgggaggaccaguggugcggaucccucaucggccugacagccagagcuaccugggccacaaacauucagguggcgaucaaucagguucgccggcuuauugggaacgagaauuaccuggauuauaugaccagcaugaagagauuuaaaaacgaaucugaccccgagggcgcucucugguga

SEQ ID NO: 18860 - RNA, 9879 nt, Artificial Sequence
  derived and/or modified CDS sequence (opt5) from DENV-1__FJ024441__SS-prME
agcgugaccaugcugcucaugcugaugcccaccgcccuugcuuuccaccugacgaccagaggaggggaaccucauaugauugucuccaagcaggaacggggaaagucucuccuguuuaagacaagcgccggcguuaacaugugcacccuuauugcgauggaccugggggagcucugugaagauaccaugaccuacaagugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggcggcagauucagcgcguugaaaccugggcccugagacaccccggcuucacagugaucgcucuuuuucuggcccaugcgauugggaccucuaucacccagaaaggaaucauuuucauccuccugaugcuugucacaccuagcauggccaugcggugcgugggcauugggucccgcgauuuuguugagggacugagcggcgcuacguggguggacgucgugcucgagcacgggucuugugugaccacaauggccaaggauaagcccacccuggacaucgaacugcucaaaacagaggucaccaacccugcuguucugagaaaacuuugcauugaagccaaaaucuccaauacgacaaccgauagccgguguccgacccaaggagaggcgacacugguggaagaacaggacgccaacuucgugugccgcagaaccuuugucgaucggggcuggggcaauggguguggacucuucggcaaggggucucugauuacaugcgcuaaauuuaagugcgugacgaaacuugagggaaaaaucguucaguacgaaaaccugaaguauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccgcacgggccucgacuucaacgaaauggugcugcuuacaaugaaagagaaguccuggcugguccauaaacagugguuucucgaucugccucuucccuggaccagcggggccuccacaucucaagagaccuggaauagacaggaccugcucgugaccuucaagacagcucacgcgaaaaagcaggaagucgugguucugggaagccaagagggcgccaugcacacggcucugaccggggccacagaaauucagaccuccggaacaaccacgaucuuugccggccaucucaagugccggcugaaaauggauaaacuuacacugaaagggaugagcuaugugauguguaccggcucuuucaagcucgagaaagaagucgcugagacccagcacggaacagugcugguucagauuaaguacgagggcaccgacgccccgugcaagaucccuuucuccacacaagaugaaaaaggggugacgcagaacggaagacugaucaccgcgaaucccauugucacagacaaggagaaaccugugaacaucgaagcugagccgcccuuuggcgagagcuauauuaccaucggggccggagaaaaggcccuuaaacucucuugguucaagaagggcagcuccauugggaaaauguuugaggcuacagcccgcggcgcucggagaauggccauccugggagauaccgcgugggacuucggcucuaucgggggaguguuuacgagcguuggcaagcugguccaucagauuuucgggaccgccuacggagugcucuuuuccggcgugagcuggacaaugaaaaucgggauuggcguccugcuuaccuggcugggacucaauucucgcuccacaagccugucuaugaccuguaucgcugugggccugguuacacuuuaccucggggugaugguccaggccgauuccggaugcgugauuaacuggaagggccgggaacugaaaugugggagcggaaucuucguuaccaaugaggugcacacguggacagaacaauauaaguuucaggcugacuccccuaagagacugucugccgcgauuggcaaagccugggaggagggggucugcggcauccgcagcgcuacccggcucgaaaacaucauguggaagcagauuuccaacgagcugaaucauauccuucuggaaaacgacaugaaauucaccgugguugugggagaugucgccggcauucucgcucaggggaagaaaaugaucagaccgcaacccauggaguacaaguauucuuggaaaagcuggggaaaggccaagauuaucggcgccgacgugcagaauacaaccuuuaucauugaugggccuaacacgcccgaauguccugacgaucagcgcgcuuggaauaucugggagguggaggacuacggauucggcauuuuuacaaccaacaucuggcugaaacugcgggauuccuauacacaggucugcgaccacagacuuaugagcgcggccauuaaggauucuaaagcuguucacgccgacaugggcuacuggaucgaauccgagaagaaugaaaccuggaaacucgcccgcgcuagcuucaucgaggugaagacauguguguggcccaagucucauacccugugguccaacgggguccuggaaagcgagaugauuaucccgaaaauuuauggaggcccuaucucucaacacaauuaccggcccggguacuucacgcagaccgccggaccuuggcaucucggcaagcuggagcuugauuuugaccugugcgaagggacaaccgugguuguggaugagcacugcggaaacagaggccccagccuccggacaaccacggucacaggcaaaauuauccacgaaugguguugccgcuccuguacccugccuccccugagauucagaggggaagacggaugcugguauggcauggagauccggccggugaaggaaaaagaggaaaaucuuguuaagagcauggugucugcgggguccggagaggucgacagcuuuucccucggccugcuguguauuucuaucaugauugaagaggugaugcgcagccggugguccagaaagaugcucaugacagggacccuggcuguuuucuuucuucugaucaugggacagcucaccuggaacgaucugauucgccugugcaucauggugggcgccaaugccucugacagaaugggcauggggacaacguaccuugcucugauggccaccuucaaaaugcggccuauguuugcggucggacuccuguuccgcagacucacaagccgggaggugcugcuucugaccauuggccucucccugguggcuucugucgaacugcccaacagccuugaggaacugggggauggacucgccaugggcaucaugauccugaagcuccugacagacuuucaaucccaucagcuuugggccacccugcucagccugacguucauuaaaacaaccuuuucucugcacuaugcuuggaagaccauggccaugguucuuuccaucgugagccuguucccccucugucugucuacaaccucccagaaaacaacguggcucccugugcugcuugggagccugggaugcaagccgcugaccauguuucucauugcugagaauaagaucuggggccgcagaucuuggccccugaacgaaggcauuauggccgucgggaucguguccauccuucugagcucccuccugaaaaacgauguuccucucgcgggaccccugauugccggcgggaugcuuaucgcuuguuacgugauuagcggaucuagcgccgaccugucccuggagaaggcugccgaggucucuugggaagaggaagccgagcauagcggcgcuucccacaauauccucguggaaguucaggaugacgggacaaugaaaauuaaggaugaggagcgggacgauacccugacaauccuucugaaagcgacccuccuggccgugucuggagucuauccucucagcauccccgcuacgcuguucgugugguacuucuggcaaaagaaaaagcagcgcuccggcguccuuugggacaccccuucucccccggaaguggagagagccguucuggaugacggcauuuaucggaucaugcagcgcgggcugcucggaagaagccaggugggcgucgggguguuucaagaaaacguuuuccauacaauguggcacgugacccggggagccguccugauguaccagggcaagagacuugagccuuccugggcuagcgugaaaaaggaccugauuucuuacgggggaggcuggcgccuccagggcuccuggaauacaggggaggaagugcagguuaucgccgucgagcccggcaagaacccuaagaaugugcaaaccgcgcccggcacauuuaaaacgccggaaggggaggugggagcuauugcccuggauuucaagccuggcaccagcgggucucccaucgucaaccgggaaggaaagauugugggccucuauggcaaugggguugugacaaccuccggaaccuacgucagcgccaucgcucaggccaaagcgucccaggagggcccucugcccgagaucgaagacgagguguuuagaaagcgcaaccuuacaauuauggaucugcaccccgggucuggaaaaacgcggagauaucugccugcuaucguucgcgaagccauuaagcggaaacucagaacccugauccuugccccgacacgcguggucgcuagcgagauggccgaagcucugaagggcaugcccauucgguaccaaaccacagccgugaaguccgagcauaccgggaaagagaucguugaccucaugugccacgcgacguucacaaugagacugcugagcccugugcggguccccaauuauaacaugaucauuauggaugaagcccauuuuaccgacccuucuuccaucgcugcccgcggcuacauuagcaccagagugggaaugggcgaggcugccgccaucuucaugacagcuacacccccugggucuguggaagcguuuccgcagagcaaugccgucauucaggaugaggaacgggacauccccgagcgcuccuggaacucuggauaugaguggaucacagauuucccuggcaagaccguuugguuugugcccagcauuaaauccgggaaugacaucgcuaacugucucagaaagaauggaaaacgggugauucagcuuucuagaaagacguucgauacagaauaccaaaagaccaaaaacaacgacugggacuacgucgugacaaccgauaucagcgagaugggcgccaauuuccgcgccgaccggguuauugauccuagacgcugccugaagcccgugauccugaaagacgggccggaacgggucauucucgcuggcccuaugcccgugacgguugccuccgcggcucagagacgcggacggaucggcagaaaccacaauaaggagggggaucaguauaucuacaugggacagccccugaacaaugacgaggaucaugcccacuggaccgaagccaaaaugcuucuggacaacauuaauacaccugagggcaucauucccgcucucuuugaaccugagcgcgaaaagagcgccgcgaucgauggggaguauagacugcggggagaggcccgcaagaccuucguggaacugaugagacggggcgaccucccggucuggcuuucuuacaaaguggcuuccgagggguuucaauauagcgaucgcagauggugcuucgacggcgaacggaacaaucagguccuggaggaaaacauggauguggagauuuggacaaaggagggagaacgcaagaagcugcgcccccgguggcucgacgccagaaccuacuccgacccucuggcucuuagagaguuuaaagaguucgccgcuggccggagaucuguuagcggggaucugauccucgagaucggaaagcugccccagcaccugacacagcgggcccaaaaugcgcucgacaaccuugugaugcugcauaauuccgaacagggcgggcgcgccuauagacacgcuauggaggagcugccugauaccauugaaacgcucaugcugcuugcccugaucgcugugcucacaggaggcgucacccuguuuuuccugucuggccgggggcucggaaaaaccagcauuggccuucuguguguuauggccuccagcgugcugcucuggauggccucuguggagccccauuggaucgcugcguccauuauccuggaauuuuuccuuaugguccugcucaucccggagccugaccgccagagaacaccccaggauaaccaacuggccuacgugguuauugggcugcucuuuaugauccuuaccguggcugccaaugagaugggacugcuggaaacaacgaagaaggaccucggcauugggcacgucgccguggagaaccaccaucacgcugccaugcuggaugucgaccuucauccugcgagcgccuggacccuguacgcuguggccacaaccaucauuacacccaugaugcggcacaccaucgaaaacacgaccgcuaauauuucucucacagccaucgcgaaccaggccgcuauccugaugggacuggauaaaggcuggccuauuuccaagauggacaucggcguuccccuccuugcccuggggugcuauagccaggugaauccgcugacccucacagcugccguccugaugcuuguggcucauuacgccauuaucggaccuggccugcaagcgaaagccacccgcgaggcucagaagagaacggccgcugggauuaugaaaaaccccacaguugauggaaucguggccaucgaccucgaucccgucguguaugacgccaaguucgaaaagcagcugggccagauuaugcugcucauccuuuguaccucucaaauucugcugaugcggacaaccugggcgcucugcgagagcaucacccuggcuacagggccucuuacgacccugugggagggauccccgggcaaauuuuggaauacaaccauugccgugucuauggcuaacaucuuccgcggcagcuaccucgccggggccggacuggcuuucucccugaugaaaagccucggcgggggaagacggggcacaggggcccagggagaaacccuuggcgagaaauggaagagacagcugaaucagcuguccaaaucugaauuuaacacguauaagcgcagcggcaucauggagguugaccgguccgaagcgaaggaggggcucaaaagaggagagacaaccaagcacgccgucucucgcggcaccgcuaaacugcggugguucguggaaagaaaucuugugaagcccgaggggaaagucauugaucugggauguggccgcgggggauggagcuacuauugcgccggccucaagaagguuacagaagugaaaggcuacaccaaaggcgggccugggcacgaggaacccaucccuauggcuacauacggguggaaccuggugaaacugcauuccggaaaggacgucuuuuucauucccccugagaaaugugauacgcuccuuugcgacaucggcgagucuagcccgaaucccaccauugaagaggggcggacacugagagugcugaagaugguugaaccuuggcuccgcggaaaccaauuuuguaucaaaauucugaaucccuauaugccuuccguggucgagacccuugagcagaugcagcggaagcacggcggcaugcuggugagaaacccccucagccgcaauucuacacaugaaauguacuggguuuccugcgggaccggaaacaucgugagcgccgucaauaugacgucucggaugcugcugaacagauucaccauggcgcaccgcaagccgacauaugagagagauguggaccucggcgccgggacccggcacguggcugucgaaccugagguugccaaccuggauaucauuggacagcgcaucgaaaauauuaaacaugagcacaaguccacauggcauuacgacgaggauaaccccuauaaaaccugggcuuaccacggcagcuaugaagugaagcccucuggguccgccagcuccauggugaauggagucgugaaacuucugacaaagccuugggacguuauccccauggugacccaaauugcuaugacggauacaaccccuuuuggccagcagagagucuucaaggagaaaguggacacccggacaccgaaggccaaaagaggcacggcgcaaaucauggaaguuaccgccaaguggcucuggggguuucugagccggaacaaaaagccccgcaucuguacaagagaggaguucacccggaaggugcgcucuaaugcugccauuggagcugucuuuguggacgagaaccaguggaauagcgccaaagaggccguugaagaugagagauucugggaccuugugcaucgggaacgcgagcugcacaagcagggcaaaugcgcgacaugcgucuacaacaugauggggaagagagagaagaagcucggagaguuuggcaaggcuaaagggucccgggccaucugguacauguggcugggcgcccgcuuccuggaguucgaagcucucggauuuaugaaugaggaucacugguucucuagagaaaacagccuguccggcguggagggggagggacuucauaagcugggcuauauucuccgggacaucucuaaaauuccugggggaaauauguacgccgaugacaccgcuggcugggauacacgcaucaccgaagacgaucugcagaacgaggccagaaucacggacauuauggaacccgagcacgcgcuucuggccaagagcaucuuuaaacucaccuaucaaaauaaggucgugcggguucagcgcccugcuaaaaacgggacagugauggaugucauuuccagacgggaccagagaggcucuggacaggugggcaccuacgggcugaauacauucaccaacauggaagcccaacugauccgccagauggagagcgagggaaucuuuucccccagcgaacucgagacgccgaaccuggcugaacgggugcuugauuggcuggagaaguauggcguugaaagacucaagcgcauggccaucucuggggacgacuguguggucaaaccuaucgaugaccgguucgcgacagcccugaccgcucuuaaugauaugggaaaggugagaaaagacauuccccagugggagccuuccaagggcuggaacgauuggcagcaaguucccuuuugcagccaucacuuccaccagcugaucaugaaagacgggcgcgagauuguggucccuugucggaaucaggaugaacucgugggcagagcccgcgucucucagggagcuggcuggucccugcgggagacagccugccugggaaagagcuacgcucaaauguggcagcucauguauuuucauagacgcgaccugcggcuugccgcgaacgccaucuguuccgcugugcccguugauuggauuccgaccucuagaacgaccuggagcauccacgcccaucaccaguggaugacaaccgaagacaugcuguccguguggaaucgggucuggauugaggaaaacccuuggauggaggauaagacacauaucagcucuuggggagacgugcccuaccucggcaaaagagaggaccaauggugcgggucccugaucggacuuaccgcccgcgcuacaugggccaccaauauucagguugcgaucaaccaggugcggagacugauuggcaaugaaaacuaccucgauuauaugacgagcaugaagcgcuucaaaaaugagucugaccccgaaggggcucugugguga

SEQ ID NO: 18861 - RNA, 9879 nt, Artificial Sequence
  derived and/or modified CDS sequence (opt5) from DENV-1__FJ024442__SS-prME
agcgugaccaugcugcucaugcugaugcccaccgcccuugcuuuccaccugacgaccagaggcggggaaccucauaugaucguguccaagcaggaacggggaaaaucucuccuguuuaagacaagcgccggcguuaacaugugcacccuuauugcgauggaccugggggaacucugugaagauacaaugaccuacaaaugccccagaaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauuaucauuggggccggagaaaaagcccuuaagcucucuugguucaagaaaggcagcuccaucgggaagauguuugaggcuaccgccagaggcgcucgccggauggccauccugggagauacagcgugggacuucggcucuauugggggaguguuuaccagcguuggcaaacugguccaucagaucuucgggacggccuacggagugcucuuuuccggcgugagcuggaccaugaagauugggaucggcguccugcuuacauggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcugucugccgcgaucggcaaggccugggaggagggggucugcggcaucagaagcgcuacacgccucgaaaacauuauguggaaacagaucuccaacgagcugaaucauauucuucuggaaaacgacaugaaguucaccgugguugugggagaugucgccggcauccucgcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaagcugcgcgauuccuauacccaggucugcgaccaccggcuuaugagcgcggccaucaaagauucuaaggcuguucacgccgacaugggcuacuggaucgaauccgagaaaaaugaaacauggaagcucgccagagcuagcuucauugaggugaagaccuguaucuggcccaaaucucauacacugugguccaacggggugcuggaaagcgagaugauuaucccgaagauuuauggaggcccuaucucucaacacaauuaccgccccggguacuucacccagacggccggaccuuggcaucucggcaaacuggagcuugauuuuaaccugugcgaagggaccacagucgugguugacgagcacugcggaaaucggggccccagccucagaaccacaaccgugacgggcaagaucauucacgaaugguguugccgguccuguacacugccuccccugcgcuucagaggggaggauggaugcugguauggcauggagauccggccggucaaagaaaaggaggaaaaccuugucaagagcaugguuucugcgggguccggagagguggacagcuuuucccucggccugcuguguauuucuaucaugauugaagaggucaugagaagccgcuggucccggaaaaugcucaugaccgggacacuggcuguguucuuucuucugaucaugggacagcucaccuggaaugaccugauuagacugugcaucaugguuggcgccaacgccucugaucgcaugggcauggggaccacauaccuugcucugauggccacguucaagaugagaccuauguuugcggugggacuccuguuccggcgccucaccagcagagagguccugcuucugacaaucggccucucccugguggcuucuguggaacugcccaauagccuugaggaacugggggacggacucgccaugggcauuaugauccugaaacuccugaccgauuuucaaucccaucagcuuugggccacacugcucagccugaccuucauuaagacgacauuuucucugcacuaugcuuggaaaaccauggccaugguccuuuccaucguuagccuguucccccucugucugucuaccacaucccagaagaccacauggcucccugugcugcuugggagccugggaugcaagccgcugacgauguuucucauugcugagaacaaaaucuggggccggcgcucuuggccccugaacgaaggcaucauggccguggggauugucuccauccuucugagcucccuccugaagaaugacgugccucucgcgggaccccugauugccggcgggaugcuuaucgcuuguuacguuauuagcggaucuagcgccgaucugucccuggagaaagcugccgaggugucuugggaagaggaagccgagcauagcggcgcuucccacaacauccucgucgaagugcaggacgaugggaccaugaagaucaaagacgaggagagagaugacacacugaccauucuucugaaggcgacacuccuggccguuucuggaguguauccucucagcauccccgcuacccuguucgucugguacuucuggcagaagaagaagcagcgguccggcgugcuuugggauacgccuucucccccggaagucgagcgcgccgugcuggacgauggcauuuauagaaucaugcagcgggggcugcucggacgcagccagguuggcgugggggucuuucaagaaaauguguuccauaccauguggcacguuacaagaggagccgugcugauguaccagggcaaacggcuugagccuuccugggcuagcgucaagaaagaccugauuucuuacgggggaggcuggagacuccagggcuccuggaacaccggggaggaaguccaggugaucgccguugagcccggaaagaauccuaaaaacguccaaacagcgcccggcaccuuuaagacaccggaaggggaggugggagcuauugcccuggacuucaagccuggcacgagcgggucucccaucgugaaucgcgaaggacggaucgucggccucuauggcaacggggugguuaccacauccggaaccuacgugagcgccauugcucaggccaaagcgucccaggagggcccucugcccgagaucgaagaugaggucuuuagaaagcgcaaucuuaccauuauggaccugcaccccgggucuggaaaaacacggagauaucugccugcuaucgugcgcgaagccauuaagcggaaacucagaacgcugauccuugccccgacccgcguuguggcuagcgagauggccgaagcucugaagggcaugcccauccgguaccaaacaaccgccgucaaguccgagcauacagggaaagagauuguggaucucaugugccacgcgaccuucacgaugagacugcugagcccuguucgggugcccaacuauaauaugaucauuauggacgaagcccauuuuacagauccuucuuccaucgcugcccgcggcuacauuagcaccagagucggaaugggcgaggcugccgccaucuucaugaccgcuacacccccugggucuguggaagcguuuccgcagagcaacgccgugauccaggacgaggaacgggauauucccgagcgcuccuggaaucucggauaugaguggaucaccgacuucccuggcaagacagucugguuuguucccucuauuaaaagcgggaacgauaucgcuaauugucuuagaaagaacggaaaacgggugauucagcuguccagaaagaccuucgacacggaauaccaaaagaccaaaaacaaugauugggacuacguggucaccacagacaucucugagaugggcgccaacuuccgcgccgaucgggugauugacccuagacgcugccugaagcccguuauccucaaagaugggccggaacgggugauccuggcuggcccuaugcccgucaccguggccagcgcggcucagagacgcggacggauuggcagaaaucacaacaaggagggggaccaguauaucuacaugggacagccccuuaauaacgaugaggaccaugcccacuggacggaagccaaaaugcugcucgauaauauuaacaccccugagggcaucauucccgcucuguuugaaccugagcgcgaaaaguccgccgcgaucgacggggaguauagacugcggggagaggcccgcaagacauucguugaacucaugagacggggcgaucuuccgguguggcugagcuacaaagucgcuucugagggguuucaauauuccgaccgcagauggugcuucgauggcgaacggaauaaccaggugcuggaggaaaauauggacgucgagaucuggaccaaggagggagaacgcaaaaagcuccgcccccgguggcuggaugccagaacauacagcgacccucuugcucugcgcgaguuuaaagaguucgccgcuggccggagauccgugucuggggaccucauucuggagaucggaaagcugccccagcaccucacccagcgggcccaaaacgcgcuugauaaucugguuaugcugcauaacagcgaacagggcgggcgcgccuauagacacgcuauggaggagcucccugacacaauugaaacccugaugcuucuggcccucaucgcugugcugacgggaggcgugacacuguuuuuccucuccggccgggggcuuggaaaaaccucuauuggccugcugugugucauggccagcuccguucuccuguggauggccagcguggagccccauuggaucgcugcgucuaucauucuugaauuuuuccugauggugcuccugaucccggagccugaucgccagagaacaccccaggacaaucaacuggccuacgucgugauugggcuccuuuuuaugauccugacaguugcugccaacgagaugggacugcucgaaaccacaaagaaggaucugggcauugggcacguggccgucgagaaccaccaucacgcugccaugcuugacguggaucugcauccugcguccgccuggacgcucuacgcugucgccaccacaaucauuacccccaugaugcggcacacaaucgaaaauaccacggcuaacaucagccugaccgccauugcgaaucaggccgcuauccugaugggacucgacaaaggcuggccuauuucuaagauggauaucggcgugccccuucuggcccuggggugcuauucccagguuaacccgcucacacugaccgcugccgugcuuaugcuggucgcucauuacgccauuaucggaccuggccuccaagcgaaagccacacgcgaggcucagaagagaaccgccgcugggaucaugaaaaaucccacgguggacggaauuguugccaucgaucuggaccccguggucuaugaugccaaguucgaaaagcagcugggccagauuaugcuccuuauccuguguacaagccaaauucugcucaugcggaccacaugggcgcugugcgagucuaucacccuugcuaccgggccucugacaacgcucugggagggaagcccgggcaaauuuuggaacaccacaaucgccguguccauggcuaauauuuuccgcggcucuuaccuggccggggccggacuggcuuucagccucaugaagucccuuggcgggggaagacggggcaccggggcccagggagaaacacugggcgagaaauggaagagacagcugaaccagcucagcaaauccgaauuuaauaccuauaagcgcucuggcaucauggagguggaccggagcgaagcgaaggaggggcugaaaagaggagagacgacaaagcacgccguuucccgcggcaccgcuaaacuucggugguucgucgaaagaaaccuggugaagcccgaggggaaagugauugaccucggauguggccgcgggggauggucuuacuauugcgccggccugaagaaggucaccgaaguuaaaggcuacacaaaagggggaccuggccacgaggaacccaucccuauggcuaccuacggguggaaucuggugaaacuccauagcggaaaggauguguuuuucauucccccugagaaaugugacacacuucugugcgauaucggcgaguccucuccgaaccccacgauugaagaggggcggacccugagaguccucaagaugguggaaccuuggcugcgcggaaaucaauuuuguaucaaaauccuuaaccccuauaugccuagcguuguggagacacuggagcagaugcagcggaagcacggcggcaugcucgucagaaauccccugucccgcaacagcacccaugaaauguacugggugucuugcgggacaggaaauauuguuuccgccgugaacaugaccagccggaugcugcucaacagauucacgauggcgcaccgcaagccgaccuaugagagagacgucgaucugggcgccgggacacggcacguggcuguggaaccugaggucgccaaucuugacaucauuggacagcgcaucgaaaacauuaaacaugagcacaagucuaccuggcauuacgaugaggacaaucccuauaaaacaugggcuuaccacggcuccuaugaaguuaagcccagcgggucugccuccagcauggugaacggaguggucaaacugcucaccaagccuugggaugugauccccaugguuacacaaaucgcuaugaccgacacgacaccuuuuggccagcagagaguguucaaggagaaagucgauacccggaccccgaaggccaaaagaggcacagcgcaaauuauggaagugacggccaaguggcuguggggguuucuuucccggaauaaaaagccccgcaucuguaccagagaggaguucacacggaagguucgcagcaacgcugccauuggagcuguguuugucgacgagaaucaguggaacucugccaaagaggccguggaagacgagagauucugggaucugguucaucgggaacgcgagcuccacaagcagggcaaaugcgcgaccugcguguacaauaugauggggaagagagagaaaaagcugggagaguuuggcaaggcuaaagggagccgggccaucugguacauguggcugggcgcccgcuuccucgaguucgaagcucugggauuuaugaacgaggaccacugguucuccagagaaaauucucuuagcggcgucgagggggagggacugcauaagcucggcuauauucugcgggauaucuccaaaaucccugggggaaacauguacgccgacgauacagcuggcugggacacccgcauuacagaagaugaccuucagaaugaggccagaaucaccgauauuauggaacccgagcacgcgcugcucgccaagucuaucuuuaaacugacguaucaaaacaaggugguccgggugcagcgcccugcuaaaaaugggaccguuauggacgugauuagcagacgggaucagagaggcuccggacaggucggcacauacgggcugaacaccuucacaaacauggaagcccaacucauccgccagauggagucugagggaaucuuuagccccuccgaacuggagaccccgaaucuugcugaacgggugcuggacuggcucgagaaguauggcguggaaagacugaagcgcauggccauuagcggggaugacuguguugugaaaccuaucgacgaucgguucgcgacggcccuuacagcucugaacgacaugggaaaggucagaaaagauauuccccagugggagccuucuaagggcuggaaugacuggcagcaagugcccuuuugcucccaucacuuccaccagcucaucaugaaagaugggcgcgagauuguugugccuugucggaaccaggacgaacuggucggcagagcccgcgugagccagggagcuggcuggucucugcgggagaccgccugccucgggaaguccuacgcucaaauguggcagcugauguauuuucauagacgcgaucuucggcuggccgcgaaugccaucuguagcgcuguccccguggacuggauuccgacauccagaaccacguggucuauccacgcccaucaccaguggaugaccacagaagauaugcucagcguuuggaaccggguguggaucgaggaaaauccuuggauggaggacaagacccauauuuccagcuggggagauguccccuaccugggcaaaagagaggaccaauggugcgggucucuuaucggacugacagcccgcgcuaccugggccacaaacauucagguggcgaucaaucagguucggagacucauuggcaacgaaaauuaccuggacuauaugaccuccaugaagcgcuucaaaaacgagggggaucccgaaggcgcucugugguga

SEQ ID NO: 18862 - RNA, 9879 nt, Artificial Sequence
  derived and/or modified CDS sequence (opt5) from DENV-1__FJ373296__SS-prME
agcgugaccaugcugcucaugcugaugcccaucgcccuugcuuuccaccugacgacgagaggaggggaaccucauaugauugucuccaagcaggaacggggaaaaucucuccuguuuaagaccagcgccggcguuaacaugugcacccuuaucgcgauggaccugggggaacucugugaagauaccaugacauacaaaugcccccgcauuaccgaagcugaacccgacgauguggacuguuggugcaaugccacagauaccugggugacguauggaaccuguucccaaacaggcgagcacagacgggacaagcgcucugucgcccuggcuccucauguggggcugggacucgagaccagaacagaaaccuggaugagcuccgagggcgccuggaaacagauccagcggguugaaacgugggcucugcgccaccccggcuucacagugauugcccuuuuucuggcgcaugccaucgggaccucuaucacacagaagggaauuaucuucauucuccugaugcuugucaccccuagcauggcuaugagaugcgugggcaucgggucccgggauuuuguugagggacugagcggcgccaccuggguggacgucgugcucgagcacgggucuugugugacaacgauggcuaaggauaaacccacccuggacauugaacugcucaagacagaggucaccaacccugccguucugcgcaaacuuugcaucgaagcgaagauuuccaauacaaccacggauagcagauguccgacacaaggagaggccacccugguggaagaacaggacgcuaacuucgugugccggcgcaccuuugucgauagaggcuggggcaauggguguggacucuucggcaaagggucucugaucacaugcgccaaguuuaagugcgugaccaaacuugagggaaagaucguucaguacgaaaaccugaaauauuccgugauugucacagugcacacgggcgaccagcaucaaguugggaaugagagcaccgaacacggaacaaccgcuacaaucacaccccaggccccuacgaccgagauucagcucacagacuacggcgcccugacccuggauuguucuccccggacaggccucgacuucaacgaaauggugcugcuuaccaugaaggagaaauccuggcugguccauaagcagugguuucucgaucugccucuucccuggacgagcggggcuuccacaucucaagagaccuggaaucgccaggaccugcucgugacauucaaaaccgcgcacgccaagaagcaggaagucgugguucugggaagccaagagggcgcuaugcacaccgcccugacaggggccacggaaauccagaccuccggaacaaccacaauuuuugcuggccaucucaaaugcagacugaagauggauaaacuuacccugaaggggaugagcuaugugauguguacgggcucuuucaaacucgagaaggaagucgccgagacacagcacggaaccgugcugguucagaucaaguacgagggcaccgacgcgccgugcaaaaucccuuucuccacacaagaugaaaagggggcuacccagaacggacggcugauuacagccaaucccaucgugacggacaaagagaagccugucaacauugaagccgagccgcccuuuggcgagagcuauaucgugauuggggcuggagaaaaagcccuuaagcucucuugguucaagaaaggcagcuccaucgggaagauguuugaggcuaccgccagaggcgcgcgccggauggccauccugggagauacagcuugggacuucggcucuauugggggaguguuuaccagcguuggcaaacugguccaucagaucuucgggacagccuacggagugcucuuuuccggcgugagcuggaccaugaagauugggaucggcguccugcuuacguggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacagaacaauauaaguuucaggcggacuccccuaaacggcugucugccgcuaucggcaaggccugggaggagggggucugcggcaucagaagcgcuacccgccucgaaaacauuauguggaaacagaucuccaacgagcugaaucauauucuucuggaaaacgacaugaagcucacggugguugugggagaugucgccggcauccuggggcagggcaagaagaugauucggccgcaacccauggaguacaaauauucuuggaaaagcuggggcaaggccaagaucaucggggcugacgcgcagaauacaaccuucauuaucgauggaccuaacacccccgaauguccugacgaucagagagccuggaauauuugggagguggaggacuacggcuuuggcaucuucacaaccaacauuuggcugaaacuucgcgauuccuauacacaggugugcgaccaccggcucaugagcgcugccaucaaagauucuaaggccguccacgcugacaugggguacuggaucgaauccgagaaaaaugaaacauggaagcuggccagagcgagcuuuauugagguuaagaccuguaucuggcccaaaucucauacacugugguccaacggagugcucgaaagcgagaugauuaucccgaagauuuauggcgggccuaucucucaacacaauuaccgccccggauacuucacccagacagcuggcccuuggcaucuggggaaacuugagcuggauuucgaccucugcgaaggaaccacgguggucguggaugagcacugcggcaaccggggccccagccugagaaccacaaccguuacagggaagaucauucacgaaugguguugccgguccuguacccugccuccccuucgcuuuagaggagaggacggcugcugguaugggauggagauccggccggugaaagaaaaggaggaaaaucucgucaagagcauggugucugccggauccggcgagguugacagcuucucccuggggcugcucuguauuucuaucaugauugaagaggugaugagaagccgcuggucccggaaaaugcugaugacgggaacacuugccgucuuuuuccugcucaucaugggccagcugaccuggaacgaucugauuagacuuugcaucauggugggcgcuaaugccucugaccgcauggggaugggaacaaccuaccuggcgcucauggcuaccuuuaagaugagaccuauguucgccguuggccugcucuuucggcgccugacaagcagagaggugcuucugcucacgaucgggcugucccuggucgccucuguggaacuucccaacagccuggaggaacucggagauggccuggcuauggggauuaugauccucaaacugcuuaccgacuuccaaucccaucagcugugggccacacuccugagccugaccuuuauuaagacaaccuucucucuucacuaugcuuggaaaacgauggccauggugcuguccaucgucagccucuuuccccugugucucucuacaaccucccagaagaccacauggcugccuguucuucugggaagccugggcugcaagccgcucaccauguuccugauugcggagaauaaaaucuggggccggaagucuuggccccuuaacgaagggaucauggccgugggaauuguguccauccugcucagcucccugcucaaaaacgaugucccucuggcuggcccccuuauugccgggggaaugcugaucgcuuguuacgugauuagcggcucuagcgccgaccugucccucgagaaggccgcugagguuucuugggaagaggaagcggagcauagcggggccucccacaauauccugguggaaguccaggaugacggaacaaugaaaaucaaggaugaggagcgcgacgauacgcuuaccauucugcucaaagcuacacugcucgccgugucuggcguuuauccucugagcauccccgccacccuuuuugugugguacuucuggcaaaagaagaaacagagauccggcguccugugggacacaccuucucccccggaaguggagcgggcuguccuggaugacgggauuuaucgcaucaugcagagaggacuccugggccggagccagguggggguuggaguguuccaagaaaacgucuuucauaccauguggcacgugacgcgcggcgccguucuuauguaccaggggaagagacuggagccuuccugggcgagcgugaaaaaggaccucauuucuuacggaggcggcuggcggcugagaggguccuggaauaccggagaggaaguccaggugaucgcuguggagcccggcaaaaacccuaagaauguucagacagcccccgggaccuucaagacaccggaaggagaggucggcgccauugcucucgauuuuaaaccugggaccagcggaucucccaucgugaaccgcgaaggcaagaucgugggccuguaugggaauggagucgugacaacguccggcaccuacguuagcgccauugcgcaagcuaaagccucccaggaggggccucuucccgagaucgaagacgagguguuccggaagagaaaccugacaauuauggaucugcaccccggaucuggcaaaacccgccgguaucucccugccaucgucagagaagcuauuaagcgcaagcugcggacccuuauccuggccccgacaagagugguugcuagcgagauggccgaagcgcucaaagggaugcccauccgcuaccagacgaccgccgugaaguccgagcauacaggcaaagagauugucgaccugaugugccacgcuaccuuuacaaugcggcugcucagcccugugagaguucccaauuauaacaugaucauuauggaugaagcccauuucaccgacccuucuuccaucgcugcccggggauacauuagcacgcgcgugggcaugggggaggccgcugcgaucuuuaugacagccacacccccuggaucugucgaggcuuucccgcaaagcaaugccgugauccaggaugaggaaagagacauucccgagcgguccuggaacucuggcuaugaguggaucaccgauuuuccugggaagacagugugguucguccccagcauuaaauccggaaaugacaucgccaacugucuucgcaagaauggcaagagaguuauucagcugucucggaaaaccuuugauacagaauaccagaagaccaaaaacaacgacugggacuacguggugacgacagauaucagcgagaugggggcuaauuucagagccgaccgcgucauugauccucggagaugccugaagcccgugauccucaaagacggcccggaacgcguuauccuggcgggaccuaugcccgugaccgucgcuuccgccgcccaacggagaggccgcauugggcggaaccacaauaaggagggagaucaguauaucuacaugggccagccccuuaacaaugacgaggaucaugcucacuggacagaagccaagaugcugcucgacaacauuaauaccccugaggggaucauucccgcgcuguucgaaccugagagagaaaagagcgccgcuguggauggagaguaucgccugagaggcgaggcccggaagacguuuguugagcucaugcgcagaggggaccuuccgguguggcugucuuacaaagucgcuuccgagggcuuccaguauagcgaucggcgcuggugcuuugacggagaaagaaacaaucaagugcuggaggaaaacauggaugucgagaucuggaccaaggagggcgaacggaaaaagcucagaccccgcuggcuggacgcccggacauacuccgacccucuugcucugagagaguucaaagaauuugccgcggggcgccggucugugagcggagaucucauccuggagauuggcaagcugccccagcaccucacccagagagcccagaaugcucuugacaaccugguuaugcugcauaauuccgaacaagggggacgggccuaucgccacgcuauggaggagcucccugauacaaucgaaacccugaugcuucuggcccucauugccgugcugacaggcggcgugacccuguucuuucucucugggagaggacuuggcaagacgagcaucgggcugcugugugucauggcuuccagcguucuccuguggauggcgucuguggagccccauuggauugccgcuuccaucauccuugaguucuuucugauggugcuccugauuccggagccugaccggcagcgcacaccccaggauaaccagcuggccuacgucgugaucggacuccuuuucaugauucugaccguugccgcuaaugagaugggccugcucgaaaccaccaaaaaggaccuggggaucggacacguggccgucgagaaccaccaucacgcggccaugcuugauguggaccugcauccugcuagcgccuggacccucuacgcugucgccacaacgauuaucacccccaugaugagacacacaauugaaaacaccacagcgaauaucucucugaccgccaucgcuaaccaagccgcuauucugaugggccucgauaaaggcuggccuaucuccaagauggacauuggggugccccuucuggcccugggaugcuauagccagguuaauccgcucacgcugaccgcugccgugcuuaugcuggucgcgcauuacgccaucauuggcccugggcuccaggcuaaagccacacgggaggcucaaaagcgcaccgccgccggaaucaugaagaaccccacaguggauggcaucguugcgauugaccuggaucccguggucuaugacgcuaaauuugaaaagcagcuggggcagaucaugcuccuuauucuguguaccucucagauccugcucaugagaacgacaugggcccugugcgagagcauuacccuugcuacaggaccucugaccacccucugggagggcuccccgggcaaauucuggaauacaacgaucgccgugucuauggccaacaucuuucgggggagcuaccuggcuggagccggccuggcguucucccucaugaaaagccuugggggaggccgcagagggaccggagcccaaggcgaaacacugggcgagaaauggaagcggcagcugaaucagcucuccaagucugaguucaacaccuauaaaagaagcgggauuauggagguggaccgcuccgaagcuaaggagggacugaaacggggcgagacaaccaagcacgccguuucuagagggacggcuaaacuucgcugguuugucgaacggaaucuggugaagcccgagggaaaggugaucgaucucggcugugggagaggaggcuggagcuacuauugcgccggccugaaaaaggucacagaaguuaaaggguacaccaagggaggcccugggcacgaggaacccauuccuauggcgaccuacggauggaaccuggugaaacuccauuccggcaaggacguguucuuuauucccccugagaaaugugauacacuucugugcgacaucggggagucuagcccgaaucccaccaucgaagagggacgcacacugcggguccucaagaugguggaaccuuggcugagaggcaaccaguucuguauuaagauccuuaaucccuauaugccuuccguuguggagacgcuggagcaaaugcagcgcaaacacggcgggaugcucguccggaacccccugagcagaaauucuacccaugaaauguacuggguguccugcggaacaggcaacaucguuagcgccgugaauaugaccucucgcaugcugcucaaccgguuuacaauggcucacagaaagccgaccuaugagcgcgaugucgaccuggggacgggaaccagacacguggccguggaaccugaggucgcuaaccuugauauuaucggccagcggauugaaaauaucaaacaugagcacaaguccacauggcauuacgacgaggauaaccccuauaaaaccugggccuaccacgggagcuaugaaguuaagcccucuggauccgcuagcuccauggugaauggcguggucaagcugcucacaaaaccuugggacgugauucccaugguuacccagaucgccaugacagauaccacgccuuucggccaacagcgcguguuuaaggagaaagucgacacaagaaccccgaaggcgaaacgggggaccgcccagaucauggaagugacagcuagauggcuguggggauuccuuagccggaacaagaagccccgcauuuguacgagagaggaauuuacccggaaaguucgcucuaaugccgcuaucggcgccguguucgucgacgagaaccaauggaauagcgccaaggaggcgguggaagaugagagauuuugggaccugguucaucgggaacgcgagcuccacaaacaggggaagugcgcuacaugcguguacaacaugaugggaaaaagagaaaagaagcugggcgaguucgggaaagccaagggcucccgggccauuugguacauguggcugggagcucgcuuucucgaguucgaagcccugggcuucaugaaugaggaucacugguuuucuagagaaaacagccuuuccggggucgagggagagggccugcauaaacucggguauauccugcgggacauuucuaagaucccuggaggcaauauguacgcugaugacaccgccgggugggauacacgcaucaccgaagacgaucuucagaacgaggcgaaaauuacagacaucauggaacccgagcacgcccugcucgcuaaggccauuuucaaacugaccuaucagaauaagguggucagagugcaacggccugcuaagaacggcacgguuauggaugugaucagccgcagagaccagcggggauccggccaggucgggaccuacggacugaauacauuuaccaacauggaagcccagcucauuagacaaauggagucugagggcaucuucagccccuccgaacuggagacaccgaaccuugcggaacgcgcccuggauuggcucgagaaauaugggguggaacggcugaagagaauggcuaucagcggagacgacugugugguuaaaccuauugaugaccgcuuugccaccgcucuuacggcccugaaugauaugggcaaggugcggaaagacaucccccagugggagccuucuaagggguggaacgauuggcagcagguccccuucugcucccaucacuuucaccaacucauuaugaaggacggcagagagaucgugguuccuugucgcaaucaggaugaacuggugggacgggcuagagucagccagggcgccggguggucucugcgcgagacagcgugccucggaaaauccuacgcccagauguggcaacugauguauuuccaucggagagaccuucgccuggcugccaacgccauuuguagcgcugugcccgucgauugggugccgaccucccggacaaccuggucuauccacgcccaucaccaguggaugacgaccgaagacaugcucagcguuuggaauagaguguggauugaggaaaacccuuggauggaggauaagacacauaucuccagcugggaggacguccccuaccugggcaaacgggaagaccaguggugcgggucucuuaucggacugaccgcgagagcuacaugggccaccaauauucaaguggccaucaaccagguucgccggcucauuggcaaugagaacuaccuggauuauaugacauccaugaagagauuuaaaaaugaaagcgaccccgagggggcucugugguga

SEQ ID NO: 18863 - RNA, 9879 nt, Artificial Sequence
  derived and/or modified CDS sequence (opt5) from DENV-1__FJ182018__SS-prME
agcgugaccaugcugcucaugcugaugcccacagcccuugcuuuccaccugacgaccagaggcggggaaccucauaugaucguguccaagcaggaacgggggaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauuaucauuggggccggagaaaaagcccuuaagcucucuugguucaagaaaggcagcuccaucgggaagauguuugaggcuaccgccagaggcgcucgccggauggccauccugggagauacagcgugggacuucggcucuauugggggaguguuuaccagcguuggcaaacugguccaucagaucuucgggacggccuacggagugcucuuuuccggcgugagcuggaccaugaagauugggaucggcguccugcuuacauggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcugucugccgcgaucggcaaggccugggaggagggggucugcggcaucagaagcgcuacacgccucgaaaacauuauguggaaacagaucuccaacgagcugaaucauauucuucuggaaaacgacaugaaguucaccgugguugugggagaugucgccggcauccucgcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaagcugcgcgauucccacacccaggucugcgaccaccggcuuaugagcgcggccaucaaagauucuaaggcuguucaugccgacaugggcuauuggaucgaauccgagaaaaaugaaacauggaagcucgccagagcuagcuucauugaggugaagaccuguaucuggcccaaaucucacacacugugguccaacggggugcuggaaagcgagaugauuaucccgaagauuuacggaggcccuaucucucaacauaauuaucgccccggguacuucacccagacggccggaccuuggcaccucggcaaacuggagcuugauuuugaccugugcgaagggaccacagucgugguugaugagcacugcggaaaccggggccccagccucagaaccacaaccgugacgggcaagaucauucaugaaugguguugccgguccuguacacugccuccccugcgcuucagaggggaggacggaugcugguacggcauggagauccggccggucaaagaaaaggaggaaaaucuugucaagagcaugguuucugcgggguccggagagguggacagcuuuucccucggccugcuguguauuucuaucaugauugaagaggucaugagaagccgcuggucccggaaaaugcucaugaccgggacacuggcuguguucuuucuucugaucaugggacagcucaccuggaacgaucugauuagacugugcaucaugguuggcgccaaugccucugaccgcaugggcauggggaccacauaucuugcucugauggccacguucaagaugagaccuauguuugcggugggacuccuguuccggcgccucaccagcagagagguccugcuucugacaaucggccucucccugguggcuucuguggaacugcccaacagccuugaggaacugggggauggacucgccaugggcauuaugauccugaaacuccugaccgacuuucaaucccaccagcuuugggccacacugcucagccugaccuucauuaagacgacauuuucucugcauuacgcuuggaaaaccauggccaugguccuuuccaucguuagccuguucccccucugucugucuaccacaucccagaagaccacauggcucccugugcugcuugggagccugggaugcaagccgcugacgauguuucucauugcugagaauaaaaucuggggccggcgcucuuggccccugaacgaaggcaucauggccguggggauugucuccauccuucugagcucccuccugaagaacgaugugccucucgcgggaccccugauugccggcgggaugcuuaucgcuuguuauguuauuagcggaucuagcgccgaccugucccuggagaaagcugccgaggugucuugggaagaggaagccgagcacagcggcgcuucccauaauauccucgucgaagugcaggaugacgggaccaugaagaucaaagaugaggagagagacgauacacugaccauucuucugaaggcgacacuccuggccguuucuggaguguacccucucagcauccccgcuacccuguucgucugguauuucuggcagaagaagaagcagcgguccggcgugcuuugggacacgccuucucccccggaagucgagcgcgccgugcuggaugacggcauuuacagaaucaugcagcgggggcugcucggacgcagccagguuggcgugggggucuuucaagaaaacguguuccacaccauguggcacguuacaagaggagccgugcugauguaucagggcaaacggcuugagccuuccugggcuagcgucaagaaagaccugauuucuuacgggggaggcuggagacuccagggcuccuggaauaccggggaggaaguccaggugaucgccguugagcccggaaagaacccuaaaaauguccaaacagcgcccggcaccuuuaagacaccggaaggggaggugggagcuauugcccuggauuucaagccuggcacgagcgggucucccaucgugaaccgcgaaggaaaaaucgucggccucuacggcaauggggugguuaccacauccggaaccuaugugagcgccauugcucaggccaaggcgucccaggagggcccucugcccgagaucgaagacgaggucuuucggaaaagaaaccuuaccauuauggaucugcaucccgggucuggaaagacacgccgguaccugccugcuaucgugagagaagccauuaaacgcaagcuccggacgcugauccuugccccgaccagaguuguggcuagcgagauggccgaagcucugaagggcaugcccauccgcuaucaaacaaccgccgucaaauccgagcacacagggaaggagauuguggaccucaugugccaugcgaccuucacgaugcggcugcugagcccuguuagagugcccaauuacaacaugaucauuauggaugaagcccacuuuacagacccuucuuccaucgcugcccggggcuauauuagcacccgcgucggaaugggcgaggcugccgccaucuucaugaccgcuacacccccugggucuguggaagcguuuccgcagagcaaugccaucauucaggaugaggaaagagacauccccgagcgguccuggaacucuggauacgaguggauuaccgauuucccuggcaaaacagugugguuuguccccagcaucaaguccgggaaugacauugcuaacugucuccgcaaaaauggaaagagaguuauccagcuuucucggaagaccuucgauacggaauaucagaaaaccaagaacaacgacugggacuacguggugaccacagauauuagcgagaugggcgccaauuucagagccgaccgcgucaucgauccucggagaugccugaaacccgugauccugaaggacgggccggaacgcguuauucucgcuggcccuaugcccgugaccgucgccuccgcggcucagcggagaggacgcaucggccggaaccauaauaaagagggggaucaguacauuuauaugggacagccccugaacaaugacgaggaucacgcccacuggacggaagccaagaugcuucuggacaacaucaauaccccugagggcauuauccccgcucucuuugaaccugagagagaaaagagcgccgcgaucgauggggaguaccgccugagaggagaggcccggaaaacauucguggaacugaugcgcagaggcgaccucccgguuuggcuuucuuauaagguggcuuccgagggguuucaauacagcgaucggcgcuggugcuucgacggcgaaagaaacaaucagguccuggaggaaaacauggauguggagauuuggaccaaagagggagaacggaagaaacugagaccccgcuggcucgacgcccggacauauuccgacccucuggcucuuagagaguuuaaggaguucgccgcuggccgccggucugucagcggggaucugauccucgagauuggaaaacugccccagcaucugacccagagagcccaaaaugcgcucgacaaccuugugaugcugcacaauuccgaacagggcgggcgggccuaccgccaugcuauggaggagcugccugauacaaucgaaacccucaugcugcuugcccugauugcuguucucacgggaggcgugacacuguuuuuccugucuggcagagggcucggaaagaccagcaucggccuucugugugugauggccuccagcguccugcucuggauggccucuguugagccccacuggaucgcugcguccauuauccuggaauuuuuccuuauggugcugcucauuccggagccugaccggcagcgcacaccccaggauaaccaacuggccuauguggucaucgggcugcucuuuaugauucuuacaguggcugccaaugagaugggacugcuggaaaccacaaagaaagaccucggcaucgggcacguugccguggagaaccaucaccaugcugccaugcuggaugucgaccuucacccugcgagcgccuggacgcuguacgcuguggccaccacaauuaucacccccaugaugagacauacaaucgaaaacaccacggcuaauauuucucucaccgccaucgcgaaccaggccgcuauucugaugggacuggauaagggcuggccuaucuccaaaauggacauuggcgucccccuccuugcccuggggugcuacagccaggugaauccgcugacacucaccgcugccguucugaugcuuguggcucacuaugccaucaucggaccuggccugcaagcgaaggccacacgggaggcucagaaacgcaccgccgcugggauuaugaagaaccccacggucgauggaaucguggccauugaccucgaucccguuguguacgacgccaaguucgaaaaacagcugggccagaucaugcugcucauucuuuguacaucucaaauccugcugaugagaaccacaugggcgcucugcgagagcaucacccuggcuaccgggccucuuacaacgcugugggagggauccccgggcaaguuuuggaauaccacaauugccgucucuauggcuaacaucuuccggggcagcuaucucgccggggccggacuggcuuucucccugaugaaaagccucggcgggggacgcagaggcaccggggcccagggagaaacacuuggcgagaaguggaaacggcagcugaaucagcuguccaagucugaauuuaacaccuacaagagaagcggcauuauggagguggaccgcuccgaagcgaaagaggggcucaagcggggagagacgacaaaacacgccgugucuagaggcaccgcuaagcugcgcugguucguugaacggaaucuugucaaacccgaggggaaggugaucgaucugggauguggcagagggggauggagcuauuacugcgccggccucaagaaagugaccgaagucaagggcuauacaaaagggggaccuggccaugaggaacccauuccuauggcuaccuacggguggaaccugguuaagcugcacuccggaaaagacguguuuuucauucccccugagaagugugauacacuccuuugcgacauuggcgagucuagcccgaaucccacgaucgaagaggggcgcacccugcgggugcugaaaauggucgaaccuuggcucagaggaaaccaauuuuguaucaagauucugaaucccuacaugccuuccgugguugagacacuugagcagaugcagcgcaagcauggcggcaugcuggugcggaacccccucagcagaaauucuacccacgaaauguauugggucuccugcgggacaggaaacaucgugagcgccguuaauaugaccucucgcaugcugcugaaccgguucacgauggcgcacagaaaaccgaccuacgagcgcgauguggaccucggcgccgggacaagacaugucgcuguggaaccugagguggccaaccuggauauuaucggacagcggauugaaaauaucaagcacgagcauaaauccaccuggcacuaugacgaggauaaccccuacaagacaugggcuuaucauggcagcuacgaagucaaacccucuggguccgccagcuccaugguuaauggaguggugaaacuucugaccaagccuugggacgucauccccauggugacacaaauugcuaugaccgauacgacaccuuuuggccagcagcgcguuuucaaagagaagguggacaccagaaccccgaaagccaagcggggcacagcgcaaaucauggaagucacggccaaauggcucuggggguuucugagcagaaacaagaagccccggauuuguacccgcgaggaguucacaagaaaagugcggucuaaugcugccaucggagcuguuuuuguggacgagaaccaguggaauagcgccaaggaggccgucgaagaugagcgcuucugggaccuugugcacagagaacgggagcugcacaaacagggcaagugcgcgaccugcguuuauaacaugauggggaaacgcgaaaagaagcucggagaguuuggcaaagcuaagggguccagagccauuugguacauguggcugggcgcccgguuccuggaguucgaagcucucggauuuaugaaugaggaucauugguucucucgcgaaaacagccuguccggcguggagggggagggacuucacaaacugggcuacauccucagagacaucucuaagauuccugggggaaauauguaugccgaugacacagcuggcugggauacccggaucacagaagacgaucugcagaacgaggcccgcauuaccgacaucauggaacccgagcaugcgcuucuggccaaaagcauuuuuaagcucacguaccaaaauaaagucgugagaguccagcggccugcuaagaacgggaccgugauggauguuaucucccgcagagaccagcggggcucuggacaggugggcacauaugggcugaauaccuucacaaacauggaagcccaacugaucagacagauggagagcgagggaaucuuuucccccagcgaacucgagaccccgaaccuggcugaacgcguccuugauuggcuggagaaguacggcguggaacggcucaaaagaauggccaucucuggggacgacugugugguuaagccuauugaugaccgcuucgcgacggcccugacagcucuuaaugauaugggaaaagugcggaaggacaucccccagugggagccuuccaaaggcuggaacgauuggcagcaaguccccuuuugcagccaccacuuccaucagcugauuaugaaggacgggagagagaucgugguuccuugucgcaaucaggaugaacucgugggccgggccagagucucucagggagcuggcuggucccugcgcgagaccgccugccugggaaagagcuaugcucaaauguggcagcucauguacuuucaccggagagaccugcgccuugccgcgaacgccauuuguuccgcugugcccgucgauuggaucccgacaucucggaccacguggagcauccaugcccaccaucaguggaugaccacagaagacaugcuguccguguggaauagaguuuggauugaggaaaacccuuggauggaggauaaaacccacaucagcucuuggggagacgugcccuaucucggcaagcgggaggaccaauggugcgggucccugauuggacuuacagccagagcuaccugggccacaaauauccaggucgcgauuaaccaggugcgccggcugaucggcaaugaaaacuaccucgauuacaugaccagcaugaaaagauucaagaaugagggggaccccgaaggcgcucugugguga

SEQ ID NO: 18864 - RNA, 9879 nt, Artificial Sequence
  derived and/or modified CDS sequence (opt5) from DENV-1__FJ410287__SS-prME
agcgugaccaugcugcucaugcugaugcccacagcccuugcuuuccaccugacgaccagaggcggggaaccucauaugauuguguccaagcaggaacgggggaaaucucuccuguuuaagacaagcgccggcguuaacaugugcacccuuauugcgauggaccugggggagcucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuaccucucaggcucccacaaccgagauccagcucacagacuacggcgcccugacccuggauuguuccccucggacgggccucgacuucaacgaaauggugcugcuuacaaugaaggagaaaagcuggcugguccauaagcagugguuucucgaucugccccuuccuuggaccuccggggccucuacaagccaagagaccuggaaucgccaggaccugcucgugaccuucaaaacagcucacgcgaagaagcaggaagucgugguucugggaucccaagagggcgccaugcacacggcucugaccggggccacagaaauucagaccagcggaacaaccacgaucuuugccggccaucucaaaugcagacugaagauggauaaacuuacacugaaggggaugucuuaugugauguguaccggcuccuucaaacucgagaaggaagucgcugagacccagcacggaacagugcugguucagauuaaguacgagggcaccgacgcccccugcaaaaucccguuccugacacaagaugaaaagggggugacgcagaacggacggcuuaucaccgcgaauccuauugucacagacaaagagaagcccgugaacaucgaagcugagccucccuuuggcgagagcuauauuaucauuggggccggagaaaaagcccucaagcugucuugguucaagaaaggcagcuccaucgggaagauguuugaggcuaccgccagaggcgcucgccggauggccauccugggagauacagcgugggacuucggcucuauugggggaguguuuaccagcguuggcaaacucguccaucagaucuucgggacggccuacggagugcuguuuuccggcgugagcuggaccaugaagauugggaucggcguccuucugacauggcucggacucaauucuagauccaccagccugucuaugacauguauugcugugggccuuguuacccucuaccugggggugaugguccaggccgauuccggaugcgugaucaacuggaaaggccgcgaacugaagugugggagcggaauuuucguuacaaaugaggugcacaccuggacggaacaauauaaguuucaggcugacucccccaaacggcucucugccgcgaucggcaaggccugggaggagggggucugcggcaucagaagcgcuacacgccuggaaaacauuauguggaaacagaucuccaacgagcuuaaucauauucugcucgaaaacgacaugaaguucaccgugguugugggagaugucgccggcauccuggcucaggggaaaaagaugauucggccucaaccgauggaguacaaauauucuuggaaaagcuggggaaaggccaagaucaucggcgccgacgugcagaauaccacauuuauuaucgaugggcccaacaccccugaaugucccgacgaucagagagcuuggaauauuugggagguggaggacuacggauucggcaucuuuacgacaaacauuuggcugaaacuucgcgauuccuauacccaggucugcgaccaccggcucaugagcgcggccaucaaagauucuaaggcuguucacgccgacaugggcuacuggaucgaauccgagaaaaaugaaacauggaagcuggccagagcuagcuucauugaggugaagaccuguaucuggccuaaaucucauacacugugguccaacggggugcucgaaagcgagaugauuauccccaagauuuauggaggcccgaucucucaacacaauuaccgcccuggguacuucacccagacggccggacccuggcaucugggcaaacuugagcuggauuuugaccucugcgaagggaccacagucgugguugaugagcacugcggaaaccggggcccuagccugagaaccacaaccgugacgggcaagaucauucacgaaugguguugccgguccuguacacugcccccucuucgcuucagaggggaggacggaugcugguauggcauggagauccggcccgucaaagaaaaggaggaaaaucucgucaagagcaugguuucugcgggguccggagagguggacagcuuuucccugggccugcucuguauuucuaucauuaucgaagaggucaugagaagccgcuggucccggaaaaugcugaugaccgggacacuugcuguguucuuucugcucauuaugggacagcugaccuggaacgaucugaucagacuuugcaucaugguuggcgccaaugccucugaccgcaugggcauggggaccacauaccuggcucucauggccacguucaagaugagaccgauguuugcggugggacugcuguuccggcgccugaccagcagagagguccuucugcucacaauuggccugucccugguggcuucuguggaacuuccuaacagccuggaggaacucggggauggacuggccaugggcaucaugauucucaaacugcuuaccgacuuucaaucccaucagcugugggccacacuccugagccugaccuucaucaagacgacauuuucucuucacuaugcuuggaaaaccauggccaugguccuguccauuguuagccucuucccccugugucucucuaccacaucccagaagaccacauggcugcccgugcuucuggggagccugggaugcaagccucucacgauguuucugaucgcugagaauaaaaucuggggccggcgcucuuggccgcuuaacgaaggcauuauggccguggggaucgucuccauucugcucagcucccugcucaagaacgaugugccccuggcgggaccucuuaucgccggcgggaugcugauugcuuguuacguuaucagcggaucuagcgccgaccugucccucgagaaagcugccgaggugucuugggaagaggaagccgagcauagcggcgcuucccacaauauccuggucgaagugcaggaugacgggaccaugaagauuaaagaugaggagagagacgauacacuuaccauccugcucaaggcgacacugcucgccguuucuggaguguauccccugagcauuccugcuacccuuuucgucugguacuucuggcagaagaagaagcagcgguccggcgugcugugggacacgcccucuccucccgaagucgagcgcgccgugcuggaugacggcaucuauagaauuaugcagcgggggcuccugggacgcagccagguuggcgugggggucuuucaagaaaacguguuccauaccauguggcacguuacaagaggagccgugcuuauguaccagggcaaacggcuggagccguccugggcuagcgucaagaaagaccucaucucuuacgggggaggcuggagacugcagggcuccuggaauaccggggaggaagugcaagugauugccguugagccuggaaagaaccccaaaaauguccaaacagcgccuggcaccuuuaagacacccgaaggggaggugggagcuaucgcccucgauuucaagccgggcacgagcgggucuccuaucgugaaccgcgaaggaaaaauugucggccuguauggcaauggggugguuaccacauccggaaccuacgugagcgccaucgcucaggccaaggcgucccaggagggcccccuuccugagauugaagacgaggucuuucggaaaagaaaccugaccaucauggaucugcaccccgggucuggaaagacacgccgguaucuccccgcuauugugagagaagccaucaaacgcaagcugcggacgcuuauccuggccccuaccagaguuguggcuagcgagauggccgaagcucucaagggcaugccgauucgcuaccaaacaaccgccgucaaauccgagcauacagggaaggagaucguggaccugaugugccacgcgaccuucacgaugcggcugcucagccccguuagagugccuaauuauaacaugauuaucauggaugaagcccauuuuacagaccccucuuccauugcugcccggggcuacaucagcacccgcgucggaaugggcgaggcugccgccaucuucaugaccgcuacaccucccgggucuguggaagcguuuccucagagcaaugccgugauucaggaugaggaaagagacaucccggagcgguccuggaacucuggauaugaguggauuaccgauuuccccggcaaaacagucugguuuguuccuagcaucaaguccgggaaugacauugcuaacugucuucgcaaaaauggaaagagagugauccagcugucucggaagaccuucgauacggaauaccagaagacaaagaacaacgacugggacuacguggucaccacagauauuagcgagaugggcgccaauuucagagccgaccgcgugaucgauccccggagaugccugaaaccuguuauccucaaggacgggcccgaacgcgugauucuggcuggcccgaugccugucaccguggccuccgcggcucagcggagaggacgcaucggccggaaccacaauaaagagggggaucaguauauuuacaugggacagccccuuaacaaugacgaggaucaugcccacuggacggaagccaagaugcugcucgacaacaucaauacccccgagggcauuaucccugcucuguuugaacccgagagagaaaagagcgccgcgaucgauggggaguaucgccugagaggagaggcccggaaaacauucguugaacucaugcgcagaggcgaccuuccuguguggcugucuuacaaggucgcuuccgagggguuucaauauagcgaucggcgcuggugcuucgacggcgaaagaaacaaucaggugcuggaggaaaacauggaugucgagauuuggaccaaagagggagaacggaagaaacucagaccgcgcuggcuggacgcccggacauacuccgacccccuugcucugagagaguuuaaggaguucgccgcuggccgccggucugugagcggggaucucauccuggagauuggaaaacugccucagcaccucacccagagagcccaaaaugcgcuugacaaccugguuaugcugcauaauuccgaacagggcgggcgggccuaucgccacgcuauggaggagcuccccgauacaaucgaaacccugaugcuucuggcccucauugcugugcugacgggaggcgugacacuguuuuuccucucuggcagagggcuuggaaagaccagcaucggccugcugugugucauggccuccagcguucuccuguggauggccucuguggagccucauuggaucgcugcguccauuauccuugaauuuuuccugauggugcuccugauucccgagccggaccggcagcgcaccccucaggauaaccaacuggccuacgucgugaucgggcuccuuuuuaugauucugacaguugcugccaaugagaugggacugcucgaaaccacaaagaaagaccugggcaucgggcacguggccgucgagaaccaccaucacgcugccaugcuugauguggaccugcaucccgcgagcgccuggacgcucuacgcugucgccaccacaauuaucaccccuaugaugagacacacaaucgaaaacaccacggcuaauauuucucugaccgccaucgcgaaccaggccgcuauucugaugggacucgauaagggcuggcccaucuccaaaauggacauuggcgugccucuucuggcccuggggugcuauagccagguuaauccccucacacugaccgcugccgugcuuaugcuggucgcucauuacgccaucaucggaccgggccuccaagcgaaggccacacgggaggcucagaaacgcaccgccgcugggauuaugaagaacccuacgguggauggaaucguugccauugaccuggaucccguggucuaugacgccaaguucgaaaaacagcugggccagaucaugcuccuuauucuguguacaucucaaauccugcucaugagaaccacaugggcgcugugcgagagcaucacccuugcuaccgggccccugacaacgcucugggagggauccccuggcaaguuuuggaauaccacaauugccgugucuauggcuaacaucuuccggggcagcuaccuggccggggccggacuggcuuucucccucaugaaaagccuuggcgggggacgcagaggcaccggggcccagggagaaacacugggcgagaaguggaaacggcagcugaaucagcucuccaagucugaauuuaacaccuauaagagaagcggcauuauggagguggaccgcuccgaagcgaaagaggggcugaagcggggagagacgacaaaacacgccguuucuagaggcaccgcuaaacuucgcugguucgucgaacggaaucuggugaaaccggaggggaaggugaucgaucucggauguggcagagggggauggagcuacuauugcgccggccugaagaaagucaccgaaguuaagggcuacacaaaagggggacccggccacgaggaaccuauucccauggcuaccuacggguggaaccuggugaagcuccauuccggaaaagacguguuuuucaucccucccgagaagugugauacacuucugugcgacauuggcgagucuagcccuaauccgacgaucgaagaggggcgcacccugcggguccucaaaaugguggaacccuggcugagaggaaaccaauuuuguaucaagauucuuaauccuuauaugcccuccguuguggagacacuggagcagaugcagcgcaagcacggcggcaugcucguccggaacccucugagcagaaauucuacccaugaaauguacuggguguccugcgggacaggaaacaucguuagcgccgugaauaugaccucucgcaugcugcucaaccgguucacgauggcgcacagaaaacccaccuaugagcgcgaugucgaccugggcgccgggacaagacacguggcuguggaaccggaggucgccaaccuugauauuaucggacagcggauugaaaauaucaagcaugagcacaaauccaccuggcauuacgacgaggauaacccuuauaagacaugggcuuaccacggcagcuaugaaguuaaacccucuggguccgccagcuccauggugaauggaguggucaagcugcucaccaagcccugggacgugaucccuaugguuacacaaauugcuaugaccgauacgacacccuuuggccagcagcgcguguucaaagagaaggucgacaccagaaccccuaaagccaagcggggcacagcgcaaaucauggaagugacggccaaauggcuguggggguuucuuagcagaaacaagaagccgcggauuuguacccgcgaggaguucacaagaaaaguucggucuaaugcugccaucggagcuguguuugucgacgagaaccaguggaauagcgccaaggaggccguggaagaugagcgcuucugggaccugguucauagagaacgggagcuccacaaacagggcaagugcgcgaccugcguguacaacaugauggggaaacgcgaaaagaagcugggagaguuuggcaaagcuaagggguccagagccauuugguacauguggcugggcgcccgguuccucgaguucgaagcucugggauuuaugaaugaggaucacugguucucucgcgaaaacagccuuuccggcgucgagggggagggacugcauaaacucggcuauauccugagagacaucucuaagauucccgggggaaauauguacgccgaugacacagcuggcugggauacccggaucacagaagacgaucuucagaacgaggcccgcauuaccgacaucauggaaccugagcacgcgcugcucgccaaaagcauuuuuaagcugacguaucaaaauaaaguggucagagugcagcggcccgcuaagaacgggaccguuauggaugugaucucccgcagagaccagcggggcucuggacaggucggcacauacgggcugaauaccuucacaaacauggaagcccaacucaucagacagauggagagcgagggaaucuuuuccccuagcgaacuggagacccccaaccuugcugaacgcgugcuggauuggcucgagaaguauggcguggaacggcugaaaagaauggccaucucuggggacgacuguguugugaagccgauugaugaccgcuucgcgacggcccuuacagcucugaaugauaugggaaaaguccggaaggacaucccucagugggagcccuccaaaggcuggaacgauuggcagcaagugccuuuuugcagccaucacuuccaccagcucauuaugaaggacgggagagagaucguugugcccugucgcaaucaggaugaacuggucggccgggccagagugucucagggagcuggcuggucccugcgcgagaccgccugccucggaaagagcuacgcucaaauguggcagcugauguauuuucaucggagagaccuucgccuggccgcgaacgccauuuguuccgcugucccuguggauuggauccccacaucucggaccacguggagcauccacgcccaucaccaguggaugaccacagaagacaugcucuccguuuggaauagaguguggauugaggaaaacccguggauggaggauaaaacccauaucagcucuuggggagacgucccuuaccugggcaagcgggaggaccaauggugcgggucccuuauuggacugacagccagagcuaccugggccacaaauauccagguggcgauuaaccagguucgccggcucaucggcaaugaaaacuaccuggauuauaugaccagcaugaaaagauucaagaaugagggggaccccgaaggcgcucugugguga

SEQ ID NO: 18865 - RNA, 9879 nt, Artificial Sequence
  derived and/or modified CDS sequence (opt5) from DENV-1__FJ432719__SS-prME
agcgugaccaugcugcucaugcugaugcccaccgcccuugcuuuccaccugacgaccagaggcggggaaccucauaugaucguguccaagcaggaacgggggaaaucucuccuguuuaagaccagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccgccgagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaacuggccgagacccagcacggaaccguccuggugcagauuaaguacgagggcacagacgcgccgugcaaaaucccuuucuccacccaagaugaaaaggggguuacacagaacggacggcuuaucacggcuaaucccauugugaccgacaaagagaagccugucaacaucgaagccgagccgcccuuuggcgagagcuauauugugaucggggccggagaaaaagcucucaagcugucuugguucaagaaaggcagcuccauugggaagauguuugaggccacagcuagaggcgcccgccggauggcgauccugggagauaccgccugggacuucggcucuaucgggggaguguuuacaagcguuggcaaacucguccaucagauuuucgggaccgcuuacggagugcuguuuuccggcgugagcuggacgaugaagaucgggauuggcguccuucugaccuggcucggacucaauucuagauccacaagccugucuaugaccuguaucgccgugggccuuguuacacucuaccugggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcucucugcggccauuggcaaggcuugggaggagggggucugcggcaucagaagcgccacgcgccuggaaaacaucauguggaaacagauuuccaacgagcuuaaucauauccugcucgaaaacgacaugaaguucacagugguugugggagaugucgcuggcauucuggcccaggggaaaaagaugauccggccgcaacccauggaguacaaauauucuuggaaaagcuggggaaaggccaagauuaucggcgcugacgugcagaauaccaccuuuaucauugaugggccuaacacacccgaauguccugacgaucagagagcguggaauaucugggagguggaggacuacggauucggcauuuuuaccacgaacaucuggcugaaacuucgcgauuccuauacacaggucugcgaccaccggcucaugagcgccgcuauuaaagauucuaaggccguucacgccgacaugggcuacuggaucgaauccgagaaaaaugaaaccuggaagcuggcuagagccagcuucaucgaggugaagacauguauuuggcccaaaucucauacccugugguccaacggggugcucgaaagcgagaugaucauuccgaagaucuauggaggcccuauuucucaacacaauuaccgccccggguacuucacacagaccgcgggaccuuggcaucugggcaaacuugagcuggauuuugaccucugcgaagggacgaccgucgugguugaugagcacugcggaaaccggggccccagccugagaacaaccacagugaccggcaagaucauccacgaaugguguugccgguccuguacgcugccuccccuucgcuucagaggggaggacggaugcugguauggcauggagauucggccggucaaagaaaaggaggaaaaucucgucaagagcaugguuucugcuggguccggagagguggacagcuuuucccugggccugcucuguaucucuauuaugaucgaagaggucaugagaagccgcuggucccggaaaaugcugaugacagggacccuugccguguucuuucugcucauuaugggacagcugacauggaacgaucugaucagacuuugcauuaugguuggcgccaaugcuucugaccgcaugggcauggggaccaccuaccuggcccucauggcgacauucaagaugagaccuauguuugcugugggacugcuguuccggcgccugacgagcagagagguccuucugcucaccaucggccugucccugguggccucuguggaacuucccaacagccuggaggaacucggggauggacuggccaugggcaucaugauucucaaacugcuuacagacuuucaaucccaucagcugugggcuacccuccugagccugacauucaucaagaccacguuuucucuucacuaugccuggaaaacaauggcuaugguccuguccauuguuagccucuucccccugugucucucuaccaccucccagaagacaaccuggcugccugugcuucuggggagccugggaugcaagccgcucacaauguuucugaucgccgagaauaaaauuuggggccggcgcucuuggccccuuaacgaaggcaucauggcgguggggaucgucuccauucugcucagcucccugcucaagaacgaugugccucuggccggaccccuuaucgcuggcgggaugcugauugccuguuacguuaucagcggaucuagcgcugaccugucccucgagaaagccgccgaggugucuugggaagaggaagcugagcauagcggcgcgucccacaauauucuggucgaagugcaggaugacgggacgaugaagaucaaagaugaggagagagacgauacccuuacaauccugcucaaggccacccugcucgcuguuucuggaguguauccucugagcauucccgccacacuuuucgucugguacuucuggcagaagaagaagcagcgguccggcgugcugugggacaccccuucucccccggaagucgagcgcgccgugcuggaugacggcaucuauagaauuaugcagcgggggcuccugggacgcagccagguuggcgugggggucuuucaagaaaacguguuccauacgauguggcacguuaccagaggagcugugcuuauguaccagggcaaacggcuggagccuuccugggccagcgucaagaaagaccucaucucuuacgggggaggcuggagacugcagggcuccuggaauacaggggaggaaguccaggugauugcgguugagcccggaaagaacccuaaaaauguccaaaccgcucccggcacauuuaagaccccggaaggggaggugggagccaucgcccucgauuucaagccuggcacaagcgggucucccauugugaaccgcgaaggaaaaaucgucggccuguauggcaauggggugguuacgaccuccggaacauacgugagcgcuaucgcccaggcgaaggcuucccaggagggcccucuucccgagauugaagacgaggucuuucggaaaagaaaccugaccaucauggaucugcaccccgggucuggaaagacccgccgguaucucccugccauugugagagaagccaucaaacgcaagcugcggacacuuauucuggcuccgacgagaguuguggccagcgagauggcugaagcccucaagggcaugcccauccgcuaccaaaccacagcggucaaauccgagcauaccgggaaggagaucguggaccugaugugccacgccacauucaccaugcggcugcucagcccuguuagagugcccaauuauaacaugauuaucauggaugaagcucauuuuacggacccuucuuccauugccgcucggggcuacaucagcacacgcgucggaaugggcgaggccgccgcuauuuucaugaccgcgacacccccugggucuguggaagccuuuccgcagagcaaugcugugauccaggaugaggaaagagacauccccgagcgguccuggaacucuggauaugaguggauuacagauuucccuggcaaaaccgucugguuuguucccagcaucaaguccgggaaugacauugccaacugucuucgcaaaaauggaaagagagugauccagcugucucggaagacauucgauaccgaauaccagaagacgaagaacaacgacugggacuacguggucacaaccgauauuagcgagaugggcgccaauuucagagcugaccgcgugaucgauccucggagaugccugaaacccguuauucucaaggacgggccggaacgcgugauccuggccggcccuaugcccgucacaguggcguccgcugcccagcggagaggacgcaucggccggaaccacaauaaagagggggaucaguauauuuacaugggacagccccuuaacaaugacgaggaucaugcccacuggaccgaagcuaagaugcugcucgacaacaucaauacgccugagggcauuauccccgcccuguuugaaccugagagagaaaagagcgcggccauugauggggaguaucgccugagaggagaggcucggaaaaccuucguugaacucaugcgcagaggcgaccuuccgguguggcugucuuacaaggucgccuccgagggguuucaauauagcgaucggcgcuggugcuucgacggcgaaagaaacaaucaggugcuggaggaaaacauggaugucgagaucuggacaaaagagggagaacggaagaaacucagaccccgcuggcuggacgcucggaccuacuccgacccucuugcccugagagaguuuaaggaguucgcugccggccgccggucugugagcggggaucucauccuggagauuggaaaacugccccagcaccucacacagagagcgcaaaaugcccuugacaaccugguuaugcugcauaauuccgaacagggcgggcgggcuuaucgccacgccauggaggagcucccugauaccaucgaaacacugaugcuucuggcucucauugccgugcugaccggaggcgugacgcuguuuuuccucucuggcagagggcuuggaaagacaagcaucggccugcugugugucauggccuccagcguucuccuguggauggcuucuguggagccccauuggauugcggccuccaucauccuugaauuuuuccugauggugcuccugauuccggagccugaccggcagcgcacaccccaggauaaccaacuggcuuacgucgugaucgggcuccuuuuuaugauucugaccguugccgccaaugagaugggacugcucgaaacaaccaagaaagaccugggcaucgggcacguggcugucgagaaccaccaucacgccgcgaugcuugauguggaccugcauccugccagcgcuuggacacucuacgccgucgcuacgaccauuaucacacccaugaugagacacaccauugaaaacacaaccgccaauaucucucugacggcgaucgccaaccaggcugccauucugaugggacucgauaagggcuggccuaucuccaaaauggacauuggcgugccccuucuggcucuggggugcuauagccagguuaauccgcucacccugacagccgcugugcuuaugcuggucgcccauuacgcgaucauuggaccuggccuccaagccaaggcuacccgggaggcccagaaacgcacagcugccgggaucaugaagaaccccaccguggauggaaucguugccauugaccuggaucccguggucuaugacgcgaaguucgaaaaacagcugggccagaucaugcuccuuauucuguguacgucucaaauccugcucaugagaacaaccugggcucugugcgagagcauuacacuugccaccgggccucugaccacacucugggagggauccccgggcaaguuuuggaauacgaccaucgcugugucuauggccaacaucuuccggggcagcuaccuggccggggcuggacuggccuucucccucaugaaaagccuuggcgggggacgcagaggcacaggggcgcagggagaaacccugggcgagaaguggaaacggcagcugaaucagcucuccaagucugaauuuaacacauauaagagaagcggcauuauggagguggaccgcuccgaagccaaagaggggcugaagcggggagagaccacgaaacacgcuguuucuagaggcacagccaaacuucgcugguucgucgaacggaaucuggugaaacccgaggggaaggugaucgaucucggauguggcagagggggauggagcuacuauugcgcuggccugaagaaagucaccgaaguuaagggcuacaccaaagggggaccuggccacgaggaacccauuccuauggccacauacggguggaaccuggugaagcuccauuccggaaaagacguguuuuucauucccccugagaagugugauacccuucugugcgacaucggcgagucuagcccgaaucccacaaucgaagaggggcgcacgcugcggguccucaaaaugguggaaccuuggcugagaggaaaccaauuuuguauuaagauccuuaaucccuauaugccuuccguuguggagacccuggagcagaugcagcgcaagcacggcggcaugcucguccggaacccccugagcagaaauucuacacaugaaauguacuggguguccugcgggaccggaaacaucguuagcgcggugaauaugacaucucgcaugcugcucaaccgguucaccauggcccacagaaaaccgacguaugagcgcgaugucgaccugggcgcugggaccagacacguggccguggaaccugaggucgcuaaccuugauauuaucggacagcggauugaaaauaucaagcaugagcacaaauccacauggcauuacgacgaggauaaccccuauaagaccugggccuaccacggcagcuaugaaguuaaacccucuggguccgcuagcuccauggugaauggaguggucaagcugcucacaaagccuugggacgugauucccaugguuacccaaaucgccaugacagauaccacgccuuuuggccagcagcgcguguucaaagagaaggucgacacaagaaccccgaaagcgaagcggggcaccgcccaaaucauggaagugacagcuaaauggcuguggggguuucuuagcagaaacaagaagccccggauuuguacgcgcgaggaguucaccagaaaaguucggucuaaugccgcuaucggagccguguuugucgacgagaaccaguggaauagcgccaaggaggcgguggaagaugagcgcuucugggaccugguucauagagaacgggagcuccacaaacagggcaagugcgcuacaugcguguacaacaugauggggaaacgcgaaaagaagcugggagaguuuggcaaagccaagggguccagagccauuugguacauguggcugggcgcucgguuccucgaguucgaagcccugggauuuaugaaugaggaucacugguucucucgcgaaaacagccuuuccggcgucgagggggagggacugcauaaacucggcuauauccugagagacauuucuaagaucccugggggaaauauguacgcugaugacaccgccggcugggauacacggaucaccgaagacgaucuucagaacgaggcgcgcauuacagacaucauggaacccgagcacgcccugcucgcuaaaagcauuuuuaagcugaccuaucaaaauaaaguggucagagugcagcggccugccaagaacgggacgguuauggaugugaucucccgcagagaccagcggggcucuggacaggucggcaccuacgggcugaauacauucaccaacauggaagcucaacucauuagacagauggagagcgagggaaucuuuucccccagcgaacuggagacaccgaaccuugccgaacgcgugcuggauuggcucgagaaguauggcguggaacggcugaaaagaauggcgaucucuggggacgacuguguugugaagccuauugaugaccgcuucgccaccgcucuuacggcccugaaugauaugggaaaaguccggaaggacaucccccagugggagccuuccaaaggcuggaacgauuggcagcaagugcccuuuugcagccaucacuuccaccagcucauuaugaaggacgggagagagaucguugugccuugucgcaaucaggaugaacuggucggccgggcuagagugucucagggagccggcuggucccugcgcgagacagcuugccucggaaagagcuacgcccaaauguggcagcugauguauuuucaucggagagaccuucgccuggcggccaacgcuauuuguuccgccguccccguggauuggaucccgaccucucggacaaccuggagcauucacgcccaucaccaguggaugacgaccgaagacaugcucuccguuuggaauagaguguggaucgaggaaaacccuuggauggaggauaaaacacauaucagcucuuggggagacguccccuaccugggcaagcgggaggaccaauggugcgggucccuuauuggacugaccgcuagagccacaugggcgaccaauauccagguggcuauuaaccagguucgccggcucaucggcaaugaaaacuaccuggauuauaugacaagcaugaaaagauucaagaaugagucugaccccgaaggggcccugugguga

SEQ ID NO: 18866 - RNA, 9879 nt, Artificial Sequence
  derived and/or modified CDS sequence (opt5) from DENV-1__FJ182020__SS-prME
agcgugacaaugcugcugaugcugaugcccacagcccuugcuuuccaccugacgaccagaggcggggaaccucauaugaucgucuccaagcaggaacggggaaaaucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagaucguucaguacgaaaaccuuaaauauuccgugaucgucacggugcacaccggcgaccagcaucaaguugggaaugagagcacagaacacggaaccacagcuaccauuacgccccaggccccuucuaccgagauccagcugacagacuacggcgcccucacccuggauuguagcccccggacaggccuggacuuuaacgaaauggugcuccugaccaugaaggagaaaagcuggcuuguccauaagcagugguuccuggaucucccucugcccuggacguccggggcuucuacaagccaagagaccuggaaucgcaaagaccuucuggugacauuuaagaccgcgcacgccaagaaacaggaagucgugguucucggaucccaggagggcgcuaugcacaccgcccugacaggggccacggaaauucaaaccagcggaacaaccacaaucuucgcuggccaucugaagugcagacucaaaauggauaagcugacccuuaaagggaugucuuaugugauguguacgggcuccuucaagcuggagaaggaagucgccgagacacagcacggaaccgugcucguucagauuaaauacgagggcaccgacgcgccgugcaagaucccuuuuagcacacaggaugaaaaaggggugacccaaaacggacggcugaucacagcuaaucccauugucacggacaaggagaaaccugugaacaucgaagccgagccgcccuucggcgagucuuauauugugaucggggccggagaaaaggcucugaaacuuagcugguuuaaaaagggcuccucuauugggaaaauguucgaggccaccgcuagaggcgcccgccggauggcgauccucggagauacagccugggacuuuggcagcaucgggggaguuuucaccuccgucggcaagcuggugcaucagauuuuugggacagcuuacggagugcuguucagcggcgucucuuggaccaugaaaaucgggauuggcgugcuccugacguggcuuggacucaauuccagaagcaccucucucuccaugacauguaucgccguuggccuggugacccuguaccuuggggucauggugcaggcugauagcggaugcguuauuaacuggaagggccgcgaacucaaguguggguccggaaucuuugugacaaaugagguccacaccuggacagaacaguauaaauuccaagccgacucuccuaagcggcugagcgcggccauuggcaaggcuugggaggagggggugugcggcaucagauccgccacccgccuggaaaacaucauguggaagcagauuucuaacgagcucaaucauauccugcuugaaaacgacaugaaauuuacgguuguggucggagauguggcuggcauucuggcccaggggaagaaaaugauccggccgcagcccauggaguacaaguauagcuggaaguccuggggaaaagccaagauuaucggcgcugacgugcaaaauacaaccuucaucauugaugggccuaacacccccgaauguccugacgaucagagagcguggaauaucugggaggucgaggacuacggauuuggcauuuucacaaccaacaucuggcucaaacugcgcgauagcuauacgcagguuugcgaccaccggcugaugucugccgcuauuaaggauuccaaagccgugcacgccgacaugggcuacuggaucgaaagcgagaagaaugaaacauggaaacuugcuagagccucuuucaucgaggugaaaaccuguauuuggcccaagucccauacacucuggagcaacgggguccuggaaucugagaugaucauuccgaaaaucuauggaggcccuauuagccagcacaauuaccgccccggguacuuuacccaaacagcgggaccuuggcaucugggcaagcucgagcuggauuucgaccuuugcgaagggaccacggugguuguggaugagcacugcggaaaccggggccccucccugagaaccacaaccgucacaggcaaaaucauccacgaaugguguugccggagcuguacccucccuccccugcgcuuuaagggggaggacggaugcugguauggcauggagauuagaccggugaaggaaaaagaggaaaaucugguuaagucuaugguguccgcugggagcggagaggucgacuccuucucucuuggccuccuguguaucagcauuaugaucgaagaggugaugcgguccagauggucucgcaaaaugcugaugacggggacacucgccgucuuuuuccugcuuauuaugggacagcugaccuggaacgaucucauccggcugugcauuauggugggcgccaaugcuagcgacagaaugggcauggggacaaccuaccuggcccuuauggcgaccuuuaagaugcgcccuauguucgcugucggacugcucuuuagacggcugacaucccgcgaggugcuccugcuuacgaucggccugucucucguggccagcgucgaacugcccaacucccuggaggaacuuggggauggacuggccaugggcaucaugauucucaaacugcucaccgacuuccagagccaucaacugugggcuacacuucugucucucaccuuuaucaagacaaccuucucccugcacuaugccuggaagacgauggcuaugguucugagcauugugucucuuuuuccccugugucucuccacaaccagccagaaaaccacauggcugccugugcuccuggggucucuuggaugcaagccgcugaccauguuccugaucgccgagaauaaaauuuggggcagaaaguccuggccccucaacgaaggcaucauggcggucgggaucgugagcauucugcuuuccagccugcucaaaaacgauguuccucuggccggaccccucaucgcuggcgggaugcugauugccuguuacgugaucucuggaagcuccgcugaccuuucucuggagaaggccgccgaggucagcugggaagaggaagcugagcauuccggcgcgucucacaauauucugguggaaguucaggaugacgggacaaugaaaaucaaggaugaggagcgggacgauacgcucaccauccugcuuaaggccacacugcucgcugugagcggagucuauccucuguccauucccgccacccucuucgugugguacuuuuggcagaaaaagaaacaacgcucuggcguccugugggacacaccuuccccucccgaaguggagagagccguucuugaugacggcaucuaucggauuaugcagcgcgggcugcugggaagaucccaggugggcgucgggguguuccaggaaaacguuuuucauaccauguggcacgugacgcggggagcuguccucauguaccaaggcaagcgccuggagcccagcugggccucugugaaaaaggaccuuaucuccuacgggggaggcuggagacugcagggcagcuggaauaccggggaggaagugcagguuauugcggucgagcccggaaagaacccuaaaaaugugcagacagcucccggcaccuucaagacaucugaaggggaggugggagccaucgcccucgauuuuaaaccgggcaccuccgggagcccuauugucaaccgggaaggaaagaucgugggccuguauggcaaugggguugugacaacguccggaaccuacgucucugcuaucgcccaagcgaaagcuagccaggagggcccccucccugagauugaagacgagguguucagaaagcgcaaccugacaaucauggaucuucaccccggguccggaaagacccggagauaucugcccgccauuguucgcgaagccaucaaacggaagcugagaacccucauucuggcuccuacacgcguggucgccagcgagauggcugaagcccuuaaaggcaugccgauccgguaccagacgaccgcggugaagucugagcauacagggaaagagaucguugaccugaugugccacgccaccuuuacaaugagacuccugucccccgugcgcgucccuaauuauaacaugauuaucauggaugaagcucauuucaccgaccccagcucuauugccgcucggggcuacaucagcacgagagugggaaugggcgaggccgccgcuauuuuuaugacagcgaccccucccggguccguggaagccuucccucaaucuaaugcugucauccaggaugaggaacgggacaucccggagcgcagcuggaacuccggauaugaguggauuaccgauuuucccggcaagacaguuugguucgugccuucuaucaagagcgggaaugacauugccaacugucugcgcaagaauggaaagcgggugauccagcucucccgcaaaaccuucgauacagaauaccagaagaccaaaaacaacgacugggacuacgucgugacgacagauauuagcgagaugggcgccaauuuuagagcugaccggguuaucgaucccagacgcugccuuaagccugugauucugaaggacgggcccgaacgggucauccuggccggcccgaugccugugaccguugcgucugcugcccaaagacgcggacggaucggcagaaaccacaauaaagagggggaucaguauauuuacaugggacagccccucaacaaugacgaggaucaugcccacuggacagaagcuaagaugcugcuugacaacaucaauacccccgagggcauuaucccugcccuguucgaacccgagcgcgaaaaauccgcggccauugauggggaguaucggcucagaggagaggcucgcaagacguuuguggaacugaugagacggggcgaccugccugucuggcucagcuacaaaguggccuccgagggguuccaguauucugaucgcagauggugcuuugacggcgaacggaacaaucaaguccuugaggaaaacauggauguggagaucuggaccaaggagggagaacgcaaaaagcugagaccgcgguggcuggacgcuagaacauacagcgacccccucgcccugcgcgaguucaaggaauuugcugccggccggagauccguuucuggggaucuuauccuggagauuggaaaacucccucagcaccugacccagcgcgcgcagaaugcccuggacaaccucgugaugcuucauaauagcgaacaaggcgggcgggcuuauagacacgccauggaggagcugcccgauacaaucgaaacccugaugcuccuggcucuuauugccgugcugacaggaggcgucacccucuucuuucuguccggccgggggcugggaaagacgagcaucggccuccuuuguguuauggccucuuccgugcugcuguggauggcuagcguggagccucauuggauugcggccucuaucauccucgaguucuuucugaugguccuucugauucccgagccggaccgccagagaacaccucaggauaaccagcucgcuuacgugguuaucgggcugcuguucaugauucucaccguggccgccaaugagaugggacuucuggaaaccaccaagaaggaccugggcaucgggcacgucgcuguggagaaccaccaucacgccgcgaugcucgaugucgaccugcaucccgccuccgcuuggacccuuuacgccguggcuacaacgauuaucaccccuaugaugcggcacacaauugaaaacaccacagccaauaucagccugaccgcgaucgccaaccaagcugccauucucaugggacuggauaaaggcuggcccaucucuaagauggacauuggcguuccucugcucgcucuugggugcuauagccaggugaauccccugacgcugaccgccgcuguccucaugcugguggcccauuacgcgaucauuggaccgggccuucaggccaaggcuacacgcgaggcccagaagagaaccgcugccgggaucaugaagaacccuacaguugauggaaucguggccauugaccuggaucccgucguguaugacgcgaaauuugaaaagcagcucggccagaucaugcugcugauucucuguaccucccagauccuucugaugcggacgacaugggcucugugcgagucuauuacccucgccacagggccccugaccacccuuugggagggaagcccuggcaaauucuggaauacaacgaucgcuguguccauggccaacaucuuccgcggcagcuaccuggccggggcuggacucgccuuuucccugaugaagucucugggcgggggaagacggggcaccggggcgcaaggagaaacacucggcgagaaguggaaacgccagcuuaaucagcugagcaaguccgaguucaacaccuauaaaagaucuggcauuauggagguugaccggagcgaagccaaggaggggcugaaaagaggagagacaaccaagcacgcugucucccgcggcacggccaagcuccggugguuuguggaaagaaaucuggugaaaccggaggggaaggucaucgaucuuggauguggccgcgggggauggucuuacuauugcgcuggccugaaaaagguuacagaagugaaaggcuacaccaaagggggacccggccacgaggaaccuauucccauggccaccuacggguggaaccucgugaaacugcauagcggaaaggacgucuucuuuaucccucccgagaagugugauacacugcucugcgacauuggcgaguccagcccuaauccgaccaucgaagaggggcggacacuuagagugcugaaaaugguugaacccuggcugcgcggaaaccaguucuguauuaagauccucaauccuuauaugcccucuguggucgagacgcuggagcaaaugcagcggaaacacggcggcaugcuugugagaaacccucugucccgcaauagcacccaugaaauguacuggguuucuugcgggacaggaaacaucguguccgcggucaauaugaccagccggaugcuccugaacagauuuacaauggcccaccgcaagcccaccuaugagcgggauguggaccugggcgcugggacgagacacguggccgucgaaccggagguugcuaaccucgauauuaucggacagcgcauugaaaauaucaaacaugagcacaagucuaccuggcauuacgacgaggauaacccuuauaagacaugggccuaccacggcuccuaugaagugaaacccagcggguccgcuagcucuauggugaauggagucgugaagcugcuuaccaaacccugggacguuauuccuauggugacacagaucgccaugaccgauacaacccccuucggccaacagagagucuuuaaggagaaaguggacacgcggacaccuaaggcgaagcgcggcaccgcccagaucauggaaguuaccgcuaaauggcuguggggguuccucagcagaaacaagaaaccgcggauuuguacaagagaggaauuuacgcggaaggugcgcuccaaugccgcuaucggagccgucuucguggacgagaaccaauggaacucugccaaagaggcgguugaagaugagagauuuugggaccuggugcaucgggaacgcgagcuucacaagcagggcaagugcgcuaccugcgucuacaacaugauggggaaaagagaaaagaaacugggagaguucggcaaggccaaagggagccgggccauuugguacauguggcucggcgcucgcuuccuggaguuugaagcccugggauucaugaaugaggaucacugguuuuccagagaaaacucucucagcggcguggagggggagggacugcauaaacuuggcuauauccugcgggacauuuccaaaauccccgggggaaauauguacgcugaugacacagccggcugggauacccgcaucacagaagacgaucuccagaacgaggcgaagauuaccgacaucauggaaccugagcacgcccugcuugcuaagucuauuuucaaacugacauaucagaauaaggucgugagaguucaacggcccgccaaaaacgggaccgugauggaugucaucagccgcagagaccagcggggcuccggacaggugggcacguacgggcucaauaccuuuacaaacauggaagcucagcugauucgccaaauggagagcgagggaaucuucucuccuuccgaacuggagacccccaaccucgccggcagagugcuggauuggcuugaaaagcaugggguugagcggcugaaaagaauggcgaucagcggagacgacuguguggucaagccgauugaugaccgcuuugccacagcucucaccgcccugaaugauaugggcaaggugcggaaagacaucccucagugggaacccucuaagggguggaacgauuggcagcagguuccuuucugcucccaccacuuucaucaacuuauuaugaaagacggcagagagaucgugguccccugucgcaaucaggaugagcuggugggacgggcuagagucagccagggcgccggguggucccuccgcgaaacggcuugccugggaaagucuuaugcccagauguggcaacugauguacuuccaccggagagaccuccgccuggcggccaacgcuauuuguagcgccgugccuguugauugggugcccacaucccggaccacauggagcauccaugcccaccaucaguggaugaccacggaggacaugcuuucugucuggaauagaguguggauugaagagaacccguggauggaagauaaaacccacaucuccagcuggggcgacguuccuuaucuggggaagcgcgaggaccaguggugcggaucucucaucggccugacagcucgggccaccugggcgacaaauauucaaguggcuaucaaccaggucagacggcuuauugggaaugagaacuaccuggauuacaugaccagcaugaagagauuuaaaaaugaauccgaccccgagggcgcccucugguga

SEQ ID NO: 18867 - RNA, 9879 nt, Artificial Sequence
  derived and/or modified CDS sequence (opt5) from DENV-1__FJ182022__SS-prME
agcgugaccaugcugcucaugcugaugcccaccgcccuugcuuuccaccugacgaccagaggaggggaaccucauaugaucgucuccaagcaggaacggggaaaaucucuccuguuuaagacaagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugcgggggaugagcuaugugauguguaccggcucuuucaagcucgagaaagaagucgcugagacccagcacggaacagugcugguucagauuaaguacgagggcaccgacgccccgugcaagaucccuuucuccacacaagaugaaaaaggggugacgcagaacggaagacugaucaccgcgaaucccauugucacagacaaggagaaaccugugaacaucgaagcugagccgcccuuuggcgagagcuauauugugaucggggccggagaaaaggcccuuaaacucucuugguucaagaagggcagcuccauugggaaaauguuugaggcuaccgcccgcggcgcucggagaauggccauccugggagauacagcgugggacuucggcucuaucgggggaguuuuuaccagcgucggcaagcuggugcaucagauuuucgggacggccuacggagugcucuuuuccggcgucagcuggaccaugaaaaucgggauuggcgugcugcuuacauggcugggacucaauucucgcuccaccagccugucuaugacauguaucgcuguuggccuggugacccuuuaccucggggucauggugcaggccgauuccggaugcguuauuaacuggaagggccgggaacugaaaugugggagcggaaucuucgugacaaaugagguccacaccuggacggaacaauauaaguuucaggcugacuccccuaagagacugucugccgcgauuggcaaagccugggaggagggggugugcggcauccgcagcgcuacacggcucgaaaacaucauguggaagcagauuuccaacgagcugaaucauauccuucuggaaaacgacaugaaauucaccguuguggucggagauguggccggcauucucgcucaggggaagaaaaugaucagaccgcaacccauggagcacaaguacucuuggaaaagcuggggaaaggccaagauuaucggcgccgacgugcagaauaccacauuuaucauugaugggccuaacacccccgaauguccugacgaucagcgcgcuuggaauaucugggaggucgaggacuauggauucggcauuuuuacgacaaacaucuggcugaaacugcgggauuccuacacccagguuugcgaccacagacuuaugagcgcggccauuaaggauucuaaagcugugcaugccgacaugggcuauuggaucgaauccgagaagaaugaaacauggaaacucgcccgcgcuagcuucaucgaggugaagaccuguauuuggcccaagucucacacacugugguccaacgggguccuggaaagcgagaugaucauuccgaaaaucuacggaggcccuauuucucaacauaauuaucggcccggguacuucacccagacggccggaccuuggcaccucggcaagcuggagcuugauuuugaccugugcgaagggaccacagugguuguggaugagcacugcggaaacagaggccccagccuccggaccacaaccgucacgggcaaaaucauccaugaaugguguugccgcuccuguacacugccuccccugagauucagaggggaagacggaugcugguacggcauggagauucggccggugaaggaaaaagaggaaaaucuuguuaagagcauggugucugcgggguccggagaggucgacagcuuuucccucggccugcuguguaucucuauuaugaucgaagaggugaugcgcagccggugguccagaaagaugcucaugaccgggacacuggcuguuuucuuucuucugauuaugggacagcucaccuggaacgaucugauccgccugugcauuauggugggcgccaaugccucugacagaaugggcauggggaccacauaucuugcucugauggccacguucaaaaugcggccuauguuugcggucggacuccuguuccgcagacucaccagccgggaggugcugcuucugacaaucggccucucccugguggcuucugucgaacugcccaacagccuugaggaacugggggauggacucgccaugggcaucaugauucugaagcuccugaccgacuuucaaucccaccagcuuugggccacacugcucagccugaccuucaucaaaacgacauuuucucugcauuacgcuuggaagaccauggccaugguucuuuccauugugagccuguucccccucugucugucuaccacaucccagaaaaccacauggcucccugugcugcuugggagccugggaugcaagccgcugacgauguuucucaucgcugagaauaagauuuggggccgcagaucuuggccccugaacgaaggcaucauggccgucgggaucguguccauucuucugagcucccuccugaaaaacgauguuccucucgcgggaccccugaucgccggcgggaugcuuauugcuuguuaugugaucagcggaucuagcgccgaccugucccuggagaaggcugccgaggucucuugggaagaggaagccgagcacagcggcgcuucccauaauauucucguggaaguucaggaugacgggaccaugaaaaucaaggaugaggagcgggacgauacacugaccauccuucugaaagcgacacuccuggccgugucuggagucuacccucucagcauucccgcuacccuguucgugugguauuucuggcaaaagaaaaagcagcgcuccggcguccuuugggacacgccuucucccccggaaguggagagagccguucuggaugacggcaucuaccggauuaugcagcgcgggcugcucggaagaagccaggugggcgucgggguguuucaagaaaacguuuuccacaccauguggcacgugacacggggagccguccugauguaucagggcaagagacuugagccuuccugggcuagcgugaaaaaggaccugaucucuuacgggggaggcuggcgccuccagggcuccuggaauaccggggaggaagugcagguuauugccgucgagcccggcaagaacccuaagaaugugcaaacagcgcccggcaccuuuaaaacaccggaaggggaggugggagcuaucgcccuggauuucaagccuggcacgagcgggucucccauugucaaccgggaaggaaagaucgugggccucuacggcaaugggguugugaccacauccggaaccuaugucagcgccaucgcucaggccaaagcgucccaggagggcccucugcccgagauugaagacgagguguuuagaaagcgcaaccuuaccaucauggaucugcaucccgggucuggaaaaacacggagauaccugccugcuauuguucgcgaagccaucaagcggaaacucagaacgcugauucuugccccgacccgcguggucgcuagcgagauggccgaagcucugaagggcaugcccauccgguaucaaacaaccgccgugaaguccgagcacacagggaaagagaucguugaccucaugugccaugcgaccuucacgaugagacugcugagcccugugcggguccccaauuacaacaugauuaucauggaugaagcccacuuuacagacccuucuuccauugcugcccgcggcuauaucagcaccagagugggaaugggcgaggcugccgccauuuucaugaccgcuacacccccugggucuguggaagcguuuccgcagagcaaugccgucauccaggaugaggaacgggacauccccgagcgcuccuggaacucuggauacgaguggauuaccgauuucccuggcaagacaguuugguuugugcccagcaucaaauccgggaaugacauugcuaacugucucagaaagaauggaaaacgggugauccagcuuucuagaaagaccuucgauacggaauaucaaaagaccaagaacaacgacugggacuacgucgugaccacagauauuagcgagaugggcgccaauuuccgcgccgaccggguuaucgauccuagacgcugccugaagcccgugauucugaaagacgggccggaacgggucauccucgcuggcccuaugcccgugaccguugccuccgcggcucagagacgcggacggaucggcagaaaccauaauaaggagggggaucaguacauuuauaugggacagccccugaacaaugacgaggaucacgcccacuggacggaagccaaaaugcuucuggacaacaucaauaccccugagggcauuauccccgcucucuuugaaccugagcgcgaaaagagcgccgcgauugauggggaguacagacugcggggagaggcccgcaagacauucguggaacugaugagacggggcgaccucccggucuggcuuucuuauaaaguggcuuccgagggguuucaauacagcgaucgcagauggugcuucgacggcgaacggaacaaucagguccuggaggaaaacauggauguggagaucuggaccaaggagggagaacgcaaaaagcugcgcccccgguggcucgacgccagaacauauuccgacccucuggcucuuagagaguuuaaagaguucgccgcuggccggagaucuguuagcggggaucugauccucgagauuggaaagcugccccagcaucugacccagcgggcccaaaaugcgcucgacaaccuugugaugcugcacaauuccgaacagggcgggcgcgccuacagacaugcuauggaggagcugccugauacaaucgaaacccucaugcugcuugcccugauugcugugcucacgggaggcgucacacuguuuuuccugucuggccgggggcucggaaaaaccagcaucggccuucuguguguuauggccuccagcgugcugcucuggauggccucuguggagccccacuggauugcugcguccaucauccuggaauuuuuccuuaugguccugcucauuccggagccugaccgccagagaacaccccaggauaaccaacuggccuaugugguuaucgggcugcucuuuaugauucuuacaguggcugccaaugagaugggacugcuggaaaccacaaagaaggaccucggcaucgggcacgucgccguggagaaccaucaccaugcugccaugcuggaugucgaccuucacccugcgagcgccuggacgcuguacgcuguggccaccacaauuaucacccccaugaugcggcauacaauugaaaacaccacggcuaauaucucucucaccgccaucgcgaaccaggccgcuauucugaugggacuggauaaaggcuggccuaucuccaagauggacauuggcguuccccuccuugcccuggggugcuacagccaggugaauccgcugacacucaccgcugccguccugaugcuuguggcucacuaugccaucauuggaccuggccugcaagcgaaagccacacgcgaggcucagaagagaaccgccgcugggaucaugaaaaaccccacgguugauggaaucguggccauugaccucgaucccgucguguacgacgccaaguucgaaaagcagcugggccagaucaugcugcucauucuuuguacaucucaaauccugcugaugcggaccacaugggcgcucugcgagagcauuacccuggcuaccgggccucuuacaacgcugugggagggauccccgggcaaauuuuggaauaccacaaucgccgugucuauggcuaacaucuuccgcggcagcuaucucgccggggccggacuggcuuucucccugaugaaaagccucggcgggggaagacggggcaccggggcccagggagaaacacuuggcgagaaauggaagagacagcugaaucagcuguccaaaucugaauuuaacaccuacaagcgcagcggcauuauggagguugaccgguccgaagcgaaggaggggcucaaaagaggagagacgacaaagcacgccgucucucgcggcaccgcuaaacugcggugguucguggaaagaaaucuugugaagcccgaggggaaagucaucgaucugggauguggccgcgggggauggagcuauuacugcgccggccucaagaagguuaccgaagugaaaggcuauacaaaaggcgggccugggcaugaggaacccauuccuauggcuaccuacggguggaaccuggugaaacugcacuccggaaaggacgucuuuuucauucccccugagaaaugugauacacuccuuugcgacauuggcgagucuagcccgaaucccacgaucgaagaggggcggacccugagagugcugaagaugguugaaccuuggcuccgcggaaaccaauuuuguauuaaaauccugaaucccuacaugccuuccguggucgagacacuugagcagaugcagcggaagcauggcggcaugcuggugagaaacccccucagccgcaauucuacccacgaaauguauuggguuuccugcgggacaggaaacaucgugagcgccgucaauaugaccucucggaugcugcugaacagauucacgauggcgcaccgcaagccgaccuacgagagagauguggaccucggcgccgggacacggcauguggcugucgaaccugagguugccaaccuggauauuaucggacagcgcauugaaaauaucaaacacgagcauaaguccaccuggcacuaugacgaggauaaccccuacaaaacaugggcuuaucauggcagcuacgaagugaagcccucuggguccgccagcuccauggugaauggagucgugaaacuucugaccaagccuugggacguuauucccauggugacacaaaucgcuaugaccgauacgacaccuuuuggccagcagagagucuucaaggagaaaguggacacccggaccccgaaggccaaaagaggcacagcgcaaaucauggaaguuacggccaaguggcucuggggguuucugagccggaacaaaaagccccgcauuuguaccagagaggaguucacacggaaggugcgcucuaaugcugccaucggagcugucuuuguggacgagaaccaguggaauagcgccaaagaggccguugaagaugagagauucugggaccuugugcaccgggaacgcgagcugcacaagcagggcaaaugcgcgaccugcgucuauaacaugauggggaagagagagaaaaagcucggagaguuuggcaaggcuaaagggucccgggccauuugguacauguggcugggcgcccgcuuccuggaguucgaagcucucggauuuaugaaugaggaucauugguucucuagagaaaacagccuguccggcguggagggggagggacuucacaagcugggcuacauccuccgggacauuucuaaaaucccugggggaaauauguaugccgaugacacagcuggcugggauacccgcaucacagaagacgaucugcagaacgaggccagaauuaccgacaucauggaacccgagcaugcgcuucuggccaagagcauuuuuaaacucacguaccaaaauaaggucgugcggguucagcgcccugcuaaaaacgggaccgugauggaugucaucuccagacgggaccagagaggcucuggacaggugggcacauaugggcugaauaccuucacaaacauggaagcccaacugauucgccagauggagagcgagggaaucuuuucccccagcgaacucgagaccccgaaccuggcugaacgggugcuugauuggcuggagaaguacggcguugaaagacucaagcgcauggccaucucuggggacgacuguguggucaaaccuauugaugaccgguucgcgacggcccugacagcucuuaaugauaugggaaaggugagaaaagacaucccccagugggagccuuccaagggcuggaacgauuggcagcaaguucccuuuugcagccaccacuuccaucagcugauuaugaaagacgggcgcgagaucguggucccuugucggaaucaggaugaacucgugggcagagcccgcgucucucagggagcuggcuggucccugcgggagaccgccugccugggaaagagcuaugcucaaauguggcagcucauguacuuucacagacgcgaccugcggcuugccgcgaacgccauuuguuccgcugugcccguugauuggaucccgacaucuagaaccacguggagcauucaugcccaccaucaguggaugaccacagaagacaugcuguccguguggaaucgggucuggaucgaggaaaacccuuggauggaggauaagacccacaucagcucuuggggagacgugcccuaucucggcaaaagagaggaccaauggugcgggucccugauuggacuuacagcccgcgcuaccugggccacaaauauccagguugcgauuaaccaggugcggagacugaucggcaaugaaaacuaccucgauuacaugaccagcaugaagcgcuucaaaaaugagucugaccccgaaggggcucugugguga

SEQ ID NO: 18868 - RNA, 9879 nt, Artificial Sequence
  derived and/or modified CDS sequence (opt5) from DENV-1__FJ024447__SS-prME
agcgugaccaugcugcugaugcugaugcccacagcccuugcuuuccaccugacgaccagaggcggggagccucauaugaucguguccaagcaggaacggggaaaaucucuccuguuuaagacaagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccagacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaggaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaaguggugcaucagauuuucgggacggccuacggaguccuguuuuccggcgugagcuggaccaugaagaucgggauuggcguucuccugacauggcuuggacucaauucuagauccaccagccucucuaugacauguaucgcugugggccuggucacccuguaccuuggggugaugguucaggccgauuccggaugcgugauuaacuggaaaggccgcgaacucaagugugggagcggaaucuucgucacaaaugaggugcacaccuggacggaacaauauaaguuucaggcugacuccccuaaacggcugucugccgcgauuggcaaggccugggaggaggggguuugcggcaucagaagcgcuacacgccuggaaaacaucauguggaaacagauuuccaacgagcucaaucauauccugcuugaaaacgacaugaaguucaccguggucgugggagauguggccggcauucuggcucaggggaaaaagaugauccggccgcaacccauggaguacaaauauucuuggaaaagcuggggaaaggccaagauuaucggcgccgacguccagaauaccacauuuaucauugaugggccuaacacccccgaauguccugacgaucagagagcuuggaauaucugggagguugaggacuacggauucggcauuuuuacgacaaacaucuggcucaagcugcgcgauuccuauacccaggugugcgaccaccggcugaugagcgcggccauuaaagauucuaaggcugugcacgccgacaugggcuacuggaucgaauccgagaaaaaugaaacauggaaacuugccagagcuagcuucaucgaggucaagaccuguauuuggcccaaaucucauacacucugguccaacggggugcuggaaagcgagaugaucauuccgaagaucuauggaggcccuauuucucaacacaauuaccgccccggguacuucacccagacggccggaccuuggcaucugggcaaacucgagcuggauuuugaccuuugcgaagggaccacaguuguggucgaugagcacugcggaaaccggggccccagccugagaaccacaaccgugacgggcaagaucauccacgaaugguguugccgguccuguacacucccuccccugcgcuucagaggggaggacggaugcugguauggcauggagauucggccgguuaaagaaaaggaggaaaaucuggucaagagcauggucucugcgggguccggagagguggacagcuuuucccuuggccuccuguguaucucuauuaugaucgaagagguuaugagaagccgcuggucccggaaaaugcugaugaccgggacacucgcuguguucuuucugcuuauuaugggacagcugaccuggaacgaucucaucagacugugcauuauggucggcgccaaugccucugaccgcaugggcauggggaccacauaccuggcucuuauggccacguucaagaugagaccuauguuugcggugggacugcuguuccggcgccugaccagcagagaggugcuccugcuuacaaucggccugucccucgucgcuucuguugaacugcccaacagccuggaggaacuuggggauggacuggccaugggcaucaugauucucaaacugcucaccgacuuucaaucccaucagcugugggccacacuucugagccucaccuucaucaagacgacauuuucucugcacuaugcuuggaaaaccauggccauggugcuguccauugugagccuuuucccccugugucucucuaccacaucccagaagaccacauggcugccuguccuccuggggagccuuggaugcaagccgcugacgauguuucugaucgcugagaauaaaauuuggggccggcgcucuuggccccucaacgaaggcaucauggccguggggaucguuuccauucugcuuagcucccugcucaagaacgaugugccucuggcgggaccccucaucgccggcgggaugcugauugcuuguuacgucaucagcggaucuagcgccgaccuuucccuggagaaagcugccgaggugucuugggaagaggaagccgagcauagcggcgcuucccacaauauucugguugaagugcaggaugacgggaccaugaagaucaaagaugaggagagagacgauacacucaccauccugcuuaaggcgacacugcucgccgucucuggaguguauccucugagcauucccgcuacccucuucgucugguacuucuggcagaagaagaagcagcgguccggcgugcugugggacacgccuucucccccggaaguuggccgcgccgugcuugaugacgggaucuauagaauuaugcagcggggacugcugggccgcagccaggucggggugggaguuuuucaagagaacguguuccauaccauguggcacgucacaagaggcgccgugcucauguaccaggggaaacggcuggaaccuuccugggcuagcgugaagaaagaccuuaucucuuacggaggcggcuggagacugcagggguccuggaauaccggagaggagguucaggucauugccguggaacccggcaagaacccuaaaaaugugcaaacagcgcccgggaccuuuaagacaccggagggagaagucggcgcuaucgcccucgauuucaagccugggacgagcggaucucccauugugaaccgcgagggcaaaaucguuggccuguaugggaauggaguggucaccacauccggcaccuacgugagcgccaucgcucaggccaaggcgucccaggaagggccucuccccgagauugaggacgaaguuuuucggaaaagaaaccugaccaucauggaucuucaccccggaucuggcaagacacgccgguaucugccugcuauugugagagaggccaucaaacgcaagcugcggacgcucauucuggccccgaccagagucguggcuagcgaaauggccgaggcucuuaaggggaugcccauccgcuaccaaacaaccgccguuaaauccgaacauacaggcaaggagaucguggaccugaugugccacgcgaccuucacgaugcggcuccugagcccugucagagugcccaauuauaacaugauuaucauggaugaggcccauuuuacagacccuucuuccauugcugcccggggauacaucagcacccgcgugggcaugggggaagcugccgccauuuucaugaccgcuacacccccuggaucugucgaggcguuuccgcagagcaaugccguuauccaggaugaagagagagacauccccgaacgguccuggaacucuggcuaugaguggauuaccgauuucccugggaaaacagugugguuugugcccagcaucaaguccggaaaugacauugcuaacugucugcgcaaaaauggcaagagagucauccagcucucucggaagaccuucgauacggaguaccagaaaaccaagaacaacgacugggacuacgugguuaccacagauauuagcgaaaugggggccaauuucagagccgaccgcgugaucgauccucggagaugccuuaaacccgucauucugaaggacggcccggagcgcgugauccuggcuggaccuaugcccguuaccguggccuccgcggcucagcggagaggccgcaucgggcggaaccacaauaaagaaggagaucaguauauuuacaugggccagccccucaacaaugacgaggaucaugcccacuggacggaggccaagaugcugcuugacaacaucaauaccccugaagggauuauccccgcucuguuugagccugaaagagaaaagagcgccgcgauugauggagaauaucgccucagaggcgaggcccggaaaacauucgucgagcugaugcgcagaggggaccugccgguguggcucucuuacaaggucgcuuccgaaggcuuucaauauagcgaucggcgcuggugcuucgacggagagagaaacaaucaggugcuugaagagaacauggauguugaaaucuggaccaaagagggcgagcggaagaaacugagaccccgcuggcuggacgcccggacauacuccgacccucucgcucugagagaauuuaaggaguucgccgcugggcgccggucugugagcggagaucuuauccuggaaauuggcaaacucccccagcaccugacccagagagcccaaaaugcgcuggacaaccucgugaugcuucauaauuccgagcaagggggacgggccuaucgccacgcuauggaggaacugccugauacaaucgagacccugaugcuccuggcccuuauugcuguccugacgggcggcguuacacucuuuuuccugucugggagaggacugggcaagaccagcaucgggcuccuuugugugauggccuccagcgugcugcuguggauggccucugucgaaccccauuggauugcugcguccaucauccucgaguuuuuccugauggugcuucugauuccggaaccugaccggcagcgcacaccccaggauaaccaacucgccuacguugugaucggacugcuguuuaugauucucacagucgcugccaaugagaugggccuucuggagaccacaaagaaagaccuggggaucggacacguggccgucgaaaaccaccaucacgcugccaugcucgauguggaccugcauccugcgagcgccuggacgcuuuacgcuguugccaccacaauuaucacccccaugaugagacacacaauugagaacaccacggcuaauaucucucugaccgccaucgcgaaccaggccgcuauucucaugggccuggauaagggcuggccuaucuccaaaauggacauuggggugccccugcucgcccuuggaugcuauagccaggucaauccgcugacacugaccgcugccgugcucaugcugguugcucauuacgccaucauuggcccugggcuucaagcgaaggccacacgggaagcucagaaacgcaccgccgcuggaaucaugaagaaccccacgguggauggcaucgucgccauugaccuggaucccgugguguaugacgccaaguucgagaaacagcucgggcagaucaugcugcugauucucuguacaucucaaauccuucugaugagaaccacaugggcgcugugcgaaagcauuacccucgcuaccggaccucugacaacgcuuugggagggcuccccgggcaaguuuuggaauaccacaaucgccguuucuauggcuaacaucuuccgggggagcuaccuggccggagccggccucgcuuucucccugaugaaaagccucgggggaggccgcagagggaccggagcccagggcgagacacucggcgaaaaguggaaacggcagcuuaaucagcuguccaagucugaguuuaacaccuauaagagaagcgggauuauggaagucgaccgcuccgaggcgaaagaaggacugaagcggggcgagacgacaaaacacgccgugucuagagggaccgcuaagcuccgcugguucguggagcggaaucuggucaaacccgaaggaaagguuaucgaucuuggcugugggagaggaggcuggagcuacuauugcgccggccugaagaaagugaccgaggugaagggguacacaaaaggaggcccugggcacgaggagcccauuccuauggcuaccuacggauggaaccucgucaagcugcauuccggcaaagacguguuuuucauucccccugaaaagugugauacacugcucugcgacauuggggagucuagcccgaaucccacgaucgaggaaggacgcacccuucggguucugaaaaugguggagccuuggcugagaggcaaccaauuuuguauuaagauccucaaucccuauaugccuuccgucguggaaacacuggagcagaugcagcgcaagcacggcgggaugcuuguucggaacccccugagcagaaauucuacccaugagauguacuggguguccugcggaacaggcaacaucgucagcgccgugaauaugaccucucgcaugcuccugaaccgguucacgauggcgcacagaaaaccgaccuaugaacgcgauguggaccugggggccggaacaagacacgucgcuguugagccugaaguggccaaccucgauauuaucggccagcggauugagaauaucaagcaugaacacaaauccaccuggcauuacgacgaggauaaccccuauaagacaugggcuuaccacgggagcuaugaggugaaacccucuggauccgccagcuccauggucaauggcgugguuaagcugcuuaccaagccuugggacgugauucccauggucacacaaaucgcuaugaccgauacgacaccuuuuggccagcagcgcguguucaaagaaaagguugacaccagaaccccgaaagccaagcgggggacagcgcaaaucauggaggugacggccaaauggcuguggggauuucucagcagaaacaagaagccccggauuuguacccgcgaagaguucacaagaaaaguccggucuaaugcugccaucggcgcuguguuuguugacgaaaaccaguggaauagcgccaaggaggccguggaggaugaacgcuucugggaccugguccauagagagcgggaacuucacaaacaggggaagugcgcgaccugcguguacaacaugaugggaaaacgcgagaagaagcugggcgaauuugggaaagcuaagggcuccagagccauuugguacauguggcucggagcccgguuccuggaguucgaggcucugggcuuuaugaaugaagaucacugguucucucgcgagaacagccucuccggggucgaaggagagggccugcauaaacuuggguauauccugagagacauuucuaauaucccuggaggcaacauguacgccgaugacacagcugggugggauacccggaucacagaggacgaucuccagaaugaagcccgcauuaccgacaucauggagcccgaacacgcgcugcuugccaagagcauuuuuaaacugacguaucaaaacaaggugguuagagugcagcggccugcuaaaaauggcaccgucauggaugugaucucccgcagagaccagcggggaucuggccagguggggacauacggacucaacaccuucacaaacauggaggcccaacugauuagacagauggaaagcgagggcaucuuuucccccagcgagcuggaaaccccgaaucucgcugagcgcguucuggauuggcuugaaaaguaugggguggagcggcugaagagaauggccaucucuggagacgacugugucgugaaaccuauugaugaccgcuucgcgacggcccucacagcucugaacgauaugggcaagguucggaaagacaucccccagugggaaccuuccaagggguggaaugauuggcagcaagugcccuuuugcagccaucacuuccaccagcuuauuaugaaagacggcagagagaucgucgugccuugucgcaaccaggaugagcuggucggacgggccagagugucucagggcgcuggguggucccuccgcgaaaccgccugccugggaaagagcuacgcucaaauguggcagcugauguauuuucaucggagagaccuccgccuggccgcgaaugccauuuguuccgcuguucccguggauuggaucccgacaucucggaccacguggagcauucacgcccaucaccaguggaugaccacagaggacaugcuuuccgucuggaacagaguguggaucgaagagaauccuuggauggaagauaagacccauaucagcucuuggggcgacguucccuaccuggggaaacgggaggaccaauggugcggaucccucauuggccugacagccagagcuaccugggccacaaacauccagguggcgauuaaucagguccgccggcuuaucgggaacgagaauuaccuggauuauaugaccagcaugaagagauucaaaaacgaaucugaccccgagggcgcucucugguga

SEQ ID NO: 18869 - RNA, 9879 nt, Artificial Sequence
  derived and/or modified CDS sequence (opt5) from DENV-1__FJ182025__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccagacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaggaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccagacggccggaccuuggcaucucggcaaacuggagcuugauuuugaccugugcgaagggaccacagugguuguggaugagcacugcggaaaccggggccccagccucagaaccacaaccgucacgggcaagaucauccacgaaugguguugccgguccuguacacugccuccccugcgcuucagaggggaggacggaugcugguauggcauggagauucggccggugaaagaaaaggaggaaaaucuuguuaagagcauggugucugcgggguccggagaggucgacagcuuuucccucggccugcuguguaucucuauuaugaucgaagaggugaugagaagccgcuggucccggaaaaugcucaugaccgggacacuggcuguuuucuuucuucugauuaugggacagcucaccuggaacgaucugaucagacugugcauuauggugggcgccaaugccucugaccgcaugggcauggggaccacauaccuugcucugauggccacguucaagaugagaccuauguuugcggucggacuccuguuccggcgccucaccagcagagaggugcugcuucugacaaucggccucucccugguggcuucugucgaacugcccaacagccuugaggaacugggggauggacucgccaugggcaucaugauucugaaacuccugaccgacuuucaaucccaucagcuuugggccacacugcucagccugaccuucaucaagacgacauuuucucugcacuaugcuuggaaaaccauggccaugguucuuuccauugugagccuguucccccucugucugucuaccacaucccagaagaccacauggcucccugugcugcuugggagccugggaugcaagccgcugacgauguuucucaucgcugagaauaaaauuuggggccggcgcucuuggccccugaacgaaggcaucauggccgucgggaucguguccauucuucugagcucccuccugaagaacgauguuccucucgcgggaccccugaucgccggcgggaugcuuauugcuuguuacgugaucagcggaucuagcgccgaccugucccuggagaaagcugccgaggucucuugggaagaggaagccgagcauagcggcgcuucccacaauauucucguggaaguucaggaugacgggaccaugaagaucaaagaugaggagagagacgauacacugaccauccuucugaaggcgacacuccuggccgugucuggagucuauccucucagcauucccgcuacccuguucgugugguacuucuggcagaagaagaagcagcgguccggcguccuuugggacacgccuucucccccggaagugggccgcgccguucuggaugacgggaucuauagaauuaugcagcggggacugcucggccgcagccaggugggggucggaguguuucaagagaacguuuuccauaccauguggcacgugacaagaggcgccguccugauguaccaggggaaacggcuugaaccuuccugggcuagcgugaagaaagaccugaucucuuacggaggcggcuggagacuccagggguccuggaauaccggagaggaggugcagguuauugccgucgaacccggcaagaacccuaaaaaugugcaaacagcgcccgggaccuuuaagacaccggagggagaagugggcgcuaucgcccuggauuucaagccugggacgagcggaucucccauugucaaccgcgagggcaaaaucgugggccucuaugggaauggaguugugaccacauccggcaccuacgucagcgccaucgcucaggccaaggcgucccaggaagggccucugcccgagauugaggacgaaguguuucggaaaagaaaccuuaccaucauggaucugcaccccggaucuggcaagacacgccgguaucugccugcuauuguuagagaggccaucaaacgcaagcuccggacgcugauucuugccccgaccagaguggucgcuagcgaaauggccgaggcucugaaggggaugcccauccgcuaccaaacaaccgccgugaaauccgaacauacaggcaaggagaucguugaccucaugugccacgcgaccuucacgaugcggcugcugagcccugugagaguccccaauuauaacaugauuaucauggaugaggcccauuuuacagacccuucuuccauugcugcccggggauacaucagcacccgcgugggcaugggggaagcugccgccauuuucaugaccgcuacacccccuggaucuguggaggcguuuccgcagagcaaugccgucauccaggaugaagagagagacauccccgaacgguccuggaacucuggcuaugaguggauuaccgauuucccugggaaaacaguuugguuugugcccagcaucaaguccggaaaugacauugcuaacugucuccgcaaaaauggcaagagagugauccagcuuucucggaagaccuucgauacggaguaccagaaaaccaagaacaacgacugggacuacgucgugaccacagauauuagcgaaaugggggccaauuucagagccgaccgcguuaucgauccucggagaugccugaaacccgugauucugaaggacggcccggagcgcgucauccucgcuggaccuaugcccgugaccguugccuccgcggcucagcggagaggccgcaucgggcggaaccacaauaaagaaggagaucaguauauuuacaugggccagccccugaacaaugacgaggaucaugcccacuggacggaggccaagaugcuucuggacaacaucaauaccccugaagggauuauccccgcucucuuugagccugaaagagaaaagagcgccgcgauugauggagaauaucgccugagaggcgaggcccggaaaacauucguggagcugaugcgcagaggggaccucccggucuggcuuucuuacaagguggcuuccgaaggcuuucaauauagcgaucggcgcuggugcuucgacggagagagaaacaaucagguccuggaagagaacauggauguggaaaucuggaccaaagagggcgagcggaagaaacugagaccccgcuggcucgacgcccggacauacuccgacccucuggcucuuagagaauuuaaggaguucgccgcugggcgccggucuguuagcggagaucugauccucgaaauuggcaaacugccccagcaccugacccagagagcccaaaaugcgcucgacaaccuugugaugcugcauaauuccgagcaagggggacgggccuaucgccacgcuauggaggaacugccugauacaaucgagacccucaugcugcuugcccugauugcugugcucacgggcggcgucacacuguuuuuccugucugggagaggacucggcaagaccagcaucgggcuucuguguguuauugccuccagcgugcugcucuggauggccucuguggaaccccauuggaucgcugcguccaucauucuggaguuuuuccuuaugguccugcucaucccggaaccugaccggcagcgcacaccccaggauaaccaacuggccuacgugguuauuggacugcucuuuaugauccuuacaguggcugccaaugagaugggccugcuggagaccacaaagaaagaccucgggauuggacacgucgccguggaaaaccaccaucacgcugccaugcuggaugucgaccuucauccugcgagcgccuggacgcuguacgcuguggccaccacaaucauuacccccaugaugagacacacaaucgagaacaccacggcuaauaucucucucaccgccauugcgaaccaggccgcuauccugaugggccuggauaagggcuggccuauuuccaaaauggacaucgggguuccccuccuugcccugggaugcuauagccaggugaauccgcugacacucaccgcugccguccugaugcuuguggcucauuacgccauuaucggcccugggcugcaagcgaaggccacacgggaagcucagaaacgcaccgccgcuggaaucaugaagaaccccacgguugauggcauuguggccaucgaccucgaucccgucguguaugacgccaaguucgagaaacagcuggggcagauuaugcugcucauccuuuguacaucucaaauucugcugaugagaaccacaugggcgcucugcgaaagcaucacccuggcuaccggaccucuuacaacgcugugggagggcuccccgggcaaguuuuggaauaccacaaucgccgugucuauggcuaacauuuuccgggggagcuaccucgccggagccggccuggcuuucucccugaugaaaagccucgggggaggccgcagagggaccggagcccagggcgagacacuuggcgaaaaguggaaacggcagcugaaucagcuguccaagucugaguuuaacaccuauaagagaagcgggaucauggaaguugaccgcuccgaggcgaaagaaggacucaagcggggcgagacgacaaaacacgccgucucuagagggaccgcuaagcugcgcugguucguggagcggaaucuugugaaacccgaaggaaaggucauugaucugggcugugggagaggaggcuggagcuacuauugcgccggccucaagaaaguuaccgaggugaagggguacacaaaaggaggcccugggcacgaggagcccaucccuauggcuaccuacggauggaaccuggugaagcugcauuccggcaaagacgucuuuuucauucccccugaaaagugugauacacuccuuugcgacaucggggagucuagcccgaaucccacgauugaggaaggacgcacccugcgggugcugaaaaugguugagccuuggcucagaggcaaccaauuuuguaucaagauccugaaucccuauaugccuuccguggucgaaacacuugagcagaugcagcgcaagcacggcgggaugcuggugcggaacccccucagcagaaauucuacccaugagauguacuggguuuccugcggaacaggcaacauugugagcgccgucaauaugaccucucgcaugcugcugaaccgguucacgauggcgcacagaaaaccgaccuaugaacgcgauguggaccucggggccggaacaagacacguggcugucgagccugaaguugccaaccuggauaucauuggccagcggaucgagaauauuaagcaugaacacaaauccaccuggcauuacgacgaggauaaccccuauaagacaugggcuuaccacgggagcuaugaggugaaacccucuggauccgccagcuccauggugaauggcgucgugaaacuucugaccaagccuugggacguuauccccauggugacacaaaucgcuaugaccgauacgacaccuuuuggccagcagcgcgucuucaaagaaaagguggacaccagaaccccgaaagccaagcgggggacagcgcaaauuauggagguuacggccaaauggcucuggggauuucugagcagaaacaagaagccccggaucuguacccgcgaagaguucacaagaaaagugcggucuaaugcugccauuggcgcugucuuuguggacgaaaaccaguggaauagcgccaaggaggccguugaggaugaacgcuucugggaccuugugcauagagagcgggaacugcacaaacaggggaagugcgcgaccugcgucuacaacaugaugggaaaacgcgagaagaagcucggcgaauuugggaaagcuaagggcuccagagccaucugguacauguggcugggagcccgguuccuggaguucgaggcucucggcuuuaugaaugaagaucacugguucucucgcgagaacagccuguccgggguggaaggagagggccuucauaaacugggguauauucucagagacaucucuaauaucccuggaggcaacauguacgccgaugacacagcugggugggauacccggauuacagaggacgaucugcagaaugaagcccgcaucaccgacauuauggagcccgaacacgcgcuucuggccaagagcaucuuuaaacucacguaucaaaacaaggucgugagaguucagcggccuaccaaaaauggcacagugauggaugucauuucccgcagagaccagcggggaucuggccagguggggaccuacggacugaacacauucaccaacauggaggcucaacugaucagacagauggaaagcgagggcaucuuuucccccagcgagcucgaaacgccgaaucuggccgagcgcgugcuugauuggcuggaaaaguaugggguugagcggcucaagagaauggcuauuucuggagacgacuguguggucaaaccuguggaugaccgcuucgccacagcgcugaccgcccuuaacgauaugggcaagguucggaaagacaucccccagugggaaccuuccaagggguggaaugauuggcagcaagugcccuuuugcagccaucacuuccaccagcugauuaugaaagacggcagagagaucgucgugccuugucgcaaccaggaugagcucgucggacgggcuagagugucucagggcgccggguggucccugcgcgaaacagcuugccugggaaagagcuacgcccaaauguggcagcucauguauuuucaucggagagaccugcgccuugcugccaaugcgauuuguuccgccguucccguggauuggaucccgaccucucggacgaccuggagcauucacgcucaucaccaguggaugacaaccgaggacaugcuguccgucuggaacagaguguggaucgaagagaauccuuggauggaagauaagacacauaucagcucuuggggcgacguucccuaccucgggaaacgggaggaccaauggugcggaucccugauuggccuuaccgccagagccacaugggcuaccaacauccagguggccauuaaucagguccgccggcugaucgggaacgagaauuaccucgauuauaugacgagcaugaagagauucaaaaacgaaucugaccccgagggcgcgcugugguga

SEQ ID NO: 18870 - RNA, 9879 nt, Artificial Sequence
  derived and/or modified CDS sequence (opt5) from DENV-1__FJ373297__SS-prME
agcgugaccaugcugcugaugcugaugcccaccgcccuugcuuuccaccugacgaccagaggcggggaaccucauaugaucgucuccaagcaggaacggggaaagucucuccuguuuaagacgagcgccggcguuaauaugugcacccuuauugcgauggaccugggggaacucugugaagauacaaugaccuacaagugcccgagaaucacagagguggaacccgacgauguggacuguuggugcaauaccacggauaccugggucacauauggaaccuguucccaaacaggcgagcacagacgggacaagcgcucuguggcucuggccccucauguugggcugggacucgagaccagagccgaaacguggaugagcuccgagggcgcuuggaaacagauucagaagguggaaacaugggcccugcggcaccccggcuucaccgucaucgcucuuuuucuggcccaugcgauugggacaucuaucacccagaagggaaucauuuucauccuccugaugcuugugaccccuagcauggccaugcgcugcguuggcauuggguccagagauuuuguggagggacugagcggcgcuacaugggucgacguggugcucgagcacgggucuugugucacgaccauggccaaagauaagcccacacuggacaucgaacugcucaaaaccgagguuacaaacccugcugugcugcggaaacuuugcauugaagccaaaaucuccaauaccacgacagauagccgcuguccgacccaaggagaggcgacccugguggaagaacaggacgccaacuucgucugcagacggacauuuguggaucgcggcuggggcaauggguguggacucuucggcaaggggucucugauuaccugcgcuaaguuuaaaugcguuacaaaacuugagggaaaaaucgugcaguacgaaaaccugaaguauuccgucaucgugacgguucacaccggcgaccagcaucaaguggggaaugagagcacagaacacggaaccacagccaccauuacgccccaggcuccuaccucugagauccagcucacagacuacggcgcccugacccuggauuguucccccagaacaggccucgacuucaacgaaaugguccugcuuaccaugaaagaaaagagcuggcuggugcauaaacagugguuucucgaucugccucuucccuggacguccggggccucuacaagccaagagaccuggaaucggcaggaccugcucgucacauucaagaccgcucacgcgaagaaacaggaagugguugugcugggaucccaagagggcgccaugcacaccgcucugacaggggccacggaaauucagaccagcggaacaaccacaaucuuugccggccaucucaagugccgccugaaaauggauaaacuuacccugaaagggaugucuuaugucauguguacgggccucuucaagcuggagaaggaaguggcugagacacagcacggaaccguucuggugcagauuaaauacgagggcaccgacgccccgugcaagaucccuuucuccacacaagaugaaaaaggggucacccagaacggaagacuuaucacagcgaaucccauugugacggacaaggagaaaccugugaacaucgaagcugagccgcccuuuggcgagagcuauauuguuaucggggccggagaaaaggcccucaagcugucuugguucaaaaagggcagcuccauugggaaaauguuugaggcuaccgcccggggcgcuagacgcauggccauccugggagauacagcgugggacuucggcucuaucgggggagucuuuaccagcgugggcaagcucgugcaucagauuuucgggacagccuacggaguccuguuuuccggcgugagcuggaccaugaaaaucgggauuggcguucuucugacguggcucggacucaauucucgguccaccagccugucuaugacauguaucgcugugggccuugucacccucuaccugggggugaugguucaggccgauuccggaugcgugauuaacuggaagggcagagaacugaagugugggagcggaaucuucgucacaaaugaggugcacaccuggacagaacaauauaaauuucaggcugacuccccuaagcgccucucugccgcgauuggcaaagccugggaggaggggguuugcggcauccggagcgcuaccagacuggaaaacaucauguggcgccagauuuccaacgagcuuaaucauauccugcucgaaaacgacaugaaguucacgguggucgugggagauguggucggcauucuggcccaggggaaaaagaugauccggccgcaacccauggagcacaaauacucuuggaaaagcuggggaaaggcuaagauuaucggcgccgacguucagaauacaaccuuuaucauugaugggccuaacacccccgaauguccugacgaucagagagccuggaauaucugggagguggaggacuauggauucggcauuuuuacaaccaacaucuggcugaaacuucgcgauuccuacacacaggugugcgaccaccggcucaugagcgcugcgauuaaagauucuaaggccguccaugcugacaugggcuauuggaucgaauccgagaaaaaugaaacauggaagcuggccagagccagcuucaucgaggugaagaccuguauuuggcccaaaucucacacacugugguccaacgggguucucgaaagcgagaugaucauuccgaagaucuacggaggcccuauuucucaacauaauuaucgccccggguacuucacccagacagcuggaccuuggcaccugggcaaacuugagcuggauuuugaccucugcgaagggaccacgguggucguggaugagcacugcggaaaccggggccccagccugagaaccacaaccguuacaggcaagaucauccaugaaugguguugccgguccuguacccugccuccccuucgcuucaaaggggaggacggaugcugguacggcauggagauuagaccggugaaggaaaaggaggaaaaucucgucaaaagcauggugucugccggguccggagagguugacagcuuuucccugggccugcucuguaucucuauuaugaucgaagaggugaugcggagcagauggucccgcaagaugcugaugacggggacacuugcggucuucuuucugcucauuaugggacagcugaccuggaacgaucugauccggucuugcauuauggugggcgcuaaugccagcgacagaaugggcauggggacaaccuaucuugcccugauggcuaccuucaaaaugcgcccuauguuugccgugggacuccuguucagacggcucacaucccgcgagguccugcuucugacgaucggccucucucugguugcgagcguggaacugcccaacucccuugaggaacugggggauggacucgcuaugggcaucaugauucugaagcuccugaccgacuuucaaagcuaccagcuuugggccacacugcucucucugaccuucaucaaaacaaccuuuucccugcacuaugccuggaagacgauggcuauggugcuuagcauugucucucugcucccccugugucucuccacaaccagccagaagaccacauggcugccugugcuucuggggucucugggaugcaaaccgcucaccauguuccugaucgccgagaauaagauuuggggcagaaaauccuggccccuuaacgaaggcaucauggcuguugggaucgugagcauucugcucuccagccugcucaagaacgaugucccucuggccggaccccuuaucgcgggcgggaugcugauugccuguuacgugaucucuggaagcuccgcugaccugucucucgagaaagccgcugagguuagcugggaagaggaagccgagcauuccggcgccucucacaauauucugguggaaguccaggaugacgggacaaugaagaucaaagaugaggagcgggacgauacgcuuaccauccugcucaaggcuacacugcucgcggugagcggagucuauccucuguccauucccgccacccuuuuugugugguacuucuggcaaaagaaaaagcagcgcucuggcguucugugggacacaccuagcccucccgaaguggagagagcuguccuggaugacggcaucuaucggauuaugcagcgcgggcuccugggaagaucccaggugggcguugggguguuccaagaaaacgucuuucauaccauguggcacgugacgcggggagccgugcuuauguaccagggcaaacgccuggagcccagcugggccucuguuaagaaagaccucaucuccuacgggggaggcuggagacugcagggcagcuggaauaccggggaggaaguccaggugauugcuguggagcccggaaagaacccuaagaauguccaaacagcccccggcaccuucaaaacaccggaaggggaggugggagcgaucgcucucgauuuuaagccuggcaccucugggucccccauuguuaaccgggaaggaaaaaucgugggccuguauggcaauggggucgugacaacgagcggaaccuacguuuccgccaucgcccaggcuaaggccucucaggagggcccucuucccgagauugaagacgagguguucagaaaacgcaaccugacaaucauggaucugcaccccgggagcggaaagacccggagauaucucccugcgauuguccgcgaagcuaucaagcggaaacugagaacccuuauucuggccccgacacgcgugguugccuccgagauggcugaagcccucaagggcaugcccauccgguaccaaacgaccgcugugaaaagcgagcauacagggagagagaucgucgaccugaugugccacgccaccuuuacaaugcgccugcucucuccugugcgggugcccaauuauaacaugauuaucauggaugaagcgcauuucaccgacccuuccagcauugccgcuagaggcuacaucucuacgcgggucggaaugggcgaggccgcugccauuuuuaugacagccacacccccugggagcguugaggcuuucccgcaguccaaugcggugauccaggaugaggaacgcgacauccccgagagaucuuggaacagcggauaugaguggauuaccgauuuuccuggcaagacagugugguucguccccuccaucaaaucugggaaugacauugccaacugucuucggaagaauggaaagcgcgugauccagcugagcagaaaaaccuuugauacagaauaccaaaagaccaaaaacaacgacugggacuacguugugacgacagauauuuccgagaugggcgcuaauuuccgggccgacagagucaucgauccucgccggugccugaagcccgugauucucaaagacgggccggaaagaguuauccuggccggcccuaugcccgugaccgucgcuagcgccgcgcagcgccggggaagaaucggccgcaaccacaauaaggagggggaucaguauauuuacaugggacagccccuuaacaaugacgaggaucaugcucacuggacagaagccaagaugcugcucgacaacaucaauaccccugagggcauuauccccgcccuguucgaaccugagcgggaaaaaucugcugccauugauggggaguauagacugcgcggagaggcgagaaagacguuuguggaacucaugcggcgcggcgaccuuccggucuggcuguccuacaaaguggccagcgagggguuccaauauuccgauagacgguggugcuuugacggcgaacgcaacaaucagguucuggaggaaaacauggauguggagaucuggaccaaggagggagaacgcaagaagcuccggcccagauggcuggacgcucgcacauacucugacccucuugcccugcgggaguucaaagaauuugcugccggcagacgcagcguguccggggaucucauccuggagauuggaaagcugccccagcaccucacccagcgggcucaaaaugcccuugacaaccuggucaugcugcauaauucugaacagggcgggagagcguaucggcacgccauggaggagcucccugauacaaucgaaacccugaugcuucuggcucucauugccguucugacaggaggcgugacccuguucuuucucagcggccgcgggcuuggaaagacguccaucggccugcugugugugauggcuagcucugcccuccuguggauggccuccgucgagccccauuggauugcugcgagcaucauccuugaguucuuucugauggugcuccugauuccggagccugacagacagcggacaccccaggauaaccaacuggccuacguugugaucgggcuccuuuucaugauucugaccgucgcugccaaugagaugggacugcucgaaaccaccaagaaggaccugggcaucgggcacguggccgucgagaaccaccaucacgcuaccaugcuugauguggaccugcauccugccucugcguggacacucuacgccguugcuacgaccauuaucacacccaugaugcgccacaccauugaaaacacaaccgccaauaucucccugacggcuaucgccaaccaggcggccauucugaugggacucgauaaaggcuggccuaucagcaagauggacauuggcgugccccuucuggcucuggggugcuauucucaggucaauccgcucacccugacagccgcugugcuuaugcugguugcccauuacgcuaucauuggaccuggccuccaagccaaagcgaccagagaggcccagaagcggacagcugccgggaucaugaagaaccccaccguggauggaaucgucgcuauugaccuggaucccgugguguaugacgccaaauuugaaaagcagcugggccagaucaugcuccuuauucuguguacgagccaaauccugcucaugcgcacaaccugggcccugugcgaguccauuacacuugcgaccgggccucugaccacacucugggagggaucuccgggcaaauucuggaauacgaccaucgcuguuagcauggccaacaucuuuagaggcuccuaccuggcuggggccggacuggccuucagccucaugaagucccuuggcgggggacggcgcggcacaggggcucagggagaaacccugggcgagaaauggaagagacagcugaaucagcucucuaagagcgaguucaacacauauaaacgguccggcauuauggaggucgacagaucugaagccaaggaggggcugcgccggggagagaccacgaaacacgcggugagcagaggcacagccaaacuucgcugguuuguggaacggaaucuggucaaacccgaggggaagguuaucgaucucggauguggcagagggggaugguccuacuauugcgcuggccugaagaaagugaccgaagugaagggcuacaccaaagggggaccuggccacgaggaacccauuccuauggccacauacggguggaaccuggucaagcuccauucuggaaaagacguguucuuuauucccccugagaagugugauacccuucugugcgacaucggcgagagcuccccgaaucccacaaucgaagaggggcgcacgcugcggguucucaaaaugguggaaccuuggcugagaggaaaccaauucuguauuaagauccuuaaucccuauaugccuagcgucguggagacccuggagcagaugcagcgcaagcacggcggcaugcucguucggaacccccugucuagaaauuccacacaugaaauguacugggugagcugcgggaccggaaacaucgucucugcugugaauaugacaucccgcaugcugcucaaccgguuuaccauggcccacagaaaaccgacguaugagcgcgauguggaccugggcgcggggaccagacacgucgccguugaaccugagguggcuaaccuugauauuaucggacagcggauugaaaauaucaagcaugagcacaaaagcacauggcauuacgacgaggauaaccccuauaagaccugggccuaccacggcucuuaugaagugaaacccuccgggagcgcuuccagcauggucaauggagugguuaagcugcucacaaagccuugggacgugauucccauggucacccaaaucgccaugacagauaccacgccuuucggccagcagcgcguguuuaaagagaagguugacacaagaaccccgaaagcuaagcggggcaccgcccaaaucauggaagugacagcgagauggcuguggggguuccuuucucggaacaaaaagccccgcauuuguacgagagaggaauuuacccggaagguccgcagcaaugccgcuaucggagccguguucguugacgagaaccaguggaacuccgcuaaagaggccguggaagaugagagauuuugggaccugguccaucgggaacgcgagcuccacaagcagggcaaaugcgccacaugcguguacaacaugauggggaagagagagaagaagcugggagaguucggcaaggcgaaagggucucgggcuauuugguacauguggcugggcgcccgcuuucucgaguucgaagcccugggauucaugaaugaggaucacugguuuagcagagaaaacucccuuucuggcgucgagggggagggacugcauaagcucggcuauauccugcgggacauuagcaaaaucccugggggaaauauguacgcugaugacaccgccggcugggauacacgcaucaccgaagacgaucuucagaacgaggcuaagauuacagacaucauggaacccgagcacgcccugcucgcgaccuccauuuucaaacugacguaucaaaauaaggugguuagagugcagcggccugcccgcaacgggaccgucauggaugugaucucuagacgggaccagagaggcagcggacaggugggcacauacgggcugaauaccuuuacaaacauggaagcucaacucauucgccagauggaguccgagggaaucuucagccccucugaacuggagaccccgaaccuugccgaacggguucuggauuggcucgagaaacauggcguggaaagacugaagcgcauggcuaucuccggggacgacugugucgugaagccuauugaugaccgguuugccacggcgcuuagcgcccugaaugauaugggaaaaguuagaaaggacaucccccagugggagccuucuaaaggcuggaacgauuggcagcaagugcccuucugcucccaccacuuucaucagcucauuaugaaggacgggcgcgagaucgucgugccuugucggaaucaggaugaacuggucggcagagcucgcgugagccagggagccggcuggucccugcgggagacagcuugccucgggaaaucuuaugcccaaauguggcagcugauguacuuccacagacgcgaccuucggcuggcugccaacgcgauuuguagcgccguucccguggauugggucccgaccaauagaacaaccugguccauccaugcucaccaucaguggaugacgaccgaagacaugcucagcguguggaaccggguuuggauugaggaaaauccuuggauggaggauaagacacacaucucuuccuggggagacgugcccuaucugggcaagagagaggaccaauggugcgggagccuuaucggacugaccgcccgcgccacaugggcuaccaacauucaggucgccaucaaucaggugcggagacucauuggcaacgaaaauuaccuggauuacaugacaucuaugaaacgcuuuaagaacgacagcgaucccgagggggcgcugugguga

SEQ ID NO: 18871 - RNA, 9879 nt, Artificial Sequence
  derived and/or modified CDS sequence (opt5) from DENV-1__FJ024448__SS-prME
agcgugaccaugcugcucaugcugaugcccaccgcccuugcuuuccaccugacgaccagaggaggggaaccucauaugaucguguccaagcaggaacggggaaaaucucuccuguuuaagacaagcgccggcguuaacaugugcacccuuauugcgauggaccugggggagcucugugaagauacaaucaccuacaaaugccccagaauuacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauccagcggguugaaaccugggcccugcgccaccccggcuucacagugauugcucuuuuucuggcccaugcgaucgggaccucuaucacccagaagggaauuaucuucauucuccugaugcuugucacaccuagcauggccaugagaugcgugggcaucgggucccgggauuuuguugagggacugagcggcgcuacguggguggacgucgugcucgagcacgggucuugugugaccacaauggccaaggauaaacccacccuggacauugaacugcucaagacagaggucaccaacccugcuguucugcgcaaacuuugcaucgaagccaagauuuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugaucacaugcgcuaaguuuaagugcgugacgaaacuugagggaaagaucguucaguacgaaaaccugaaauauuccgugauugucaccgugcacacaggcgaccagcaucaaguugggaaugagagcaccgaacacggaacaaccgccacgaucacaccccaggcuccuacaaccgagauucagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauccagaccuccggaacaaccacgauuuuugccggccaucucaaaugcagacugaagauggauaaacuuacacugcgggggaugagcuaugugauguguaccggcucuuucaagcucgagaaagaagucgcugagacccagcacggaacagugcugguucagaucaaguacgagggcaccgacgccccgugcaagaucccuuucuccacacaagaugaaaaaggggugacgcagaacggaagacugauuaccgcgaaucccaucgucacagacaaggagaaaccugugaacauugaagcugagccgcccuuuggcgagagcuauaucgugauuggggccggagaaaaggcccuuaaacucucuugguucaagaagggcagcuccaucgggaaaauguuugaggcuaccgcccgcggcgcucggagaauggccauccugggagauacagcgugggacuucggcucuauugggggaguuuuuaccagcgucggcaagcuggugcaucagaucuucgggacggccuacggagugcucuuuuccggcgucagcuggaccaugaaaauugggaucggcgugcugcuuacauggcugggacucaauucucgcuccaccagccugucuaugacauguauugcuguuggccuggugacccuuuaccucggggucauggugcaggccgauuccggaugcguuaucaacuggaagggccgggaacugaaaugugggagcggaauuuucgugacaaaugagguccacaccuggacggaacaauauaaguuucaggcugacuccccuaagagacugucugccgcgaucggcaaagccugggaggagggggugugcggcauccgcagcgcuacacggcucgaaaacauuauguggaagcagaucuccaacgagcugaaucauauucuucuggaaaacgacaugaaauucaccguuguggucggagauguggccggcauccucgcucaggggaagaaaaugauuagaccgcaacccauggagcacaaguacucuuggaaaagcuggggaaaggccaagaucaucggcgccgacgugcagaauaccacauuuauuaucgaugggccuaacacccccgaauguccugacgaucagcgcgcuuggaauauuugggaggucgaggacuauggauucggcaucuuuacgacaaacauuuggcugaaacugcgggauuccuacacccagguuugcgaccacagacuuaugagcgcggccaucaaggauucuaaagcugugcaugccgacaugggcuauuggaucgaauccgagaagaaugaaacauggaaacucgcccgcgcuagcuucauugaggugaagaccuguaucuggcccaagucucacacacugugguccaacgggguccuggaaagcgagaugauuaucccgaaaauuuacggaggcccuaucucucaacauaauuaucggcccggguacuucacccagacggccggaccuuggcaccucggcaagcuggagcuugauuuugaccugugcgaagggaccacagugguuguggaugagcacugcggaaacagaggccccagccuccggaccacaaccgucacgggcaaaaucauucaugaaugguguugccgcuccuguacacugccuccccugagauucagaggggaagacggaugcugguacggcauggagauccggccggugaaggaaaaagaggaaaaucuuguuaagagcauggugucugcgggguccggagaggucgacagcuuuucccucggccugcuguguauuucuaucaugauugaagaggugaugcgcagccggugguccagaaagaugcucaugaccgggacacuggcuguuuucuuucuucugaucaugggacagcucaccuggaacgaucugauucgccugugcaucauggugggcgccaaugccucugacagaaugggcauggggaccacauaucuugcucugauggccacguucaaaaugcggccuauguuugcggucggacuccuguuccgcagacucaccagccgggaggugcugcuucugacaaucggccucucccugguggcuucugucgaacugcccaacagccuugaggaacugggggauggacucgccaugggcauuaugauccugaagcuccugaccgacuuucaaucccaccagcuuugggccacacugcucagccugaccuucauuaaaacgacauuuucucugcauuacgcuuggaagaccauggccaugguucuuuccaucgugagccuguucccccucugucugucuaccacaucccagaaaaccacauggcucccugugcugcuugggagccugggaugcaagccgcugacgauguuucucauugcugagaauaagaucuggggccgcagaucuuggccccugaacgaaggcaucauggccgucgggauuguguccauccuucugagcucccuccugaaaaacgauguuccucucgcgggaccccugauugccggcgggaugcuuaucgcuuguuaugugauuagcggaucuagcgccgaccugucccuggagaaggcugccgaggucucuugggaagaggaagccgagcacagcggcgcuucccauaauauccucguggaaguucaggaugacgggaccaugaaaaucaaggaugaggagcgggacgauacacugaccauucuucugaaagcgacacuccuggccgcuucuggaguguacccucucagcauccccgccacccuguucgucugguauuucuggcaaaagaaaaagcagcgcuccggcgugcuuugggacacgccuucucccccggaagucgagagagccgugcuggaugacggcauuuaccggaucaugcagcgcgggcugcucggaagaagccagguuggcgugggggucuuucaagaaaacguguuccacaccauguggcacguuacacggggagcugugcugauguaucagggcaagagacuugagccuuccugggccagcgucaaaaaggaccugauuucuuacgggggaggcuggcgccuccagggcuccuggaauaccggggaggaaguccaggugaucgcgguugagcccggcaagaacccuaagaauguccaaacagcucccggcaccuuuaaaacaccggaaggggaggugggagccauugcccuggauuucaagccuggcacgagcgggucucccaucgugaaccgggaaggaaagaucgucggccucuacggcaauggggugguuaccacauccggaaccuaugugagcgcuauugcccaggcgaaggcuucccaggagggcccucugcccgagaucgaagacgaggucuuuagaaagcgcaaccuuaccauuauggaucugcaucccgggucuggaaaaacacggagauaccugccugccaucgugcgcgaagccauuaagcggaaacucagaacgcugauccuugcuccgacccgcguuguggccagcgagauggcugaagcccugaagggcaugcccauccgguaucaaacaaccgcggucaaguccgagcacacagggaaagagauuguggaccucaugugccaugccaccuucacgaugagacugcugagcccuguucgggugcccaauuacaacaugaucauuauggaugaagcucacuuuacagacccuucuuccaucgccgcucgcggcuauauuagcaccagagucggaaugggcgaggccgccgcuaucuucaugaccgcgacacccccugggucuguggaagccuuuccgcagagcaaugcugugauccaggaugaggaacgggacauucccgagcgcuccuggaacucuggauacgaguggaucaccgauuucccuggcaagacagucugguuuguucccagcauuaaauccgggaaugacaucgccaacugucucagaaagaauggaaaacgggugauucagcuuucuagaaagaccuucgauacggaauaucaaaagaccaagaacaacgacugggacuacguggucaccacagauaucagcgagaugggcgccaauuuccgcgcugaccgggugauugauccuagacgcugccugaagcccguuauccugaaagacgggccggaacgggugauccucgccggcccuaugcccgucaccguggcguccgcugcccagagacgcggacggauuggcagaaaccauaauaaggagggggaucaguacaucuauaugggacagccccugaacaaugacgaggaucacgcccacuggacggaagcuaaaaugcuucuggacaacauuaauaccccugagggcaucauucccgcccucuuugaaccugagcgcgaaaagagcgcggccaucgauggggaguacagacugcggggagaggcucgcaagacauucguugaacugaugagacggggcgaccucccgguguggcuuucuuauaaagucgccuccgagggguuucaauacagcgaucgcagauggugcuucgacggcgaacggaacaaucaggugcuggaggaaaacauggaugucgagaucuggaccaaggagggagaacgcaagaaacugcgcccccgguggcucgacgcuagaacauauuccgacccucuggcccuucgcgaguuuaaagaguucgcugccggccggagaucugugagcggggaucugauucucgagaucggaaaacugccccagcaucugacccagcgggcgcaaaaugcccucgacaaccuuguuaugcugcacaauuccgaacagggcgggcgcgcuuacagacaugccauggaggagcugccugauacaauugaaacccucaugcugcuugcucugaucgccgugcucacgggaggcgugacacuguuuuuccugucuggccgggggcucggaaaaaccagcauuggccuucugugugucauggccuccagcguucugcucuggauggcuucuguggagccccacuggaucgcggccuccaucauucuggaauuuuuccuuauggugcugcucaucccggagccugaccgccagagaacaccccaggauaaccaacuggcuuaugucgugauugggcugcucuuuaugauccuuacaguugccgccaaugagaugggacugcuggaaaccacaaagaaggaccucggcauugggcacguggcugucgagaaccaucaccaugccgcgaugcuggauguggaccuucacccugccagcgcuuggacgcuguacgccgucgcuaccacaaucauuacccccaugaugcggcauacaaucgaaaacaccacggccaauaucucucucaccgcgauugccaaccaggcugccauccugaugggacuggauaaaggcuggccuauuuccaagauggacaucggcgugccccuccuugcucuggggugcuacagccagguuaauccgcugacacucaccgccgcugugcugaugcuugucgcccacuaugcgauuaucggaccuggccugcaagccaaagcuacacgcgaggcccagaagagaaccgcugccgggaucaugaaaaaccccacgguggauggaauuguugccaucgaccucgaucccguggucuacgacgcgaaguucgaaaagcagcugggccagauuaugcugcucauccuuuguacaucucaaauucugcugaugcggaccacaugggcucucugcgagagcaucacccuggccaccgggccucuuacaacgcugugggagggauccccgggcaaauuuuggaauaccacaaucgcugugucuauggccaacauuuuccgcggcagcuaucucgccggggcuggacuggccuucucccugaugaaaagccucggcgggggaagacggggcaccggggcgcagggagaaacacuuggcgagaaauggaagagacagcugaaucagcuguccaaaucugaauuuaacaccuacaagcgcagcggcaucauggagguggaccgguccgaagccaaggaggggcucaaaagaggagagacgacaaagcacgcuguuucucgcggcaccgccaaacugcggugguucgucgaaagaaaucuugugaagcccgaggggaaagugauugaucugggauguggccgcgggggauggagcuauuacugcgcuggccucaagaaggucaccgaaguuaaaggcuauacaaaaggcgggccugggcaugaggaacccaucccuauggccaccuacggguggaaccuggugaaacugcacuccggaaaggacguguuuuucauucccccugagaaaugugauacacuccuuugcgacaucggcgagucuagcccgaaucccacgauugaagaggggcggacccugagaguccugaagaugguggaaccuuggcuccgcggaaaccaauuuuguaucaaaauccugaaucccuacaugccuuccguuguggagacacuugagcagaugcagcggaagcauggcggcaugcuggucagaaacccccucagccgcaauucuacccacgaaauguauuggguguccugcgggacaggaaacauuguuagcgcggugaauaugaccucucggaugcugcugaacagauucacgauggcccaccgcaagccgaccuacgagagagaugucgaccucggcgcugggacacggcauguggccguggaaccugaggucgcuaaccuggauaucauuggacagcgcaucgaaaauauuaaacacgagcauaaguccaccuggcacuaugacgaggauaaccccuacaaaacaugggccuaucauggcagcuacgaaguuaagcccucuggguccgcuagcuccauggugaauggaguggucaaacuucugaccaagccuugggacgugauccccaugguuacacaaaucgccaugaccgauacgacaccuuuuggccagcagagaguguucaaggagaaagucgacacccggaccccgaaggcgaaaagaggcacagcccaaauuauggaagugacggcuaaguggcucuggggguuucugagccggaacaaaaagccccgcaucuguaccagagaggaguucacacggaagguucgcucuaaugccgcuauuggagccguguuugucgacgagaaccaguggaauagcgccaaagaggcgguggaagaugagagauucugggaccuuguucaccgggaacgcgagcugcacaagcagggcaaaugcgcuaccugcguguauaacaugauggggaagagagagaaaaagcucggagaguuuggcaaggccaaagggucccgggccaucugguacauguggcugggcgcucgcuuccuggaguucgaagcccucggauuuaugaaugaggaucauugguucucuagagaaaacagccuguccggcgucgagggggagggacuucacaagcugggcuacauucuccgggacaucucuaaaaucccugggggaaauauguaugcugaugacacagccggcugggauacccgcauuacagaagacgaucugcagaacgaggcgagaaucaccgacauuauggaacccgagcaugcccuucuggcuaagagcaucuuuaaacucacguaccaaaauaaggugguccgggugcagcgcccugccaaaaacgggaccguuauggaugugauuuccagacgggaccagagaggcucuggacaggucggcacauaugggcugaauaccuucacaaacauggaagcucaacugauccgccagauggagagcgagggaaucuuuucccccagcgaacucgagaccccgaaccuggccgaacgggugcuugauuggcuggagaaguacggcguggaaagacucaagcgcauggcgauuucuggggacgacuguguugugaaaccuaucgaugaccgguucgccacggcucugacagcccuuaaugauaugggaaaggucagaaaagacauuccccagugggagccuuccaagggcuggaacgauuggcagcaagugcccuuuugcagccaccacuuccaucagcugaucaugaaagacgggcgcgagauuguugugccuugucggaaucaggaugaacucgucggcagagcucgcgugucucagggagccggcuggucccugcgggagaccgcuugccugggaaagagcuaugcccaaauguggcagcucauguacuuucacagacgcgaccugcggcuugcggccaacgcuaucuguuccgccguccccguggauuggauuccgacaucuagaaccacguggagcauccaugcccaccaucaguggaugaccacagaagacaugcuguccguuuggaaucggguguggaucgaggaaaacccuuggauggaggauaagacccacauuagcucuuggggagacguccccuaucucggcaaaagagaggaccaauggugcgggucccugaucggacuuacagcucgcgccaccugggcgacaaauauucagguggcuaucaaccagguucggagacugauuggcaaugaaaacuaccucgauuacaugaccagcaugaagcgcuucaaaaaugagucugaccccgaaggggcccugugguga

SEQ ID NO: 18872 - RNA, 9879 nt, Artificial Sequence
  derived and/or modified CDS sequence (opt5) from DENV-1__FJ182026__SS-prME
agcgugaccaugcugcucaugcugaugcccaccgcccuugcuuuccaccugacgaccagaggcggggaaccucauaugaucguguccaagcaggaacgggggaaaucucuccuguuuaagaccagcgccggcguuaauaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaaaacgaaaaggggguuacgcagaauggacggcuuaucaccgcgaaccccauugugacagauaaagagaagccugucaauaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagacacagcgugggauuucggcucuaucgggggaguguuuaccagcguuggcaaacucguccaucagauuuucgggacggccuacggagugcuguuuuccggcgugagcuggaccaugaagaucgggauuggcguccuucugacauggcucggacugaacucuagauccaccagccugucuaugacauguaucgcugugggccuuguuacccucuaccugggggugaugguccaggccgacuccggaugcgugauuaauuggaaaggccgcgaacugaagugugggagcggaaucuucguuacaaacgaggugcacaccuggacggaacaauauaaguuucaggcugauuccccuaaacggcucucugccgcgauuggcaaggccugggaggagggggucugcggcaucagaagcgcuacacgccuggaaaacaucauguggaaacagauuuccaaugagcuuaaccauauccugcucgaaaaugacaugaaguucaccgugguugugggagacgucgccggcauucuggcucaggggaaaaagaugauccggccgcaacccauggaguacaaauauucuuggaaaagcuggggaaaggccaagauuaucggcgccgaugugcagaacaccacauuuaucauugacgggccuaauacccccgaauguccugaugaccagagagcuuggaacaucugggagguggaggauuacggauucggcauuuuuacgacaaauaucuggcugaaacuucgcgacuccuauacccaggucugcgaucaccggcucaugagcgcggccauuaaagacucuaaggcuguucacgccgauaugggcuacuggaucgaauccgagaaaaacgaaacauggaagcuggccagagcuagcuucaucgaggugaagaccuguauuuggcccaaaucucauacacugugguccaauggggugcucgaaagcgagaugaucauuccgaagaucuauggaggcccuauuucucaacacaacuaccgccccggguacuucacccagacggccggaccuuggcaucugggcaaacuugagcuggacuuugaucucugcgaagggaccacagucgugguugacgagcacugcggaaaucggggccccagccugagaaccacaaccgugacgggcaagaucauccacgaaugguguugccgguccuguacacugccuccccuucgcuucagaggggaggauggaugcugguauggcauggagauucggccggucaaagaaaaggaggaaaaccucgucaagagcaugguuucugcgggguccggagagguggacagcuuuucccugggccugcucuguaucucuauuaugaucgaagaggucaugagaagccgcuggucccggaaaaugcugaugaccgggacacuugcuguguucuuucugcucauuaugggacagcugaccuggaaugaccugaucagacuuugcauuaugguuggcgccaacgccucugaucgcaugggcauggggaccacauaccuggcucucauggccacguucaagaugagaccuauguuugcggugggacuccuguuccggcgccugaccagcagagagguccuucugcucacaaucggccugucccugguggcuucuguggaacuucccaauagccuggaggaacucggggacggacuggccaugggcaucaugauucucaaacugcuuaccgauuuucaaucccaucagcugugggccacacuccugagccugaccuucaucaagacgacauuuucucuucacuaugcuuggaaaaccauggccaugguccuguccauuguuagccucuucccccugugucucucuaccacaucccagaagaccacauggcugccugugcuucuggggagccugggaugcaagccgcucacgauguuucugaucgcugagaacaaaauuuggggccggcgcucuuggccccuuaacgaaggcaucauggccguggggaucgucuccauucugcucagcucccugcucaagaaugacgugccucuggcgggaccccuuaucgccggcgggaugcugauugcuuguuacguuaucagcggaucuagcgccgaucugucccucgagaaagcugccgaggugucuugggaagaggaagccgagcauagcggcgcuucccacaacauucuggucgaagugcaggacgaugggaccaugaagaucaaagacgaggagagagaugacacacuuaccauccugcucaaggcgacacugcucgccguuucuggaguguauccucugagcauucccgcuacccuuuucgucugguacuucuggcagaagaagaagcagcgguccggcgugcugugggauacgccuucucccccggaagucgagcgcgccgugcuggacgauggcaucuauagaauuaugcagcgggggcuccugggacgcagccagguuggcgugggggucuuucaagaaaauguguuccauaccauguggcacguuacaagaggagccgugcuuauguaccagggcaaacggcuggagccuuccugggcuagcgucaagaaagaccucaucucuuacgggggaggcuggagacugcagggcuccuggaacgccggggaggaaguccaggugauugcgguugagcccggaaagaauccuaaaaacguccaaaccgcucccggcacauuuaagaccccggaaggggaggugggagccaucgcccucgacuucaagccuggcacaagcgggucucccauugugaaucgcgaaggaaaaaucgucggccuguauggcaacggggugguuacgaccuccggaacauacgugagcgcuaucgcccaggcgaaggcuucccaggagggcccucuucccgagauugaagaugaggucuuucggaaaagaaaucugaccaucauggaccugcaccccgggucuggaaagacccgccgguaucucccugccauugugagagaagccaucaaacgcaagcugcggacacuuauucuggcuccgacgagaguuguggccagcgagauggcugaagcccucaagggcaugcccauccgcuaccaaaccacagcggucaaauccgagcauaccgggaaggagaucguggaucugaugugccacgccacauucaccaugcggcugcucagcccuguuagagugcccaacuauaauaugauuaucauggacgaagcucauuuuacggauccuucuuccauugccgcucggggcuacaucagcacacgcgucggaaugggcgaggccgccgcuauuuucaugaccgcgacacccccugggucuguggaagccuuuccgcagagcaacgcugugauccaggacgaggaaagagauauccccgagcgguccuggaacucuggauaugaguggauuacagacuucccuggcaaaaccgucugguuuguucccagcaucaaguccgggaacgauauugccaauugucuucgcaaaaacggaaagagagugauccagcugucucggaagacauucgacaccgaauaccagaagacgaagaacaaugauugggacuacguggucacaaccgacauuagcgagaugggcgccaacuucagagcugaucgcgugaucgacccucggagaugccugaaacccguuauucucaaggaugggccggaacgcgugauccuggccggcccuaugcccgucacaguggcguccgcugcccagcggagaggacgcaucggccggaaucacaacaaagagggggaccaguauauuuacaugggacagccccuuaauaacgaugaggaccaugcccacuggaccgaagcuaagaugcugcucgauaauaucaacacgccugagggcauuauccccgcccuguuugaaccugagagagaaaagagcgcggccauugacggggaguaucgccugagaggagaggcucggaaaaccuucguugaacucaugcgcagaggcgaucuuccgguguggcugucuuacaaggucgccuccgagggguuucaauauagcgaccggcgcuggugcuucgauggcgaaagaaauaaccaggugcuggaggaaaauauggacgucgagaucuggacaaaagagggagaacggaagaaacucagaccccgcuggcuggaugcucggaccuacuccgacccucuugcccugagagaguuuaaggaguucgcugccggccgccggucugugagcggggaccucauccuggagauuggaaaacugccccagcaccucacacagagagcgcaaaacgcccuugauaaucugguuaugcugcauaacuccgaacagggcgggcgggcuuaucgccacgccauggaggagcucccugacaccaucgaaacacugaugcuucuggcucucauugccgugcugaccggaggcgugacgcuguuuuuccucucuggcagagggcuuggaaagacaagcaucggccugcugugugucauggccuccagcguucuccuguggauggcuucuguggagccccauuggauugcggccuccaucauccuugaauuuuuccugauggugcuccugauuccggagccugaucggcagcgcacaccccaggacaaucaacuggcuuacgucgugaucgggcuccuuuuuaugauucugaccguugccgccaacgagaugggacugcucgaaacaaccaagaaagaucugggcaucgggcacguggcugucgagaaccaccaucacgccgcgaugcuugacguggaucugcauccugccagcgcuuggacacucuacgccgucgcuacgaccauuaucacacccaugaugagacacaccauugaaaauacaaccgccaacaucucucugacggcgaucgccaaucaggcugccauucugaugggacucgacaagggcuggccuaucuccaaaauggauauuggcgugccccuucuggcucuggggugcuauagccagguuaacccgcucacccugacagccgcugugcuuaugcuggucgcccauuacgcgaucauuggaccuggccuccaagccaaggcuacccgggaggcccagaaacgcacagcugccgggaucaugaagaaucccaccguggacggaaucguugccauugaucuggaccccguggucuaugaugcgaaguucgaaaaacagcugggccagaucaugcuccuuauucuguguacgucucaaauccugcucaugagaacaaccugggcucugugcgagagcauuacacuugccaccgggccucugaccacacucugggagggauccccgggcaaguuuuggaacacgaccaucgcugugucuauggccaauaucuuccggggcagcuaccuggccggggcuggacuggccuucucccucaugaaaagccuuggcgggggacgcagaggcacaggggcgcagggagaaacccugggcgagaaguggaaacggcagcugaaccagcucuccaagucugaauuuaauacauauaagagaagcggcauuauggagguggaccgcuccgaagccaaagaggggcugaagcggggagagaccacgaaacacgcuguuucuagaggcacagccaaacuucgcugguucgucgaacggaaccuggugaaacccgaggggaaggugaucgaccucggauguggcagagggggauggagcuacuauugcgcuggccugaagaaagucaccgaaguuaagggcuacaccaaagggggaccuggccacgaggaacccauuccuauggccacauacggguggaaucuggugaagcuccauuccggaaaagauguguuuuucauucccccugagaagugugacacccuucugugcgauaucggcgagucuagcccgaaccccacaaucgaagaggggcgcacgcugcggguccucaaaaugguggaaccuuggcugagaggaaaucaauuuuguauuaagauccuuaaccccuauaugccuuccguuguggagacccuggagcagaugcagcgcaagcacggcggcaugcucguccggaauccccugagcagaaacucuacacaugaaauguacuggguguccugcgggaccggaaauaucguuagcgcggugaacaugacaucucgcaugcugcucaaccgguucaccauggcccacagaaaaccgacguaugagcgcgacgucgaucugggcgcugggaccagacacguggccguggaaccugaggucgcuaaucuugacauuaucggacagcggauugaaaacaucaagcaugagcacaaauccacauggcauuacgaugaggacaaucccuauaagaccugggccuaccacggcagcuaugaaguuaaacccucuggguccgcuagcuccauggugaacggaguggucaagcugcucacaaagccuugggaugugauucccaugguuacccaaaucgccaugacagacaccacgccuuuuggccagcagcgcguguucaaagagaaggucgauacaagaaccccgaaagcgaagcggggcaccgcccaaaucauggaagugacagcuaaauggcuguggggguuucuuagcagaaauaagaagccccggauuuguacgcgcgaggaguucaccagaaaaguucggucuaacgccgcuaucggagccguguuugucgacgagaaucaguggaacagcgccaaggaggcgguggaagacgagcgcuucugggaucugguucauagagaacgggagcuccacaaacagggcaagugcgcuacaugcguguacaauaugauggggaaacgcgaaaagaagcugggagaguuuggcaaagccaagggguccagagccauuugguacauguggcugggcgcucgguuccucgaguucgaagcccugggauuuaugaacgaggaccacugguucucucgcgaaaauagccuuuccggcgucgagggggagggacugcauaaacucggcuauauccugagagauauuucuaagaucccugggggaaacauguacgcugacgauaccgccggcugggacacacggaucaccgaagaugaccuucagaaugaggcgcgcauuacagauaucauggaacccgagcacgcccugcucgcuaaaagcauuuuuaagcugaccuaucaaaacaaaguggucagagugcagcggccugccaagaaugggacgguuauggacgugaucucccgcagagaucagcggggcucuggacaggucggcaccuacgggcugaacacauucaccaacauggaagcucaacucauuagacagauggagagcgagggaaucuuuucccccagcgaacuggagacaccgaaucuugccgaacgcgugcuggacuggcucgagaaguauggcguggaacggcugaaaagaauggcgaucucuggggaugacuguguugugaagccuauugacgaucgcuucgccaccgcucuuacggcccugaacgacaugggaaaaguccggaaggauaucccccagugggagccuuccaaaggcuggaaugacuggcagcaagugcccuuuugcagccaucacuuccaccagcucauuaugaaggaugggagagagaucguugugccuugucgcaaccaggacgaacuggucggccgggcuagagugucucagggagccggcuggucccugcgcgagacagcuugccucggaaagagcuacgcccaaauguggcagcugauguauuuucaucggagagaucuucgccuggcggccaaugcuauuuguuccgccguccccguggacuggaucccgaccucucggacaaccuggagcauucacgcccaucaccaguggaugacgaccgaagauaugcucuccguuuggaacagaguguggaucgaggaaaauccuuggauggaggacaaaacacauaucagcucuuggggagauguccccuaccugggcaagcgggaggaccaauggugcgggucccuuauuggacugaccgcuagagccacaugggcgaccaacauccagguggcuauuaaucagguucgccggcucaucggcaacgaaaauuaccuggacuauaugacaagcaugaaaagauucaagaacgagucugaucccgaaggggcccugugguga

SEQ ID NO: 18873 - RNA, 9879 nt, Artificial Sequence
  derived and/or modified CDS sequence (opt5) from DENV-1__FJ182027__SS-prME
agcgugaccaugcugcucaugcugaugcccaccgcccuugcuuuccaccugacgaccagaggaggggaaccucauaugaucgucuccaagcaggaacggggaaaaucucuccuguuuaagacaagcgccggcguuaacaugugcacccuuauugcgauggaccugggggagcucugugaagauacaaucaccuacaaaugcccccgcauuacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauccagcggguugaaaccugggcccugcgccaccccggcuucacagugauugcucuuuuucuggcccaugcgaucgggaccucuaucacccagaagggaauuaucuucauucuccugaugcuugucacaccuagcauggccaugagaugcgugggcaucgggucccgggauuuuguugagggacugagcggcgcuacguggguggacgucgugcucgagcacgggucuugugugaccacaauggccaaggauaaacccacccuggacauugaacugcucaagacagaggucaccaacccugcuguucugcgcaaacuuugcaucgaagccaagauuuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugaucacaugcgcuaaguuuaagugcgugacgaaacuugagggaaagaucguucaguacgaaaaccugaaauauuccgugauugucaccgugcacacaggcgaccagcaucaaguugggaaugagagcaccgaacacggaacaaccgccacgaucacaccccaggcuccuacaaccgagauucagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauccagaccuccggaacaaccacgauuuuugccggccaucucaaaugcagacugaagauggauaaacuuacacugcgggggaugagcuaugugauguguaccggcucuuucaagcucgagaaagaagucgcugagacccagcacggaacagugcugguucagaucaaguacgagggcaccgacgccccgugcaagaucccuuucuccacacaagaugaaaaaggggugacgcagaacggaagacugauuaccgcgaaucccaucgucacagacaaggagaaaccugugaacauugaagcugagccgcccuuuggcgagagcuauaucgugauuggggccggagaaaaggcccuuaaacucucuugguucaagaagggcagcuccaucgggaaaauguuugaggcuaccgcccgcggcgcucggagaauggccauccugggagauacagcgugggacuucggcucuauugggggaguuuuuaccagcgucggcaagcuggugcaucagaucuucgggacggccuacggagugcucuuuuccggcgucagcuggaccaugaaaauugggaucggcgugcugcuuacauggcugggacucaauucucgcuccaccagccugucuaugacauguauugcuguuggccuggugacccuuuaccucggggucauggugcaggccgauuccggaugcguuaucaacuggaagggccgggaacugaaaugugggagcggaauuuucgugacaaaugagguccacaccuggacggaacaauauaaguuucaggcugacuccccuaagagacugucugccgcgaucggcaaagccugggaggagggggugugcggcauccgcagcgcuacacggcucgaaaacauuauguggaagcagaucuccaacgagcugaaucauauucuucuggaaaacgacaugaaauucaccguuguggucggagauguggccggcauccucgcucaggggaagaaaaugauuagaccgcaacccauggagcacaaguacucuuggaaaagcuggggaaaggccaagaucaucggcgccgacgugcagaauaccacauuuauuaucgaugggccuaacacccccgaauguccugacgaucagcgcgcuuggaauauuugggaggucgaggacuauggauucggcaucuuuacgacaaacauuuggcugaaacugcgggauuccuacacccagguuugcgaccacagacuuaugagcgcggccaucaaggauucuaaagcugugcaugccgacaugggcuauuggaucgaauccgagaagaaugaaacauggaaacucgcccgcgcuagcuucauugaggugaagaccuguaucuggcccaagucucacacacugugguccaacgggguccuggaaagcgagaugauuaucccgaaaauuuacggaggcccuaucucucaacauaauuaucggcccggguacuucacccagacggccggaccuuggcaccucggcaagcuggagcuugauuuugaccugugcgaagggaccacagugguuguggaugagcacugcggaaacagaggccccagccuccggaccacaaccgucacgggcaaaaucauucaugaaugguguugccgcuccuguacacugccuccccugagauucagaggggaagacggaugcugguacggcauggagauccggccggugaaggaaaaagaggaaaaucuuguuaagagcauggugucugcgggguccggagaggucgacagcuuuucccucggccugcuguguauuucuaucaugauugaagaggugaugcgcagccggugguccagaaagaugcucaugaccgggacacuggcuguuuucuuucuucugaucaugggacagcucaccuggaacgaucugauucgccugugcaucauggugggcgccaaugccucugacagaaugggcauggggaccacauaucuugcucugauggccacguucaaaaugcggccuauguuugcggucggacuccuguuccgcagacucaccagccgggaggugcugcuucugacaaucggccucucccugguggcuucugucgaacugcccaacagccuugaggaacugggggauggacucgccaugggcauuaugauccugaagcuccugaccgacuuucaaucccaccagcuuugggccacacugcucagccugaccuucauuaaaacgacauuuucucugcauuacgcuuggaagaccauggccaugguucuuuccaucgugagccuguucccccucugucugucuaccacaucccagaaaaccacauggcucccugugcugcuugggagccugggaugcaagccgcugacgauguuucucauugcugagaauaagaucuggggccgcagaucuuggccccugaacgaaggcaucauggccgucgggauuguguccauccuucugagcucccuccugaaaaacgauguuccucucgcgggaccccugauugccggcgggaugcuuaucgcuuguuaugugauuagcggaucuagcgccgaccugucccuggagaaggcugccgaggucucuugggaagaggaagccgagcacagcggcgcuucccauaauauccucguggaaguucaggaugacgggaccaugaaaaucaaggaugaggagcgggacgauacacugaccauucuucugaaagcgacacuccuggccgugucuggagucuacccucucagcauccccgcuacccuguucgugugguauuucuggcaaaagaaaaagcagcgcuccggcguccuuugggacacgccuucucccccggaaguggagagagccguucuggaugacggcauuuaccggaucaugcagcgcgggcugcucggaagaagccaggugggcgucgggguguuucaagaaaacguuuuccacaccauguggcacgugacacggggagccguccugauguaucagggcaagagacuugagccuuccugggcuagcgugaaaaaggaccugauuucuuacgggggaggcuggcgccuccagggcuccuggaauaccggggaggaagugcagguuaucgccgucgagcccggcaagaacccuaagaaugugcaaacagcgcccggcaccuuuaaaacaccggaaggggaggugggagcuauugcccuggauuucaagccuggcacgagcgggucucccaucgucaaccgggaaggaaagaucgugggccucuacggcaaugggguugugaccacauccggaaccuaugucagcgccauugcucaggccaaagcgucccaggagggcccucugcccgagaucgaagacgagguguuuagaaagcgcaaccuuaccauuauggaucugcaucccgggucuggaaaaacacggagauaccugccugcuaucguucgcgaagccauuaagcggaaacucagaacgcugauccuugccccgacccgcguggucgcuagcgagauggccgaagcucugaagggcaugcccauccgguaucaaacaaccgccgugaaguccgagcacacagggaaagagauuguugaccucaugugccaugcgaccuucacgaugagacugcugagcccugugcggguccccaauuacaacaugaucauuauggaugaagcccacuuuacagacccuucuuccaucgcugcccgcggcuauauuagcaccagagugggaaugggcgaggcugccgccaucuucaugaccgcuacacccccugggucuguggaagcguuuccgcagagcaaugccgucauccaggaugaggaacgggacauucccgagcgcuccuggaacucuggauacgaguggaucaccgauuucccuggcaagacaguuugguuugugcccagcauuaaauccgggaaugacaucgcuaacugucucagaaagaauggaaaacgggugauucagcuuucuagaaagaccuucgauacggaauaucaaaagaccaagaacaacgacugggacuacgucgugaccacagauaucagcgagaugggcgccaauuuccgcgccgaccggguuauugauccuagacgcugccugaagcccgugauccugaaagacgggccggaacgggucauccucgcuggcccuaugcccgugaccguugccuccgcggcucagagacgcggacggauuggcagaaaccauaauaaggagggggaucaguacaucuauaugggacagccccugaacaaugacgaggaucacgcccacuggacggaagccaaaaugcuucuggacaacauuaauaccccugagggcaucauucccgcucucuuugaaccugagcgcgaaaagagcgccgcgaucgauggggaguacagacugcggggagaggcccgcaagacauucguggaacugaugagacggggcgaccucccggucuggcuuucuuauaaaguggcuuccgagggguuucaauacagcgaucgcagauggugcuucgacggcgaacggaacaaucagguccuggaggaaaacauggauguggagaucuggaccaaggagggagaacgcaaaaagcugcgcccccgguggcucgacgccagaacauauuccgacccucuggcucuuagagaguuuaaagaguucgccgcuggccggagaucuguuagcggggaucugauucucgagaucggaaagcugccccagcaucugacccagcgggcccaaaaugcgcucgacaaccuugugaugcugcacaauuccgaacagggcgggcgcgccuacagacaugcuauggaggagcugccugauacaauugaaacccucaugcugcuugcccugaucgcugugcucacgggaggcgucacacuguuuuuccugucuggccgggggcucggaaaaaccagcauuggccuucuguguguuauggccuccagcgugcugcucuggauggccucuguggagccccacuggaucgcugcguccaucauucuggaauuuuuccuuaugguccugcucaucccggagccugaccgccagagaacaccccaggauaaccaacuggccuaugugguuauugggcugcucuuuaugauccuuacaguggcugccaaugagaugggacugcuggaaaccacaaagaaggaccucggcauugggcacgucgccguggagaaccaucaccaugcugccaugcuggaugucgaccuucacccugcgagcgccuggacgcuguacgcuguggccaccacaaucauuacccccaugaugcggcauacaaucgaaaacaccacggcuaauaucucucucaccgccauugcgaaccaggccgcuauccugaugggacuggauaaaggcuggccuauuuccaagauggacaucggcguuccccuccuugcccuggggugcuacagccaggugaauccgcugacacucaccgcugccguccugaugcuuguggcucacuaugccauuaucggaccuggccugcaagcgaaagccacacgcgaggcucagaagagaaccgccgcugggaucaugaaaaaccccacgguugauggaauuguggccaucgaccucgaucccgucguguacgacgccaaguucgaaaagcagcugggccagauuaugcugcucauccuuuguacaucucaaauucugcugaugcggaccacaugggcgcucugcgagagcaucacccuggcuaccgggccucuuacaacgcugugggagggauccccgggcaaauuuuggaauaccacaaucgccgugucuauggcuaacauuuuccgcggcagcuaucucgccggggccggacuggcuuucucccugaugaaaagccucggcgggggaagacggggcaccggggcccagggagaaacacuuggcgagaaauggaagagacagcugaaucagcuguccaaaucugaauuuaacaccuacaagcgcagcggcaucauggagguugaccgguccgaagcgaaggaggggcucaaaagaggagagacgacaaagcacgccgucucucgcggcaccgcuaaacugcggugguucguggaaagaaaucuugugaagcccgaggggaaagucauugaucugggauguggccgcgggggauggagcuauuacugcgccggccucaagaagguuaccgaagugaaaggcuauacaaaaggcgggccugggcaugaggaacccaucccuauggcuaccuacggguggaaccuggugaaacugcacuccggaaaggacgucuuuuucauucccccugagaaaugugauacacuccuuugcgacaucggcgagucuagcccgaaucccacgauugaagaggggcggacccugagagugcugaagaugguugaaccuuggcuccgcggaaaccaauuuuguaucaaaauccugaaucccuacaugccuuccguggucgagacacuugagcagaugcagcggaagcauggcggcaugcuggugagaaacccccucagccgcaauucuacccacgaaauguauuggguuuccugcgggacaggaaacauugugagcgccgucaauaugaccucucggaugcugcugaacagauucacgauggcgcaccgcaagccgaccuacgagagagauguggaccucggcgccgggacacggcauguggcugucgaaccugagguugccaaccuggauaucauuggacagcgcaucgaaaauauuaaacacgagcauaaguccaccuggcacuaugacgaggauaaccccuacaaaacaugggcuuaucauggcagcuacgaagugaagcccucuggguccgccagcuccauggugaauggagucgugaaacuucugaccaagccuugggacguuauccccauggugacacaaaucgcuaugaccgauacgacaccuuuuggccagcagagagucuucaaggagaaaguggacacccggaccccgaaggccaaaagaggcacagcgcaaauuauggaaguuacggccaaguggcucuggggguuucugagccggaacaaaaagccccgcaucuguaccagagaggaguucacacggaaggugcgcucuaaugcugccauuggagcugucuuuguggacgagaaccaguggaauagcgccaaagaggccguugaagaugagagauucugggaccuugugcaccgggaacgcgagcugcacaagcagggcaaaugcgcgaccugcgucuauaacaugauggggaagagagagaaaaagcucggagaguuuggcaaggcuaaagggucccgggccaucugguacauguggcugggcgcccgcuuccuggaguucgaagcucucggauuuaugaaugaggaucauugguucucuagagaaaacagccuguccggcguggagggggagggacuucacaagcugggcuacauucuccgggacaucucuaaaaucccugggggaaauauguaugccgaugacacagcuggcugggauacccgcauuacagaagacgaucugcagaacgaggccagaaucaccgacauuauggaacccgagcaugcgcuucuggccaagagcaucuuuaaacucacguaccaaaauaaggucgugcggguucagcgcccugcuaaaaacgggaccgugauggaugucauuuccagacgggaccagagaggcucuggacaggugggcacauaugggcugaauaccuucacaaacauggaagcccaacugauccgccagauggagagcgagggaaucuuuucccccagcgaacucgagaccccgaaccuggcugaacgggugcuugauuggcuggagaaguacggcguugaaagacucaagcgcauggccauuucuggggacgacuguguggucaaaccuaucgaugaccgguucgcgacggcccugacagcucuuaaugauaugggaaaggugagaaaagacauuccccagugggagccuuccaagggcuggaacgauuggcagcaaguucccuuuugcagccaccacuuccaucagcugaucaugaaagacgggcgcgagauuguggucccuugucggaaucaggaugaacucgugggcagagcccgcgucucucagggagcuggcuggucccugcgggagaccgccugccugggaaagagcuaugcucaaauguggcagcucauguacuuucacagacgcgaccugcggcuugccgcgaacgccaucuguuccgcugugcccguugauuggauuccgacaucuagaaccacguggagcauccaugcccaccaucaguggaugaccacagaagacaugcuguccguguggaaucgggucuggaucgaggaaaacccuuggauggaggauaagacccacauuagcucuuggggagacgugcccuaucucggcaaaagagaggaccaauggugcgggucccugaucggacuuacagcccgcgcuaccugggccacaaauauucagguugcgaucaaccaggugcggagacugauuggcaaugaaaacuaccucgauuacaugaccagcaugaagcgcuucaaaaaugagucugaccccgaaggggcucugugguga

SEQ ID NO: 18874 - RNA, 9879 nt, Artificial Sequence
  derived and/or modified CDS sequence (opt5) from DENV-1__FJ024449__SS-prME
agcgugaccaugcugcucaugcugaugcccacagcccuugcuuuccaccugacgaccagaggcggggagccucauaugaucguguccaagcaggaacggggaaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauuaucauuggggccggagaaaaagcccuuaagcucucuugguucaagaaaggcagcuccaucgggaagauguuugaggcuaccgccagaggcgcucgccggauggccauccugggagauacagcgugggacuucggcucuauugggggaguguuuaccagcguuggcaaacugguccaucagaucuucgggacggccuacggagugcucuuuuccggcgugagcuggaccaugaagauugggaucggcguccugcuuacauggcugggacucaauucuagauccaccagccugucuaugacauguauugcugugggccugguuacccuuuaccucggggugaugguccaggccgauuccggaugcgugaucaacuggaaaggccgcgaacugaagugugggagcggaauuuucguuacaaaugaggugcacaccuggacggaacaauauaaguuucaggcugacuccccuaaacggcugucugccgcgaucggcaaggccugggaggagggggucugcggcaucagaagcgcuacacgccucgaaaacauuauguggaaacagaucuccaacgagcugaaucauauucuucuggaaaacgacaugaaguucaccgugguugugggagaugucgccggcauccucgcucaggggaaaaagaugauucggccgcaacccauggaguacaaauauucuuggaaaagcuggggaaaggccaagaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaagcugcgcgauucccacacccaggucugcgaccaccggcuuaugagcgcggccaucaaagauucuaaggcuguucaugccgacaugggcuauuggaucgaauccgagaaaaaugaaacauggaagcucgccagagcuagcuucauugaggugaagaccuguaucuggcccaaaucucacacacugugguccaacggggugcuggaaagcgagaugauuaucccgaagauuuacggaggcccuaucucucaacauaauuaucgccccggguacuucacccagacggccggaccuuggcaccucggcaaacuggagcuugauuuugaccugugcgaagggaccacagucgugguugaugagcacugcggaaaccggggccccagccucagaaccacaaccgugacgggcaagaucauucaugaaugguguugccgguccuguacacugccuccccugcgcuucagaggggaggacggaugcugguacggcauggagauccggccggucaaagaaaaggaggaaaaucuugucaagagcaugguuucugcgggguccggagagguggacagcuuuucccucggccugcuguguauuucuaucaugauugaagaggucaugagaagccgcuggucccggaaaaugcucaugaccgggacacuggcuguguucuuucuucugaucaugggacagcucaccuggaacgaucugauuagacugugcaucaugguuggcgccaaugccucugaccgcaugggcauggggaccacauaucuugcucugauggccacguucaagaugagaccuauguuugcggugggacuccuguuccggcgccucaccagcagagagguccugcuucugacaaucggccucucccugguggcuucuguggaacugcccaacagccuugaggaacugggggauggacucgccaugggcauuaugauccugaaacuccugaccgacuuucaaucccaccagcuuugggccacacugcucagccugaccuucauuaagacgacauuuucucugcauuacgcuuggaaaaccauggccaugguccuuuccaucguuagccuguucccccucugucugucuaccacaucccagaagaccacauggcucccugugcugcuugggagccugggaugcaagccgcugacgauguuucucauugcugagaauaaaaucuggggccggcgcucuuggccccugaacgaaggcaucauggccguggggauugucuccauccuucugagcucccuccugaagaacgaugugccucucgcgggaccccugauugccggcgggaugcuuaucgcuuguuauguuauuagcggaucuagcgccgaccugucccuggagaaagcugccgaggugucuugggaagaggaagccgagcacagcggcgcuucccauaauauccucgucgaagugcaggaugacgggaccaugaagaucaaagaugaggagagagacgauacacugaccauucuucugaaggcgacacuccuggccguuucuggaguguacccucucagcauccccgcuacccuguucgucugguauuucuggcagaagaagaagcagcgguccggcgugcuuugggacacgccuucucccccggaagucgagcgcgccgugcuggaugacggcauuuacagaaucaugcagcgggggcugcucggacgcagccagguuggcgugggggucuuucaagaaaacguguuccacaccauguggcacguuacaagaggagccgugcugauguaucagggcaaacggcuugagccuuccugggcuagcgucaagaaagaccugauuucuuacgggggaggcuggagacuccagggcuccuggaauaccggggaggaaguccaggugaucgccguugagcccggaaagaacccuaaaaauguccaaacagcgcccggcaccuuuaagacaccggaaggggaggugggagcuauugcccuggauuucaagccuggcacgagcgggucucccaucgugaaccgcgaaggaaaaaucgucggccucuacggcaauggggugguuaccacauccggaaccuaugugagcgccauugcucaggccaaggcgucccaggagggcccucugcccgagaucgaagacgaggucuuucggaaaagaaaccuuaccauuauggaucugcaucccgggucuggaaagacacgccgguaccugccugcuaucgugagagaagccauuaaacgcaagcuccggacgcugauccuugccccgaccagaguuguggcuagcgagauggccgaagcucugaagggcaugcccauccgcuaucaaacaaccgccgucaaauccgagcacacagggaaggagauuguggaccucaugugccaugcgaccuucacgaugcggcugcugagcccuguuagagugcccaauuacaacaugaucauuauggaugaagcccacuuuacagacccuucuuccaucgcugcccggggcuauauuagcacccgcgucggaaugggcgaggcugccgccaucuucaugaccgcuacacccccugggucuguggaagcguuuccgcagagcaaugccgugauccaggaugaggaaagagacauucccgagcgguccuggaacucuggauacgaguggaucaccgauuucccuggcaaaacagucugguuuguucccagcauuaaguccgggaaugacaucgcuaacugucuccgcaaaaauggaaagagagugauucagcuuucucggaagaccuucgauacggaauaucagaaaaccaagaacaacgacugggacuacguggucaccacagauaucagcgagaugggcgccaauuucagagccgaccgcgugauugauccucggagaugccugaaacccguuauccugaaggacgggccggaacgcgugauccucgcuggcccuaugcccgucaccguggccuccgcggcucagcggagaggacgcauuggccggaaccauaauaaagagggggaucaguacaucuauaugggacagccccugaacaaugacgaggaucacgcccacuggacggaagccaagaugcuucuggacaacauuaauaccccugagggcaucauucccgcucucuuugaaccugagagagaaaagagcgccgcgaucgauggggaguaccgccugagaggagaggcccggaaaacauucguugaacugaugcgcagaggcgaccucccgguguggcuuucuuauaaggucgcuuccgagggguuucaauacagcgaucggcgcuggugcuucgacggcgaaagaaacaaucaggugcuggaggaaaacauggaugucgagaucuggaccaaagagggagaacggaagaaacugagaccccgcuggcucgacgcccggacauauuccgacccucuggcucuuagagaguuuaaggaguucgccgcuggccgccggucugugagcggggaucugauucucgagaucggaaaacugccccagcaucugacccagagagcccaaaaugcgcucgacaaccuuguuaugcugcacaauuccgaacagggcgggcgggccuaccgccaugcuauggaggagcugccugauacaauugaaacccucaugcugcuugcccugaucgcugugcucacgggaggcgugacacuguuuuuccugucuggcagagggcucggaaagaccagcauuggccuucugugugucauggccuccagcguucugcucuggauggccucuguggagccccacuggaucgcugcguccaucauucuggaauuuuuccuuauggugcugcucaucccggagccugaccggcagcgcacaccccaggauaaccaacuggccuaugucgugauugggcugcucuuuaugauccuuacaguugcugccaaugagaugggacugcuggaaaccacaaagaaagaccucggcauugggcacguggccgucgagaaccaucaccaugcugccaugcuggauguggaccuucacccugcgagcgccuggacgcuguacgcugucgccaccacaaucauuacccccaugaugagacauacaaucgaaaacaccacggcuaauaucucucucaccgccauugcgaaccaggccgcuauccugaugggacuggauaagggcuggccuauuuccaaaauggacaucggcgugccccuccuugcccuggggugcuacagccagguuaauccgcugacacucaccgcugccgugcugaugcuugucgcucacuaugccauuaucggaccuggccugcaagcgaaggccacacgggaggcucagaaacgcaccgccgcugggaucaugaagaaccccacgguggauggaauuguugccaucgaccucgaucccguggucuacgacgccaaguucgaaaaacagcugggccagauuaugcugcucauccuuuguacaucucaaauucugcugaugagaaccacaugggcgcucugcgagagcaucacccuggcuaccgggccucuuacaacgcugugggagggauccccgggcaaguuuuggaauaccacaaucgccgugucuauggcuaacauuuuccggggcagcuaucucgccggggccggacuggcuuucucccugaugaaaagccucggcgggggacgcagaggcaccggggcccagggagaaacacuuggcgagaaguggaaacggcagcugaaucagcuguccaagucugaauuuaacaccuacaagagaagcggcaucauggagguggaccgcuccgaagcgaaagaggggcucaagcggggagagacgacaaaacacgccguuucuagaggcaccgcuaagcugcgcugguucgucgaacggaaucuugugaaacccgaggggaaggugauugaucugggauguggcagagggggauggagcuauuacugcgccggccucaagaaagucaccgaaguuaagggcuauacaaaagggggaccuggccaugaggaacccaucccuauggcuaccuacggguggaaccuggugaagcugcacuccggaaaagacguguuuuucauucccccugagaagugugauacacuccuuugcgacaucggcgagucuagcccgaaucccacgauugaagaggggcgcacccugcggguccugaaaaugguggaaccuuggcucagaggaaaccaauuuuguaucaagauccugaaucccuacaugccuuccguuguggagacacuugagcagaugcagcgcaagcauggcggcaugcugguccggaacccccucagcagaaauucuacccacgaaauguauuggguguccugcgggacaggaaacauuguuagcgccgugaauaugaccucucgcaugcugcugaaccgguucacgauggcgcacagaaaaccgaccuacgagcgcgaugucgaccucggcgccgggacaagacauguggcuguggaaccugaggucgccaaccuggauaucauuggacagcggaucgaaaauauuaagcacgagcauaaauccaccuggcacuaugacgaggauaaccccuacaagacaugggcuuaucauggcagcuacgacguuaaacccucuggguccgccagcuccauggugaauggaguggucaaacuucugaccaagccuugggaugugauccccaugguuacacaaaucgcuaugaccgacacgacaccuuuuggccagcagcgcguguucaaagaaaaggucgacaccagaaccccgaaagccaagcggggcacagcgcaaauuauggaggugacggccaaauggcucuggggguuucugagcagaaacaagaagccccggaucuguacccgcgaagaguucacaagaaaaguucggucuaaugcugccauuggagcuguguuugucgaugaaaaccaguggaauagcgccaaggaggccguggaggacgaacgcuucugggaucuuguucacagagagcgggaacugcacaaacagggcaagugcgcgaccugcguguauaacaugauggggaaacgcgagaagaagcucggagaauuuggcaaagcuaagggguccagagccaucugguacauguggcugggcgcccgguuccuggaguucgaggcucucggauuuaugaaugaagaccauugguucucucgcgagaacagccuguccggcgucgaaggggagggacuucacaaacugggcuacauucucagagauaucucuaagaucccugggggaaauauguaugccgacgauacagcuggcugggacacccggauuacagaggaugaccugcagaacgaagcccgcaucaccgauauuauggagcccgaacaugcgcuucuggccaaaagcaucuuuaagcucacguaccaaaauaaaguggucagagugcagcggccugcuaagaacgggaccguuauggacgugauuucccgcagagaucagcggggcucuggacaggucggcacauaugggcugaauaccuucacaaacauggaggcccaacugaucagacagauggaaagcgagggaaucuuuucccccagcgagcucgaaaccccgaaccuggcugagcgcgugcuugacuggcugaagaaauacggcguggaacggcucaagagaauggccauuucuggggacgauuguguugugaaaccuaucgacgaucgcuucgcgacggcccugacagcucuuaaugacaugggaaagguccggaaagauauuccccagugggagccuuccaagggcuggaacgacuggcagcaagugcccuuuugcagccaccacuuccaucagcugaucaugaaggaugggagagaaauuguugugccuugucgcaaucaggacgagcucgucggccgggccagagugucucagggagcuggcuggucccugcgcgagaccgccugccuggggaaaagcuaugcucaaauguggcagcucauguacuuucaccggagagaucugcgccuugccgcgaacgccaucuguuccgcuguccccguggacuggauuccgacaucucggaccacguggagcauccaugcccaccaucaguggaugaccacagaagauaugcuguccguuuggaauagaguguggaucgaggaaaacccuuggauggaggacaagacccacauuagcucuuggggagacguccccuaucucggcaaacgggaagaucaauggugcgggucccugaucggacuuacagccagagcuaccugggccacaaauauucagguggcgaucaaccagguucgccggcugauuggcaaugagaacuaccucgacuacaugaccagcaugaagagauucaaaaaugagggggaucccgaaggcgcucugugguga

SEQ ID NO: 18875 - RNA, 9879 nt, Artificial Sequence
  derived and/or modified CDS sequence (opt5) from DENV-1__FJ390383__SS-prME
uccgugaccaugcugcucaugcugaugcccacagcccuugcuuuccaccugacgaccagaggcggggagccucauaugaucgucuccaagcaggaacggggaaaaucucuccuguuuaagacaagcgccggcguuaauaugugcacccuuauugcgauggaccugggggagcucugugaagauacaaugaccuacaaaugcccgcgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuuccugacacaagaugaaaagggggugacgcagaacggacggcuuaucaccgcgaaucccauugucacagacaaagagaagccugugaacaucgaagcugagccgcccuuuggcgaguccuauauuaucauuggggccggagaaaaagcccucaagcugagcugguucaagaaaggcucuagcaucgggaagauguuugaggcuaccgccagaggcgcucgccggauggccauccugggagauacagcgugggacuucggcuccauugggggaguguuuaccucuguuggcaaacucguccaucagaucuucgggacggccuacggagugcuguuuagcggcguguccuggaccaugaagauugggaucggcguccuucugacauggcucggacugaauagcagaucuaccucccugagcaugacauguauugcugugggccuuguuacccucuaccugggggugaugguccaggccgauucuggaugcgugaucaacuggaaaggccgcgaacugaaguguggguccggaauuuucguuacaaaugaggugcacaccuggacggaacaauauaaguuucaggcugacagcccuaaacggcucuccgccgcgaucggcaaggccugggaggagggggucugcggcaucagaucugcuacacgccuggaaaacauuauguggaaacagaucagcaacgagcuuaaucauauucugcucgaaaacgacaugaaguucaccgugguugugggagaugucgccggcauccuggcucaggggaaaaagaugauucggccgcaacccauggaguacaaauauuccuggaagucuuggggaaaggccaaaaucaucggcgccgacgugcagaauaccacauuuauuaucgaugggccuaacacccccgaauguccugacgaucagagagcuuggaauauuugggagguggaggacuacggauucggcaucuuuacgacaaacauuuggcugaaacuucgcgauagcuauacccaggucugcgaccaccggcucauguccgcggccaucaaagauagcaaggcuguucacgccgacaugggcuacuggaucgaaucugagaaaaaugaaacauggaagcuggccagagcuuccuucauugaggugaagaccuguaucuggcccaaaagccauacacuguggucuaacggggugcucgaauccgagaugauuaucccgaagauuuauggaggcccuaucagccaacacaauuaccgccccggguacuucacccagacggccggaccuuggcaucugggcaaacuugagcuggauuuugaccucugcgaagggaccacagucgugguugaugagcacugcggaaaccggggccccucucugagaaccacaaccgugacgggcaagaucauucacgaaugguguugccggagcuguacacugccuccccuucgcuucagaggggaggacggaugcugguauggcauggagauccggccggucaaagaaaaggaggaaaaucucgugaaguccaugguuagcgcggggucuggagagguggacuccuuuagccugggccugcucuguauuuccaucauuaucgaagaggucaugagaucucgcuggagccggaaaaugcugaugaccgggacacuugcuguguucuuucugcucauuaugggacagcugaccuggaacgaucugaucagacuuugcaucaugguuggcgccaaugccuccgaccgcaugggcauggggaccacauaccuggcucucauggccacguucaagaugagaccuauguuugcggugggacuccuguuccggcgccugaccucuagagagguccuucugcucacaauuggccugagccugguggcuuccguggaacuucccaacucucuggaggaacucggggauggacuggccaugggcaucaugauucucaaacugcuuaccgacuuucaaagccaucagcugugggccacacuccugucccugaccuucaucaagacgacauuuagccuucacuaugcuuggaaaaccauggccaugguccugucuauuguuucccucuucccccugugucucagcaccacaucucagaagaccacauggcugccugugcuucuggggucccugggaugcaagccgcucacgauguuucugaucgcugagaauaaaaucuggggccggcgcagcuggccccuuaacgaaggcauuauggccguggggaucgucucuauucugcucuccagccugcucaagaacgaugagccucuggcgggaccccuuaucgccggcgggaugcugauugcuuguuacgugaucuccggaagcucugccgaccugagccucgagaaagcugccgaaguuuccugggaggaagaggccgaacauucuggcgcuagccacaauauccugguggagguccaggaugacgggaccaugaagauuaaagaugaggaaagagacgauacacuuaccauccugcucaaggcgacacugcucgccguguccggaguuuauccucugucuauucccgcuacccuuuucgugugguacuucuggcagaagaagaagcagcggagcggcguccugugggacacgccuagcccucccgagguggaacgcgccguccuggaugacggcaucuauagaauuaugcagcgggggcuccugggacgcucucaggugggcguugggguguuucaagagaacgucuuccauaccauguggcacgugacaagaggagccguucuuauguaccagggcaaacggcuggagcccagcugggcuuccgugaagaaagaccucaucagcuacgggggaggcuggagacugcagggcucuuggaauaccggggaagagguccaggugauugccguggaacccggaaagaacccuaaaaauguucaaacagcgcccggcaccuuuaagacaccggagggggaagucggagcuaucgcccucgauuucaagccuggcacguccgggagccccaucgugaaccgcgagggaaaaauugugggccuguauggcaauggggucgugaccacaucuggaaccuacguuuccgccaucgcucaggccaaggcgagccaggagggcccucuucccgaaauugaggacgaaguguuucggaaaagaaaccugaccaucauggaucugcaccccggguccggaaagacacgccgguaucucccugcuauugucagagaggccaucaaacgcaagcugcggacgcuuauccuggccccgaccagagugguugcuucugaaauggccgaggcucucaagggcaugcccauucgcuaccaaacaaccgccgugaaaagcgagcauacagggaaggaaaucgucgaccugaugugccacgcgaccuucacgaugcggcugcucuccccugugagaguucccaauuauaacaugauuaucauggaugaggcccauuuuacagacccuagcucuauugcugcccggggcuacaucuccacccgcgugggaaugggcgaagcugccgccaucuucaugaccgcuacacccccugggagcgucgaggcguuuccgcagucuaaugccgugauucaggaugaagagagagacauccccgagcggagcuggaacuccggauaugaauggauuaccgauuucccuggcaaaacagugugguuuguccccucuaucaagagcgggaaugacauugcuaacugucuucgcaaaaauggaaagagaguuauccagcugucccggaagaccuucgauacggaguaccagaagaccaagaacaacgacugggacuacguggugaccacagauauuucugaaaugggcgccaauuucagagccgaccgcgucaucgauccucggagaugccugaaacccgugauccucaaggacgggccggagcgcguuauucuggcuggcccuaugcccgugaccgucgccagcgcggcucagcggagaggacgcaucggccggaaccacaauaaagagggggaucaguauauuuacaugggacagccccuuaacaaugacgaagaucaugcccacuggacggaggccaagaugcugcucgacaacaucaauaccccugaaggcauuauccccgcucuguuugagccugaaagagagaaguccgccgcgaucgauggggaguaucgccugagaggagaagcccggaaaacauucguggagcucaugcgcagaggcgaccuuccgguuuggcugagcuacaagguggcuucugaaggguuucaauauuccgaucggcgcuggugcuucgacggcgagagaaacaaucagguccuggaagagaacauggauguggagauuuggaccaaagaaggagagcggaagaaacucagaccccgcuggcuggacgcccggacauacagcgacccucuugcucugagagaauuuaaggaguucgccgcuggccgccgguccgucucuggggaucucauccuggaaauuggaaaacugccccagcaccucacccagagagcccaaaaugcgcuugacaaccuggugaugcugcauaauagcgagcagggcgggcgggccuaucgccacgcuauggaggaacucccugauacaaucgagacccugaugcuucuggcccucauugcuguucugacgggaggcgugacacuguuuuuccucuccggcagagggcuuggaaagaccucuaucggccugcugugugugauggccagcuccguccuccuguggauggccagcguugaaccccauuggaucgcugcgucuauuauccuugaguuuuuccugauggugcuccugauuccggagccugaccggcagcgcacaccccaggauaaccaacuggccuacguggucaucgggcuccuuuuuaugauucugacaguggcugccaaugaaaugggacugcucgagaccacaaagaaagaccugggcaucgggcacguugccguggaaaaccaccaucacgcugccaugcuugaugucgaccugcauccugcguccgccuggacgcucuacgcuguggccaccacaauuaucacccccaugaugagacacacaaucgagaacaccacggcuaauauuagccugaccgccaucgcgaaccaggccgcuauucugaugggacucgauaagggcuggccuaucucuaaaauggacauuggcgucccccuucuggcccuggggugcuauucccaggugaauccgcucacacugaccgcugccguucuuaugcugguggcucauuacgccaucaucggaccuggccuccaagcgaaggccacacgggaagcucagaaacgcaccgccgcugggauuaugaagaaccccacggucgauggaaucguggccauugaccuggaucccguuguguaugacgccaaguucgagaaacagcugggccagaucaugcuccuuauucuguguacaagccaaauccugcucaugagaaccacaugggcgcugugcgagucuaucacccuugcuaccgggccucugacaacgcucugggaaggaagcccgggcaaguuuuggaauaccacaauugccgucuccauggcuaacaucuuccggggcucuuaccuggccggggccggacuggcuuucagccucaugaaaucccuuggcgggggacgcagaggcaccggggcccagggagagacacugggcgaaaaguggaaacggcagcugaaucagcucagcaaguccgaguuuaacaccuauaagagaucuggcauuauggaaguggaccgcagcgaggcgaaagaggggcugaagcggggagaaacgacaaaacacgccguguccagaggcaccgcuaaacuucgcugguucguugagcggaaucuggucaaacccgaagggaaggugaucgaucucggauguggcagagggggauggucuuacuauugcgccggccugaagaaagugaccgaggucaagggcuacacaaaagggggaccuggccacgaggaacccauuccuauggcuaccuacggguggaaccugguuaagcuccauagcggaaaagacguguuuuucauucccccugagaagugugauacacuucugugcgacaucggcgaauccucuccgaaucccacgaucgaggaagggcgcacccugcgggugcucaaaauggucgagccuuggcugagaggaaaccaauuuuguaucaagauucuuaaucccuauaugccuagcgugguugagacacuggaacagaugcagcgcaagcacggcggcaugcucgugcggaacccccuguccagaaauagcacccaugagauguacugggucucuugcgggacaggaaacaucguguccgccguuaauaugaccagccgcaugcugcucaaccgguucacgauggcgcacagaaaaccgaccuaugaacgcgauguggaccugggcgccgggacaagacacgucgcuguggagccugaaguggccaaccuugauauuaucggacagcggauugagaauaucaagcaugagcacaaaucuaccuggcauuacgacgaagauaaccccuauaagacaugggcuuaccacggcuccuaugaggucaaacccagcgggucugccuccagcaugguuaauggaguggugaagcugcucaccaagccuugggacgucauccccauggugacacaaauugcuaugaccgauacgacaccuuuuggccagcagcgcguuuucaaagaaaagguggacaccagaaccccgaaagccaagcggggcacagcgcaaaucauggaggucacggccaaauggcuguggggguuucuuuccagaaacaagaagccccggauuuguacccgcgaagaguucacaagaaaagugcggagcaaugcugccaucggagcuguuuuuguggacgagaaccaguggaacucugccaaggaagccgucgaggaugaacgcuucugggaccuggugcauagagagcgggaacuccacaaacagggcaagugcgcgaccugcguuuacaacaugauggggaaacgcgagaagaagcugggagaguuuggcaaagcuaaggggagcagagccauuugguacauguggcugggcgcccgguuccucgaguucgaggcucugggauuuaugaaugaagaucacugguucucccgcgagaacucucuuagcggcguggagggggaaggacugcauaaacucggcuauauccugagagacaucuccaagauuccugggggaaauauguacgccgaugacacagcuggcugggauacccggaucacagaggacgaucuucagaacgaagcccgcauuaccgacaucauggagcccgaacacgcgcugcucgccaaaucuauuuuuaagcugacguaucaaaauaaagucgugagaguccagcggccugcuaagaacgggaccgugauggauguuaucagccgcagagaccagcggggcuccggacaggugggcacauacgggcugaauaccuucacaaacauggaggcccaacucaucagacagauggagucugaaggaauuuuuagccccuccgagcuggaaaucccgaaccuugcugagcgcguccuggauuggcucgaaaaguauggcguggagcggcugaaaagaauggccauuagcggggacgacugugugguuaagccuaucgaugaccgcuucgcgaccgcccuuacggcucugaaugauaugggaaaagugcggaaggacauuccccagugggagccuucuaaaggcuggaacgauuggcagcaaguccccuuuugcucccaucacuuccaccagcucaucaugaaggacgggagagaaauugugguuccuugucgcaaucaggaugagcuggugggccgggccagagucagccagggagcuggcuggucucugcgcgaaacagccugccucgggaaguccuacgcucaaauguggcagcugauguauuuucaucggagagaccuucgccuggccgcgaacgccaucuguagcgcugugcccgucgauuggaucccgaccucccggacaaccuggucuauucacgcccaucaccaguggaugacgaccgaggacaugcucagcguguggaauagaguuuggaucgaagagaacccuuggauggaggauaaaacacauauuuccagcuggggagacgugcccuaccugggcaagcgggaagaccaauggugcgggucucuuaucggacugaccgccagagcuacaugggccaccaauauucaggucgcgaucaaccaggugcgccggcucaucggcaaugagaacuaccuggauuauaugacauccaugaaaagauucaagaaugaaggggaccccgagggcgcucugugguga

SEQ ID NO: 18876 - RNA, 9879 nt, Artificial Sequence
  derived and/or modified CDS sequence (opt5) from DENV-1__FJ182033__SS-prME
agcgugaccaugcugcucaugcugaugcccaccgcccuugcuuuccaccugacgaccagaggcggggaaccucauaugaucgucuccaagcaggaacggggaaaaucucuccuguuuaagacgagcgccggcguuaauaugugcacccuuauugcgauggaccugggggaacucugugaagauacaaugaccuacaaaugcccgagaaucacagagguggaacccgacgauguggacuguuggugcaauaccacggauaccugggucacauauggaaccuguucccaaacaggcgagcacagacgggacaagcgcucuguggcucuggccccucauguugggcugggacucgagaccagagccgaaacguggaugagcuccgagggcgcuuggaaacagauucagaagguggaaacaugggcccugcggcaccccggcuucaccgucaucgcucuuuuucuggcccaugcgauugggacaucuaucacccagaagggaaucauuuucauccuccugaugcuugugaccccuagcauggccaugcgcugcguuggcauuggguccagagauuuuguggagggacugagcggcgcuacaugggucgacguggugcucgagcacgggucuugugucacgaccauggccaaagauaagcccacacuggacaucgaacugcucaaaaccgagguuacaaacccugcugugcugcggaaacuuugcauugaagccaaaaucuccaauaccacgacagauagccgcuguccgacccaaggagaggcgacccugguggaagaacaggacgccaacuucgucugcagacggacauuuguggaucgcggcuggggcaauggguguggacucuucggcaaggggucucugauuaccugcgcuaaguuuaaaugcguuacaaaacuugagggaaaaaucgugcaguacgaaaaccugaaguauuccgucaucgugacgguucacaccggcgaccagcaucaaguggggaaugagagcacagaacacggaaccacagccaccauuacgccccaggcuccuaccucugagauccagcucacagacuacggcgcccugacccuggauuguucccccagaacaggccucgacuucaacgaaaugguccugcuuaccaugaaagaaaaguccuggcuggugcauaaacagugguuucucgaucugccucuucccuggacguccggggccucuacaagccaagagaccuggaaucggcaggaccugcucgucacauucaagaccgcucacgcgaagaaacaggaagugguugugcugggaucccaagagggcgccaugcacaccgcucugacaggggccacggaaauucagaccagcggaacaaccacaaucuuugccggccaucucaagugccgccugaaaauggauaaacuuacccugaaagggaugucuuaugucauguguacgggcuccuucaagcucgagaaggaaguggcugagacacagcacggaaccguucuggugcagauuaaauacgagggcaccgacgccccgugcaagaucccuuucagcacacaagaugaaaaaggggucacccagaacggaagacugaucacagcgaaucccauugugacggacaaggagaaaccugugaacaucgaagcugagccgcccuuuggcgagucuuauauuguuaucggggccggagaaaaggcccuuaagcucagcugguucaaaaagggcuccucuauugggaaaauguuugaggcuaccgcccggggcgcuagacgcauggccauccugggagauacagcgugggacuucggcagcaucgggggagucuuuaccuccauuggcaagcuggugcaucagaucuucgggacagccuacggagugcucuuuagcggcgucucuuggaccaugaaaauugggaucggcgugcugcuuacguggcugggacucaauucccggagcaccucucuguccaugacauguauugcuguuggccuggugacccuuuaccucggggucauggugcaggccgauagcggaugcguuaucaacuggaagggcagagaacugaaguguggguccggaauuuucgugacaaaugagguccacaccuggacagaacaauauaaauuucaggcugacucuccuaagcgccugagcgccgcgaucggcaaagccugggaggagggggugugcggcauccgguccgcuaccagacucgaaaacauuauguggcgccagaucucuaacgagcugaaucauauucuucuggaaaacgacaugaaguucacgguuguggucggagauguggugggcauccucgcccaggggaaaaagaugauucggccgcaacccauggagcacaaauacagcuggaaguccuggggaaaggcuaaaaucaucggcgccgacguccagaauacaaccuuuauuaucgaugggccuaacacccccgaauguccugacgaucagagagccuggaauauuugggagguugaggacuauggauucggcaucuuuacaaccaacauuuggcugaagcugcgcgauagcuacacacaggugugcgaccaccggcuuaugucugcugcgaucaaagauuccaaggccgugcaugcugacaugggcuauuggaucgaaagcgagaaaaaugaaacauggaagcucgccagagccucuuucauugaggucaagaccuguaucuggcccaaaucccacacacuguggagcaacggggugcuggaaucugagaugauuaucccgaagauuuacggaggcccuaucagccaacauaauuaucgccccggguacuucacccagacagcuggaccuuggcaccucggcaaacuggagcuugauuuugaccugugcgaagggaccacgguuguggucgaugagcacugcggaaaccggggccccucccucagaaccacaaccgugacaggcaagaucauucaugaaugguguugccggagcuguacccugccuccccugcgcuucaaaggggaggacggaugcugguacggcauggagaucagaccgguuaaggaaaaggaggaaaaucuugugaaaucuauggucuccgccgggagcggagagguggacuccuuuucucucggccugcuguguauuagcaucaugauugaagagguuaugcgguccagauggucucgcaagaugcucaugacggggacacuggcgguguucuuucuucugaucaugggacagcucaccuggaacgaucugauucggagcugcaucauggucggcgcuaaugccuccgacagaaugggcauggggacaaccuaucuggcccuuauggcuaccuucaaaaugcgcccuauguuugccgugggacuccuguucagacggcugacaucucgcgaggugcuccugcuuacgaucggccugagccucgucgcguccguugaacugcccaacagccuggaggaacuuggggauggacuggcuaugggcauuaugauccucaagcugcucaccgacuuucaaucuuaccagcugugggccacacuucugucccucaccuucauuaaaacaaccuuuagccugcacuaugccuggaagacgauggcuauggugcugucuaucgugucccuucugccccucugucugagcacaaccucucagaagaccacauggcucccuguccugcuugggucccugggaugcaaaccgcugaccauguuccucauugccgagaauaagaucuggggcagaaaaagcuggccccugaacgaaggcaucauggcuguggggauuguuuccauccuucugagcucucuccugaagaacgaugugccucucgccggaccccugauugcgggcgggaugcuuaucgccuguuacgucauuagcggauccucugcugaccugagccuggagaaagccgcugagguguccugggaagaggaagccgagcauucuggcgccagccacaauauccucguugaagugcaggaugacgggacaaugaagaucaaagaugaggagcgggacgauacgcugaccauucuucugaaggcuacacuccuggcggucuccggaguguauccucucucuauccccgccacccuguuugucugguacuucuggcaaaagaaaaagcagcgcagcggcgugcuuugggacacaccuagcccucccgaaguugagagagcugugcuggaugacggcauuuaucggaucaugcagcgcgggcugcucggaagaagccaggucggcguggggguuuuccaagaaaacguguuucauaccauguggcacgucacgcggggagccgugcugauguaccagggcaaacgccuugagcccucuugggccuccgugaagaaagaccugauuagcuacgggggaggcuggagacuccagggcucuuggaauaccggggaggaaguucaggucaucgcuguggagcccggaaagaacccuaagaaugugcaaacagcccccggcaccuucaaaacaccggaaggggaggucggagcgauugcucuggauuuuaagccuggcaccuccgggagccccaucgugaaccgggaaggaaaaaucguuggccucuauggcaaugggguggucacaacguccggaaccuacgugucugccauugcccaggcuaaggccagccaggagggcccucugcccgagaucgaagacgagguuuucagaaaacgcaaccuuacaauuauggaucugcaccccggguccggaaagacccggagauaucugccugcgaucgugcgcgaagcuauuaagcggaaacucagaacccugauccuugccccgacacgcgucguggccagcgagauggcugaagcccugaagggcaugcccauccgguaccaaacgaccgcuguuaaaucugagcauacagggagagagauuguggaccucaugugccacgccaccuuuacaaugcgccugcuguccccuguccgggugcccaauuauaacaugaucauuauggaugaagcgcauuucaccgacccuagcucuaucgccgcuagaggcuacauuagcacgcgggugggaaugggcgaggccgcugccaucuuuaugacagccacacccccuggguccgucgaggcuuucccgcagucuaaugcgguuauccaggaugaggaacgcgacauucccgagagaagcuggaacuccggauaugaguggaucaccgauuuuccuggcaagacagugugguucgugcccucuauuaaaagcgggaaugacaucgccaacugucuccggaagaauggaaagcgcgucauucagcuuuccagaaaaaccuuugauacagaauaccaaaagaccaaaaacaacgacugggacuacgugguuacgacagauaucagcgagaugggcgcuaauuuccgggccgacagagugauugauccucgccggugccugaagcccgucauccugaaagacgggccggaaagagugauccucgccggcccuaugcccguuaccguggcuucugccgcgcagcgccggggaagaauuggccgcaaccacaauaaggagggggaucaguauaucuacaugggacagccccugaacaaugacgaggaucaugcucacuggacagaagccaagaugcuucuggacaacauuaauaccccugagggcaucauucccgcccucuucgaaccugagcgggaaaaauccgcugccaucgauggggaguauagacugcgcggagaggcgagaaagacguuugucgaacugaugcggcgcggcgaccucccgguguggcuuagcuacaaagucgccuccgagggguuccaauauucugauagacgguggugcuuugacggcgaacgcaacaaucaggugcuggaggaaaacauggauguugagaucuggaccaaggagggagaacgcaagaagcugcggcccagauggcucgacgcucgcacauacagcgacccucuggcccuucgggaguucaaagaauuugcugccggcagacgcuccgugucuggggaucugauucucgagaucggaaagcugccccagcaccugacccagcgggcucaaaaugcccucgacaaccuugugaugcugcauaauagcgaacagggcgggagagcguaucggcacgccauggaggagcugccugauacaauugaaacccucaugcugcuugcucugaucgccguccucacaggaggcguuacccuguucuuucuguccggccgcgggcucggaaagacgagcauuggccuucugugugugauggcuucuuccgcccugcucuggauggccagcguggagccccauuggaucgcugcgucuaucauucuggaguucuuucuuaugguccugcucaucccggagccugacagacagcggacaccccaggauaaccaacuggccuacgugguuauugggcuccuguucaugauccuuaccguggcugccaaugagaugggacugcuggaaaccaccaagaaggaccucggcauugggcacgucgccguggagaaccaccaucacgcuaccaugcuggaugucgaccuucauccugccuccgcguggacacuguacgccguggcuacgaccaucauuacacccaugaugcgccacaccaucgaaaacacaaccgccaauaucagccucacggcuauugccaaccaggcggccauccugaugggacuggauaaaggcuggccuauuucuaagauggacaucggcguuccccuccuugcucuggggugcuauagccaggugaauccgcugacccucacagccgcuguccugaugcuuguggcccauuacgcuauuaucggaccuggccugcaagccaaagcgaccagagaggcccagaagcggacagcugccgggaucaugaagaaccccaccguugauggaauuguggcuaucgaccucgaucccgucguguaugacgccaaauuugaaaagcagcugggccagauuaugcugcucauccuuuguacgucccaaauucugcugaugcgcacaaccugggcccucugcgagucuaucacacuggcgaccgggccucuuaccacacugugggagggaagcccgggcaaauucuggaauacgaccaucgcuguguccauggccaacauuuuuagaggcagcuaccucgcuggggccggacuggccuucucccugaugaagucucucggcgggggacggcgcggcacaggggcucagggagaaacccuuggcgagaaauggaagagacagcugaaucagcugagcaaguccgaguucaacacauauaaacggucuggcaucauggagguugacagaagcgaagccaaggaggggcuccgccggggagagaccacgaaacacgcggucuccagaggcacagccaagcugcgcugguuuguggaacggaaucuugugaaacccgaggggaaggucauugaucugggauguggcagagggggauggucuuacuauugcgcuggccucaagaaaguuaccgaagugaagggcuacaccaaagggggacugggccacgaggaaccuauccccauggccacauacggguggaaccuggugaagcuccauagcggaaaagacgucuucuuuauuccucccgagaagugugauacccuucugugcgacaucggcgaguccagcccuaauccgacaauugaagaggggcgcacgcugcgggugcucaaaaugguugaacccuggcugagaggaaaccaauucuguaucaagauccuuaauccuuauaugcccucuguggucgagacccuggagcagaugcagcgcaagcacggcggcaugcucgugcggaacccucuguccagaaauagcacacaugaaauguacuggguuucuugcgggaccggaaacauuguguccgcugucaauaugacaagccgcaugcugcucaaccgguuuaccauggcccacagaaaacccacguaugagcgcgauguggaccugggcgcggggaccagacacguggccgucgaaccggagguugcuaaccuugauaucauuggacagcggaucgaaaauauuaagcaugagcacaaaucuacauggcauuacgacgaggauaacccuuauaagaccugggccuaccacggcuccuaugaagugaaacccagcggguccgcuagcucuauggugaauggagucgugaagcugcucacaaagcccugggacguuaucccuauggugacccaaaucgccaugacagauaccacgcccuucggccagcagcgcgucuuuaaagagaagguggacacaagaaccccuaaagcuaagcggggcaccgcccaaauuauggaaguuacagcgagauggcuguggggguuccuuagccggaacaaaaagccgcgcaucuguacgagagaggaauuuacccggaaggugcgcuccaaugccgcuauuggagccgucuucguggacgagaaccaguggaacucugcuaaagaggccguugaagaugagagauuuugggaccuggugcaucgggaacgcgagcuccacaagcagggcaaaugcgccacaugcgucuacaacaugauggggaagagagagaagaagcugggagaguucggcaaggcgaaagggagccgggcuaucugguacauguggcugggcgcccgcuuucucgaguucgaagcccugggauucaugaaugaggaucacugguuuuccagagaaaacucucuuagcggcguggagggggagggacugcauaagcucggcuauauucugcgggacaucuccaaaauccccgggggaaauauguacgcugaugacaccgccggcugggauacacgcauuaccgaagacgaucuucagaacgaggcuaagaucacagacauuauggaaccugagcacgcccugcucgcgaccucuaucuucaaacugacguaucaaaauaaggucgugagaguucagcggcccgcccgcaacgggaccgugauggaugucauuagcagacgggaccagagaggcuccggacaggugggcacauacgggcugaauaccuuuacaaacauggaagcucaacucauccgccagauggagagcgagggaaucuuccugccuucugaacuugagacccccaaccuggccgaacgggugcucgauuggcuggagaaacauggcguugaaagacuuaagcgcauggcuauuuccggggacgacuguguggucaagccgaucgaugaccgguuugccacggcgcugacagcccucaaugauaugggaaaagugagaaaggacauuccucagugggagcccagcaaaggcuggaacgauuggcagcaaguuccuuucugcucucaccacuuucaucagcugaucaugaaggacgggcgcgagauugugguccccugucggaaucaggaugaacuggugggcagagcucgcgucucccagggagccggcuggagccuccgggagaccgcuugccuggggaaauccuaugcccaaauguggcagcuuauguacuuccacagacgcgaccugcggcucgcugccaacgcgaucuguucugccgugccuguugauugggugcccacaagcagaaccacgugguccauucaugcucaccaucaguggaugaccacagaagacaugcugagcgucuggaaucggguguggaucgaggaaaacccguggauggaggauaagacccacaucucuuccuggggagacguuccuuaucuuggcaagagagaggaccaauggugcgggagccugauuggacucacagcccgcgccaccugggcuacaaauauccagguggccauuaaccagguccggagacugaucggcaaugaaaacuaccuggauuacaugaccucuaugaaacgcuuuaagaaugagagcgaccccgaaggggcgcucugguga

SEQ ID NO: 18877 - RNA, 9879 nt, Artificial Sequence
  derived and/or modified CDS sequence (opt5) from DENV-1__FJ182034__SS-prME
agcgugaccaugcugcucaugcugaugcccacagcccuugcuuuccaccugacgaccagaggcggggaaccucauaugaucgucuccaagcaggaacggggaaaaucucuccuguuuaagacaagcgccggcguuaauaugugcacccuuauugcgauggaccugggggaacucugugaagauacaaugaccuacaaaugcccgcgcaucacagaagcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaagacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuucuaccgagauccagcucacagacuacggcgcccugacccuggauuguagcccccggacaggccucgacuucaacgaaauggugcugcuuaccaugaaggagaaaagcuggcugguccauaagcagugguuucucgaucugccucuucccuggacguccggggcuucuacaagccaagagaccuggaaucgccaggaccugcucgugacauucaaaaccgcgcacgccaagaagcaggaagucgugguucugggaucccaagagggcgcuaugcacaccgcccugacaggggccacggaaauucagaccagcggaacaaccacaaucuuugcuggccaucucaaaugcagacugaagauggauaaacuuacccugaaggggaugucuuaugugauguguacgggcuccuucaaacucgagaaggaagucgccgagacacagcacggaaccgugcugguucagauuaaguacgagggcaccgacgcgccgugcaaaaucccuuucagcacacaagaugaaaagggggugacccagaacggacggcugaucacagcuaaucccauugucacggacaaagagaagccugugaacaucgaagccgagccgcccuuuggcgagucuuauauugugaucggggccggagaaaaagcucuuaagcucagcugguucaagaaaggcuccucuauugggaagauguuugaggccaccgcuagaggcgcccgccggauggcgauccugggagauacagccugggacuucggcagcaucgggggaguuuuuaccuccgucggcaaacuggugcaucagauuuucgggacagcuuacggagugcucuuuagcggcgucucuuggaccaugaagaucgggauuggcgugcugcuuacguggcugggacucaauuccagaagcaccucucuguccaugacauguaucgccguuggccuggugacccuuuaccucggggucauggugcaggcugauagcggaugcguuauuaacuggaaaggccgcgaacugaaguguggguccggaaucuucgugacaaaugagguccacaccuggacagaacaauauaaguuucaggccgacucuccuaaacggcugagcgcggccauuggcaaggcuugggaggagggggugugcggcaucagauccgccacccgccucgaaaacaucauguggaaacagauuucuaacgagcugaaucauauccuucuggaaaacgacaugaaguucacgguuguggucggagauguggcuggcauucucgcccaggggaaaaagaugauccggccgcaacccauggaguacaaauauagcuggaaguccuggggaaaggccaaaauuaucggcgcugacgugcagaauacaaccuuuaucauugaugggccuaacacccccgaauguccugacgaucagagagcguggaauaucugggaggucgaggacuacggauucggcauuuuuacaaccaacaucuggcugaagcugcgcgauagcuauacgcagguuugcgaccaccggcuuaugucugccgcuauuaaagauuccaaggccgugcacgccgacaugggcuacuggaucgaaagcgagaaaaaugaaacauggaagcucgcuagagccucuuucaucgaggugaagaccuguauuuggcccaaaucccauacacuguggagcaacgggguccuggaaucugagaugaucauuccgaagaucuauggaggcccuauuagccaacacaauuaccgccccggguacuucacccagacagcgggaccuuggcaucucggcaaacuggagcuugauuuuaaccugugcgaagggaccacggugguuguggacgagcacugcggaaaucggggccccucccucagaaccacaaccgucacaggcaagaucauccacgaaugguguugccggagcuguacccugccuccccugcgcuucaaaggggaggauggaugcugguauggcauggagauuagaccggugaaggaaaaggaggaaaaccuuguuaaaucuaugguguccgcugggagcggagaggucgacuccuuuucucucggccugcuguguaucagcauuaugaucgaagaggugaugcgguccagauggucucgcaagaugcucaugacggggacacuggccguuuucuuucuucugauuaugggacagcucaccuggaaugaccugauccggcugugcauuauggugggcgccaacgcuagcgauagaaugggcauggggaugacauaccuugcccugauggcgaccuucaaaaugcgcccuaugcucgcugucggacugcucuuuagacggcugaccucccgcgaggugcuucugcucacaaucggccugucucugguggccagcgucgaacuucccaauucccuggaggaacucggggacggacuggccaugggcaucaugauucucaagcugcuuacggauuuccaaagccaucagcugugggcuacccuccugucucugacauuuaucaaaaccacauauucccuucacuacgccuggaagaccauggcuaugguucugagcauugugucucucuucccccugugucucuccacgacaagccagaagaccaccuggcugccugugcuucuggggucucugggaugcaaaccgcucacaauguuucugaucgccgagaacaagauuuggggcagaaaauccuggccccuuaacgaaggcaucauggcggucgggaucgugagcauucugcucuccagccugcucaagaaugacguuccucuggccggaccccuuaucgcuggcgggaugcugauugccuguuaugugaucucuggaagcuccgcugaucugucucucgagaaagccgccgaggucagcugggaagaggaagcugagcauuccggcgcgucucacaacauucugguggaaguucaggacgaugggaccaugaagaucaaagacgaggagcgggaugacacacuuacgauccugcucaaggccacccugcucgcugugagcggagucuacccucuguccauucccgccacacuuuucgugugguauuuuuggcaaaagaaaaagcagcgcucuggcguccugugggauaccccuuccccucccgaaguggagagagccguucuggacgauggcaucuaccggauuaugcagcgcgggcuccugggaagaucccaggugggcgucgggguguuccaagaaaauguuuuccauacaauguggcacgugacccggggagcuguccuuauguaccagggcaaacgccuggagcccagcugggccucugugaagaaagaccucaucuccuaugggggaggcuggagacugcagggcagcuggaacacgggggaggaagugcagguuauugcggucgagcccggaaagaauccuaagaacgugcaaaccgcucccggcacauuuaaaaccucugaaggggaggugggagccaucgcccucgacuucaagccgggcacauccgggagcccuauugucaaucgggaaggaaaaaucgugggccuguacggcaacgggguugugaccacauccggaacguaugucucugcuaucgcccaggcgaaggcuagccaggagggcccccuuccugagauugaaaaugagguguuuagaaaacgcaaccugaccaucauggaucugcaccccggguccggaaagacacggagauaccuccccgccauuguucgcgaagccaucaagcggaaacugagaacccuuauucuggcuccuacccgcguggucgccagcgagauggcugaagcccucaagggcaugccgauccgguaucaaacaacggcggugaaaucugagcauaccgggaaggagaucguugaccugaugugccacgccacauucaccaugagacugcucucccccgugcgcgucccuaauuacaacaugauuaucauggaugaagcucauuuuacagaccccagcucuauugccgcucggggcuauaucagcaccagagugggaaugggcgaggccgccgcuauuuucaugacggcgacaccucccggguccguggaagccuuuccucagucuaaugcugucauccaggaugaggaacgggacaucccggagcgcagcuggaacuccggauacgaguggauuaccgauuuccccggcaaaaccguuugguuugugccuucuaucaagagcgggaaugacauugccaacugucuuagaaagaacggaaaacgggugauccagcugucccgcaagacauucgauaccgaauaccagaagacaaagaauaacgacugggauuaugucgugaccacggacauuagcgagaugggcgccaauuuuagagcugaccggguuaucgaucccagacgcugccugaaaccugugauucucaaggacgggcccgaacgggucauccuggccggcccgaugccugugacaguugcgucugcugcccagagacgcggacggaucggcagaaaccacaauaaggagggggaucaguacauuuauaugggacagccccuuaacaaugacgaggaucaugcccacuggaccgaagcuaaaaugcugcucgacaacaucaauacacccgagggcauuaucccugcccuguucgaacccgagcgcgaaaaguccgcggccauugauggggaguaccggcugagaggagaggcucgcaaaaccuucguggaacucaugagacggggcgaccuuccugucuggcugagcuauaagguggccuccgagggguuucaauacucugaucgcagauggugcuucgacggcgaacggaacaaucagguccuggaggaaaacauggauguggagaucuggacgaaagagggagaacgcaagaaacucagaccgcgguggcuggacgcuagaaccuauagcgauccccuugcccugcgcgaguuuaaggaguucgcugccggccggagauccguuucuggggaccucauccuggagauuggaaagcugccucagcaccucacacagcgcgcgcaaaaugcccuugacaaccuggugaugcugcauaauagcgaacagggcgggcgggcuuacagacacgccauggaggagcuccccgauaccaucgaaacacugaugcuucuggcucucauugccgugcugaccggaggcgucacacuguuuuuccucuccggccgggggcuuggaaaaaccagcaucggccugcuguguguuauggccucuuccgugcuccuguggauggcuagcguggagccucauuggauugcggccucuaucauccuugaauuuuuccugaugguccuccugauucccgagccggaccgccagagaacgccucaggauaaccaacuggcuuacgugguuaucgggcuccuuuuuaugauucugacaguggccgccaacgagaugggacugcucgaaaccaccaagaaagaccugggcaucgggcacgucgcuguggagaaucaccaucacgccgcgaugcuugaugucgaccugcaucccgccuccgcuuggacacucuaugccguggcuaccacaauuaucacgccuaugaugcggcacaccauugaaaacacaaccgccaauaucagccugacagcgaucgccaaccaggcugccauucugaugggacucgauaagggcuggcccaucucuaaaauggacauuggcguuccucuucuggcucuggggugcuacagccaggugaauccccucacccugacggccgcuguccuuaugcugguggcccauuaugcgaucauuggaccgggccuccaagccaaggcuacccgcgaggcccagaagagaacagcugccgggaucaugaaaaacccuaccguugauggaaucguggccauugaccuggaucccgucguguacgacgcgaaguucgaaaaacagcugggccagaucaugcuccuuauucuguguacaucccaaauccugcucaugcggaccacgugggcucugugcgagucuauuacacuugccaccgggccccugacaacccucugggagggaagcccuggcaaguuuuggaauaccacaaucgcuguguccauggccaacaucuuccgcggcagcuaucuggccggggcuggacuggccuuuucccucaugaaaucucuuggcgggggaagacggggcacgggggcgcagggagaaacccugggcgagaaguggaagcgccagcugaaucagcucagcaaauccgaguucaacacauacaagagaucuggcauuauggagguugaucggagcgaagccaaagaggggcugaagagaggagagaccacaaaacacgcugucucccgcggcaccgccaaacuucggugguucguggaaagaaaucuggugaagccggaggggaaagucaucgaccucggauguggccgcgggggauggucuuauuacugcgcuggccugaagaaaguuacggaagugaagggcuacacaaaagggggacccggccacgaggaaccuauucccauggccaccuauggguggaaccuggugaagcuccauagcggaaaagacgucuuuuucaucccucccgagaagugugauacccuucugugcgacauuggcgaguccagcccuaauccgacaaucgaagaggggcggacccugagagugcucaagaugguugaacccuggcugcgcggaaaccaauuuuguauuaaaauccuuaauccuuacaugcccucuguggucgagacacuggagcagaugcagcggaagcacggcggcaugcucgugagaaacccucugucccgcaauagcacgcaugaaauguauuggguuucuugcgggaccggaaacaucguguccgcggucaacaugacaagccggaugcugcucaauagauucaccauggcccaccgcaaacccacauacgagcgggauguggaccugggcgcugggaccagacacguggccgucgaaccggagguugcuaaccuugauauuaucggacagcgcauugaaaauaucaagcaugagcacaaaucuacguggcauuaugacgaggauaacccuuacaagaccugggccuaucacggcuccuacgaagugaagcccagcggguccgcuagcucuauggugaauggagucgugaaacugcucacaaagcccugggacguuauuccuauggugacccaaaucgccaugacagauaccacacccuuuggccagcagagagucuucaaagagaagguggacacccggacgccuaaagcgaagcgcggcacagcccaaaucauggaaguuaccgcuaaguggcuguggggguuucuuagcagaaacaaaaagccgcggauuuguaccagagaggaguucacacggaaagugcgcuccaaugccgcuaucggagccgucuuuguggaugagaaccaguggaacucugccaaggaggcgguugaagacgagagauucugggaccuggugcaucgggaacgcgagcuccacaaacagggcaagugcgcuacgugcgucuacaacaugauggggaagagagagaaaaagcugggagaguuuggcaaagccaaggggagccgggccauuugguauauguggcugggcgcucgcuuccucgaguuugaagcccugggauucaugaaugaggaucacugguucuccagagaaaacucucuuagcggcguggagggggagggacugcauaaacucggcuacauccugcgggacauuuccaagauccccgggggaaauauguaugcugaugacaccgccggcugggauacacgcaucaccgaagacgaucuucagaacgaggcgaaaauuacagacaucauggaaccugagcacgcccugcucgcuaagucuauuuuuaagcugaccuaccaaaauaaagucgugagaguucagcggcccgccaagaacgggacagugauggaugucaucagccgcagagaccagcggggcuccggacaggugggcaccuaugggcugaacacguucaccaauauggaagcucaacucauucgccagauggagagcgagggaaucuuuucuccuuccgaacuggagacacccaaccuugccggcagagugcuggauuggcucgaaaaacaugggguugagcggcugaagagaauggcgaucagcggagacgauuguguggucaaaccgauugacgaccgcuucgccaccgcucuuacagcccugaaugauaugggcaaggugcggaaggacaucccucagugggaacccucuaaaggguggaacgauuggcagcaaguuccuuuuugcucccaccacuuccaucagcucauuaugaaggacggcagagagaucgugguccccugucgcaaucaggaugagcuggugggacgggcuagagucagccagggcgccggguggucccugcgcgaaaccgcuugccucggaaaaucuuacgcccaaauguggcagcugauguauuuucaccggagagaccuucgccuggcggccaacgcuauuuguagcgccgugccuguugauugggugcccacgucccggacaaccuggagcauccaugcccaccaucaguggaugacaaccgaggacaugcucucugucuggaauagaguguggauugaagagaacccguggauggaagauaagacgcacaucuccagcuggggcgacguuccuuaccuggggaaacgcgaggaucaauggugcggaucucuuaucggccugaccgcucgggccacaugggcgaccaauauucagguggcuaucaaccaggucagacggcucauugggaaugagaacuaccuggacuauaugacaagcaugaagagauucaagaaugaauccgaccccgagggcgcccugugguga

SEQ ID NO: 18878 - RNA, 9879 nt, Artificial Sequence
  derived and/or modified CDS sequence (opt5) from DENV-1__FJ182036__SS-prME
agcgugaccaugcugcucaugcugaugcccacagcccuugcuuuccaccugacgaccagaggcggggaaccucauaugauugucuccaagcaggaacggggaaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugccacaccuagcauggcuaugagaugcgucggcauugggucccgggauuuuguggagggacugagcggcgccacguggguugacgugguccucgagcacgggucuugugugaccacaauggcuaaggauaaacccacccuggacaucgaacugcucaagacagaggugaccaacccugccguccugcgcaaacuuugcauugaagcgaagaucuccaauacgacaaccgauagcagauguccgacccaaggagaggccacacugguugaagaacaagacgcuaacuucgugugccggcgcaccuuuguggauagaggcuggggcaauggguguggacucuucggcaaagggucucugauuacaugcgccaaguuuaagugcgucacgaaacuugagggaaagaucgugcaguacgaaaaccugaaauauuccguuaucgugaccguccacacaggcgaccagcaucaaguggggaaugagagcaccgaacacggaacaaccgcuacgauuacaccccaagccccuaccaccgagauccagcucacagacuacggcgcccugacccuggauuguucuccccggacgggccucgacuucaacgaaaugguucugcuuacaaugaaggagaaauccuggcuggugcauaagcagugguuucucgaucugccucuucccuggaccagcggggcuuccacaucucaagagaccuggaaucgccaggaccugcucgucaccuucaaaacagcgcacgccaagaagcaggaaguggucgugcugggaagccaagagggcgcuaugcacacggcccugaccggggccacagaaauucagaccuccggaacaaccacgaucuuugcuggccaucucaaaugcagacugaagauggauaaacuuacacugaaggggaugagcuauguuauguguaccggcucuuucaaacucgagaaggaacuggccgagacccagcacggaacagugcugguccagauuaaguacgagggcaccgacgcgccgugcaaaaucccuuucuccacacaagaugaaaagggggugacgcagaacggacggcuuaucaccgcuaaucccauuguuacagacaaagagaagccugugaacaucgaagccgagccgcccuuuggcgagagcuauauugucaucggggccggagaaaaagcucucaagcugucuugguucaagaaaggcagcuccauugggaagauguuugaggccaccgcuagaggcgcccgccggauggcgauccugggagauacagccugggacuucggcucuaucgggggaguguuuaccagcgugggcaaacucguucaucagauuuucgggacggcuuacggaguccuguuuuccggcgugagcuggaccaugaagaucgggauuggcgugcuucugacauggcucggacucaauucuagauccaccagccugucuaugacauguaucgccgucggccuugugacccucuaccuggggguuauggugcaggcugauuccggaugcgucauuaacuggaaaggccgcgaacugaagugugggagcggaaucuucgugacaaaugagguucacaccuggacggaacaauauaaguuucaggccgacuccccuaaacggcucucugcggccauuggcaaggcuugggaggagggggugugcggcaucagaagcgccacacgccuggaaaacaucauguggaaacagauuuccaacgagcuuaaucauauccugcucgaaaacgacaugaaguucaccgucgugguuggagauguggcuggcauucuggcccaggggaaaaagaugauccggccgcaacccauggaguacaaauauucuuggaaaagcuggggaaaggccaagauuaucggcgcugacguccagaauaccacauuuaucauugaugggccuaacacccccgaauguccugacgaucagagagcguggaauaucugggagguggaggacuacggauucggcauuuuuacgacaaacaucuggcugaaacuucgcgauuccuauacccaggugugcgaccaccggcucaugagcgccgcuauuaaagauucuaaggccguccacgccgacaugggcuacuggaucgaauccgagaaaaaugaaacauggaagcuggcuagagccagcuucaucgagguuaagaccuguauuuggcccaaaucucauacacugugguccaacggggugcucgaaagcgagaugaucauuccgaagaucuauggaggcccuaugucucaacacaauuaccgccccggguacuucacccagacggcgggaccuuggcaucugggcaaacuugagcuggauuuugaccucugcgaagggaccacaguggucguggaugagcacugcggaaaccggggccccagccugagaaccacaaccguuacgggcaagauuauccacgaaugguguugccgguccuguacacugccuccccuucgcuucagaggggaggacggaugcugguauggcauggagauccggccggugaaagaaaaggaggaaaaucucgucaagagcauggugucugcuggguccggagagguugacagcuuuucccugggccugcucuguauuucuaucaugauugaagaggugaugagaagccgcuggucccggaaaaugcugaugaccgggacacuugccgucuucuuucugcucaucaugggacagcugaccuggaacgaucugauuagacuuugcaucauggugggcgccaaugcuucugaccgcaugggcauggggaccacauaccuggcccucauggcgacguucaagaugagaccuauguuugcuguuggacugcuguuccggcgccugaccagcagagaggugcuucugcucacaauuggccugucccuggucgccucuguggaacuucccaacagccuggaggaacucggggauggacuggccaugggcaucaugauccucaaacugcuuaccgacuuucaaucccaucagcugugggcuacacuccugagccugaccuucauuaagacgacauuuucucuucacuaugccuggaaaaccauggcuauggugcuguccaucgucagccucuucccccugugucucucuaccacaucccagaagaccacauggcugccuguucuucuggggagccugggaugcaagccgcucacgauguuucugauugccgagaauaaaaucuggggccggcgcucuuggccccuuaacgaaggcauuauggcgguggggaucguguccauccugcucagcucccugcucaagaacgaugucccucuggccggaccccuuauugcuggcgggaugcugaucgccuguuacgugauuagcggaucuagcgcugaccugucccucgagaaagccgccgagguuucuugggaagaggaagcugagcauagcggcgcgucccacaauauccugguggaaguccaggaugacgggaccaugaagauuaaagaugaggagagagacgauacacuuaccauccugcucaaggccacacugcucgcugugucuggaguuuauccucugagcauccccgccacccuuuucgugugguacuucuggcagaagaagaagcagcgguccggcguccugugggacacgccuucucccccggaaguggagcgcgccguccuggaugacggcauuuauagaaucaugcagcgggggcuccugggacgcagccaggugggcguugggguguuucaagaaaacgucuuccauaccauguggcacgugacaagaggagcuguucuuauguaccagggcaaacggcuggagccuuccugggccagcgugaagaaagaccucauuucuuacgggggaggcuggagacugcagggcuccuggaauaccggggaggaaguccaggugaucgcgguggagcccggaaagaacccuaaaaauguucaaacagcucccggcaccuuuaagacaccggaaggggaggucggagccauugcccucgauuucaagccuggcacgagcgggucucccaucgugaaccgcgaaggaaaaauugugggccuguauggcaauggggucgugaccacauccggaaccuacguuagcgcuaucgcccaggcgaaggcuucccaggagggcccucuucccgagaucgaagacgagguguuucggaaaagaaaccugaccauuauggaucugcaccccgggucuggaaagacacgccgguaucucccugccaucgucagagaagccauuaaacgcaagcugcggacgcuuauccuggcuccgaccagagugguugccagcgagauggcugaagcccucaagggcaugcccauucgcuaccaaacaaccgcggugaaauccgagcauacagggaaggagaucgucgaccugaugugccacgccaccuucacgaugcggcugcucagcccugugagaguucccaauuauaacaugaucauuauggaugaagcucauuuuacagacccuucuuccaucgccgcucggggcuacauuagcacccgcgugggaaugggcgaggccgccgcuaucuucaugaccgcgacacccccugggucugucgaagccuuuccgcagagcaaugcugugauucaggaugaggaaagagacauccccgagcgguccuggaacucuggauaugaguggaucaccgauuucccuggcaaaacagugugguuuguccccagcauuaaguccgggaaugacaucgccaacugucuucgcaaaaauggaaagagaguuauucagcugucucggaagaccuucgauacggaauaccagaagaccaagaacaacgacugggacuacguggugaccacagauaucagcgagaugggcgccaauuucagagcugaccgcgucauugauccucggagaugccugaaacccgugauccucaaggacgggccggaacgcguuauucuggccggcccuaugcccgugaccgucgcguccgcugcccagcggagaggacgcaucggccggaaccacaauaaagagggggaucaguauaucuacaugggacagccccuuaacaaugacgaggaucaugcccacuggacggaagcuaagaugcugcucgacaacauuaauaccccugagggcaucauucccgcccuguuugaaccugagagagaaaagagcgcggccaucgauggggaguaucgccugagaggagaggcucggaaaacauucguggaacucaugcgcagaggcgaccuuccgguuuggcugucuuacaagguggccuccgagggguuucaauauagcgaucggcgcuggugcuucgacggcgaaagaaacaaucagguccuggaggaaaacauggauguggagauuuggaccaaagagggagaacggaagaaacucagaccccgcuggcuggacgcucggacauacuccgacccucuugcccugagagaguuuaaggaguucgcugccggccgccggucugucagcggggaucucauccuggagaucggaaaacugccccagcaccucacccagagagcgcaaaaugcccuugacaaccuggugaugcugcauaauuccgaacagggcgggcgggcuuaucgccacgccauggaggagcucccugauacaauugaaacccugaugcuucuggcucucaucgccguucugacgggaggcgugacacuguuuuuccucucuggcagagggcuuggaaagaccagcauuggccugcugugugugauggccuccagcguccuccuguggauggcuucuguugagccccauuggaucgcggccuccauuauccuugaauuuuuccugauggugcuccugaucccggagccugaccggcagcgcacaccccaggauaaccaacuggcuuacguggucauugggcuccuuuuuaugauccugacaguggccgccaaugagaugggacugcucgaaaccacaaagaaagaccugggcauugggcacguugcuguggagaaccaccaucacgccgcgaugcuugaugucgaccugcauccugccagcgcuuggacgcucuacgccguggcuaccacaaucauuacccccaugaugagacacacaaucgaaaacaccacggccaauauuucucugaccgcgaucgccaaccaggcugccauccugaugggacucgauaagggcuggccuauuuccaaaauggacaucggcgucccccuucuggcucuggggugcuauagccaggugaauccgcucacacugaccgccgcuguucuuaugcugguggcccauuacgcgauuaucggaccuggccuccaagccaaggcuacacgggaggcccagaaacgcaccgcugccgggauuaugaagaaccccacggucgauggaaucguggccaucgaccuggaucccguuguguaugacgcgaaguucgaaaaacagcugggccagauuaugcuccuuauccuguguacaucucaaauucugcucaugagaaccacaugggcucugugcgagagcaucacccuugccaccgggccucugacaacgcucugggagggauccccgggcaaguuuuggaauaccacaauugcugucucuauggccaacaucuuccggggcagcuaccuggccggggcuggacuggccuucucccucaugaaaagccuuggcgggggacgcagaggcaccggggcgcagggagaaacacugggcgagaaguggaaacggcagcugaaucagcucuccaagucugaauuuaacaccuauaagagaagcggcaucauggagguggaccgcuccgaagccaaagaggggcugaagcggggagagacgacaaaacacgcugugucuagaggcaccgccaaacuucgcugguucguugaacggaaucuggucaaacccgaggggaaggugauugaucucggauguggcagagggggauggagcuacuauugcgcuggccugaagaaagugaccgaagucaagggcuacacaaaagggggaccuggccacgaggaacccaucccuauggccaccuacggguggaaccugguuaagcuccauuccggaaaagacguguuuuucauucccccugagaagugugauacacuucugugcgacaucggcgagucuagcccgaaucccacgauugaagaggggcgcacccugcgggugcucaaaauggucgaaccuuggcugagaggaaaccaauuuuguaucaagauucuuaaucccuauaugccuuccgugguugagacacuggagcagaugcagcgcaagcacggcggcaugcucgugcggaacccccugagcagaaauucuacccaugaaauguacugggucuccugcgggacaggaaacaucgugagcgcgguuaauaugaccucucgcaugcugcucaaccgguucacgauggcccacagaaaaccgaccuaugagcgcgauguggaccugggcgcugggacaagacacgucgccguggaaccugagguggcuaaccuugauaucauuggacagcggaucgaaaauauuaagcaugagcacaaauccaccuggcauuacgacgaggauaaccccuauaagacaugggccuaccacggcagcuaugaagucaaacccucuggguccgcuagcuccaugguuaauggaguggugaagcugcucaccaagccuugggacgucauccccauggugacacaaauugccaugaccgauacgacaccuuuuggccagcagcgcguuuucaaagagaagguggacaccagaaccccgaaagcgaagcggggcacagcccaaaucauggaagucacggcuaaauggcuguggggguuucuuagcagaaacaagaagccccggaucuguacccgcgaggaguucacaagaaaagugcggucuaaugccgcuauuggagccguuuuuguggacgagaaccaguggaauagcgccaaggaggcggucgaagaugagcgcuucugggaccuggugcauagagaacgggagcuccacaaacagggcaagugcgcuaccugcguuuacaacaugauggggaaacgcgaaaagaagcugggagaguuuggcaaagccaagggguccagagccaucugguacauguggcugggcgcucgguuccucgaguucgaagcccugggauuuaugaaugaggaucacugguucucucgcgaaaacagccuuuccggcguggagggggagggacugcauaaacucggcuauauucugagagacaucucuaagauuccugggggaaauauguacgcugaugacacagccggcugggauacccggaucacagaagacgaucuucagaacgaggcgcgcaucaccgacauuauggaacccgagcacgcccugcucgcuaaaagcaucuuuaagcugacguaucaaaauaaagucgugagaguccagcggccugccaagaacgggaccgugauggauguuauuucccgcagagaccagcggggcucuggacaggugggcacauacgggcugaauaccuucacaaacauggaagcucaacucaucagacagauggagagcgagggaaucuuuucccccagcgaacuggagaccccgaaccuugccaagcgcguccuggauuggcucgaaaaauauggcguggagcggcugaagagaauggcgaucucuggggacgacugugugguuaaaccuaucgaugaccgcuucgccacggcucuuacagcccugaaugauaugggaaaggugcggaaagacauuccccagugggaaccuuccaagggcuggaacgauuggcagcaaguccccuuuugcagccaucacuuccaccagcucaucaugaaggacgggagagagauugugguuccuugucgcaaucaggaugagcuggugggccgggcuagagucucucagggagccggcuggucccugcgcgaaaccgcuugccucgggaaaagcuacgcccaaauguggcagcugauguauuuucaucggagagaccuucgccuggcggccaacgcuaucuguuccgccgugcccgucgauuggauuccgacaucucggaccacguggagcauccacgcccaucaccaguggaugaccacagaggacaugcucuccguguggaauagaguuuggauugaagagaacccuuggauggaagauaagacccauaucagcucuuggggagacgugcccuaccugggcaaacgggaggaccaauggugcgggucccuuaucggacugacagcuagagccaccugggcgacaaauauucaggucgcuaucaaccaggugcgccggcucauuggcaaugagaacuaccuggauuauaugaccagcaugaagagauucaaaaaugaaucugaccccgagggggcccugugguga

SEQ ID NO: 18879 - RNA, 9879 nt, Artificial Sequence
  derived and/or modified CDS sequence (opt5) from DENV-1__FJ205876__SS-prME
agcgugaccaugcugcucaugcugaugcccacagcccuugcuuuccaccugacgaccagaggcggggaaccucauaugaucgucuccaagcaggaacggggaaaaucucuccuguuuaagacaagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccagacggccggaccuuggcaucucggcaaacuggagcuugauuuugaccugugcgaagggaccacagugguuguggaugagcacugcggaaaccggggccccagccucagaaccacaaccgucacgggcaagaucauccacgaaugguguugccgguccuguacacugccuccccugcgcuucagaggggaggacggaugcugguauggcauggagauucggccggugaaagaaaaggaggaaaaucuuguuaagagcauggugucugcgggguccggagaggucgacagcuuuucccucggccugcuguguaucucuauuaugaucgaagaggugaugagaagccgcuggucccggaaaaugcucaugaccgggacacuggcuguuuucuuucuucugauuaugggacagcucaccuggaacgaucugaucagacugugcauuauggugggcgccaaugccucugaccgcaugggcauggggaccacauaccuugcucugauggccacguucaagaugagaccuauguuugcggucggacuccuguuccggcgccucaccagcagagaggugcugcuucugacaaucggccucucccugguggcuucugucgaacugcccaacagccuugaggaacugggggauggacucgccaugggcaucaugauucugaaacuccugaccgacuuucaaucccaucagcuuugggccacacugcucagccugaccuucaucaagacgacauuuucucugcacuaugcuuggaaaaccauggccaugguucuuuccauugugagccuguucccccucugucugucuaccacaucccagaagaccacauggcucccugugcugcuugggagccugggaugcaagccgcugacgauguuucucaucgcugagaauaaaauuuggggccggcgcucuuggccccugaacgaaggcaucauggccgucgggaucguguccauucuucugagcucccuccugaagaacgauguuccucucgcgggaccccugaucgccggcgggaugcuuauugcuuguuacgugaucagcggaucuagcgccgaccugucccuggagaaagcugccgaggucucuugggaagaggaagccgagcauagcggcgcuucccacaauauucucguggaaguucaggaugacgggaccaugaagaucaaagaugaggagagagacgauacacugaccauccuucugaaggcgacacuccuggccgugucuggagucuauccucucagcauucccgcuacccuguucgugugguacuucuggcagaagaagaagcagcgguccggcguccuuugggacacgccuucucccccggaaguggagcgcgccguucuggaugacggcaucuauagaauuaugcagcgggggcugcucggacgcagccaggugggcgucgggguguuucaagaaaacguuuuccauaccauguggcacgugacaagaggagccguccugauguaccagggcaaacggcuugagccuuccugggcuagcgugaagaaagaccugaucucuuacgggggaggcuggagacuccagggcuccuggaauaccggggaggaagugcagguuauugccgucgagcccggaaagaacccuaaaaaugugcaaacagcgcccggcaccuuuaagacaccggaaggggaggugggagcuaucgcccuggauuucaagccuggcacgagcgggucucccauugucaaccgcgaaggaaaaaucgugggccucuauggcaaugggguugugaccacauccggaaccuacgucagcgccaucgcucaggccaaggcgucccaggagggcccucugcccgagauugaagacgagguguuucggaaaagaaaccuuaccaucauggaucugcaccccgggucuggaaagacacgccgguaucugccugcuauuguuagagaagccaucaaacgcaagcuccggacgcugauucuugccccgaccagaguggucgcuagcgagauggccgaagcucugaagggcaugcccauccgcuaccaaacaaccgccgugaaauccgagcauacagggaaggagaucguugaccucaugugccacgcgaccuucacgaugcggcugcugagcccugugagaguccccaauuauaacaugauuaucauggaugaagcccauuuuacagacccuucuuccauugcugcccggggcuacaucagcacccgcgugggaaugggcgaggcugccgccauuuucaugaccgcuacacccccugggucuguggaagcguuuccgcagagcaaugccgucauccaggaugaggaaagagacauccccgagcgguccuggaacucuggauaugaguggauuaccgauuucccuggcaaaacaguuugguuugugcccagcaucaaguccgggaaugacauugcuaacugucuccgcaaaaauggaaagagagugauccagcuuucucggaagaccuucgauacggaauaccagaaaaccaagaacaacgacugggacuacgucgugaccacagauauuagcgagaugggcgccaauuucagagccgaccgcguuaucgauccucggagaugccugaaacccgugauucugaaggacgggccggaacgcgucauccucgcuggcccuaugcccgugaccguugccuccgcggcucagcggagaggacgcaucggccggaaccacaauaaagagggggaucaguauauuuacaugggacagccccugaacaaugacgaggaucaugcccacuggacggaagccaagaugcuucuggacaacaucaauaccccugagggcauuauccccgcucucuuugaaccugagagagaaaagagcgccgcgauugauggggaguaucgccugagaggagaggcccggaaaacauucguggaacugaugcgcagaggcgaccucccggucuggcuuucuuacaagguggcuuccgagggguuucaauauagcgaucggcgcuggugcuucgacggcgaaagaaacaaucagguccuggaggaaaacauggauguggagaucuggaccaaagagggagaacggaagaaacugagaccccgcuggcucgacgcccggacauacuccgacccucuggcucuuagagaguuuaaggaguucgccgcuggccgccggucuguuagcggggaucugauccucgagauuggaaaacugccccagcaccugacccagagagcccaaaaugcgcucgacaaccuugugaugcugcauaauuccgaacagggcgggcgggccuaucgccacgcuauggaggagcugccugauacaaucgaaacccucaugcugcuugcccugauugcugugcucacgggaggcgucacacuguuuuuccugucuggcagagggcucggaaagaccagcaucggccuucuguguguuauggccuccagcgugcugcucuggauggccucuguggagccccauuggauugcugcguccaucauccuggaauuuuuccuuaugguccugcucauuccggagccugaccggcagcgcacaccccaggauaaccaacuggccuacgugguuaucgggcugcucuuuaugauucuuacaguggcugccaaugagaugggacugcuggaaaccacaaagaaagaccucggcaucgggcacgucgccguggagaaccaccaucacgcugccaugcuggaugucgaccuucauccugcgagcgccuggacgcuguacgcuguggccaccacaauuaucacccccaugaugagacacacaauugaaaacaccacggcuaauaucucucucaccgccaucgcgaaccaggccgcuauucugaugggacuggauaagggcuggccuaucuccaaaauggacauuggcguuccccuccuugcccuggggugcuauagccaggugaauccgcugacacucaccgcugccguccugaugcuuguggcucauuacgccaucauuggaccuggccugcaagcgaaggccacacgggaggcucagaaacgcaccgccgcugggaucaugaagaaccccacgguugauggaaucguggccauugaccucgaucccgucguguaugacgccaaguucgaaaaacagcugggccagaucaugcugcucauucuuuguacaucucaaauccugcugaugagaaccacaugggcgcucugcgagagcauuacccuggcuaccgggccucuuacaacgcugugggagggauccccgggcaaguuuuggaauaccacaaucgccgugucuauggcuaacaucuuccggggcagcuaccucgccggggccggacuggcuuucucccugaugaaaagccucggcgggggacgcagaggcaccggggcccagggagaaacacuuggcgagaaguggaaacggcagcugaaucagcuguccaagucugaauuuaacaccuauaagagaagcggcauuauggagguugaccgcuccgaagcgaaagaggggcucaagcggggagagacgacaaaacacgccgucucuagaggcaccgcuaagcugcgcugguucguggaacggaaucuugugaaacccgaggggaaggucaucgaucugggauguggcagagggggauggagcuacuauugcgccggccucaagaaaguuaccgaagugaagggcuacacaaaagggggaccuggccacgaggaacccauuccuauggcuaccuacggguggaaccuggugaagcugcauuccggaaaagacgucuuuuucauucccccugagaagugugauacacuccuuugcgacauuggcgagucuagcccgaaucccacgaucgaagaggggcgcacccugcgggugcugaaaaugguugaaccuuggcucagaggaaaccaauuuuguauuaagauccugaaucccuauaugccuuccguggucgagacacuugagcagaugcagcgcaagcacggcggcaugcuggugcggaacccccucagcagaaauucuacccaugaaauguacuggguuuccugcgggacaggaaacaucgugagcgccgucaauaugaccucucgcaugcugcugaaccgguucacgauggcgcacagaaaaccgaccuaugagcgcgauguggaccucggcgccgggacaagacacguggcugucgaaccugagguugccaaccuggauauuaucggacagcggauugaaaauaucaagcaugagcacaaauccaccuggcauuacgacgaggauaaccccuauaagacaugggcuuaccacggcagcuaugaagugaaacccucuggguccgccagcuccauggugaauggagucgugaaacuucugaccaagccuugggacguuauucccauggugacacaaaucgcuaugaccgauacgacaccuuuuggccagcagcgcgucuucaaagagaagguggacaccagaaccccgaaagccaagcggggcacagcgcaaaucauggaaguuacggccaaauggcucuggggguuucugagcagaaacaagaagccccggauuuguacccgcgaggaguucacaagaaaagugcggucuaaugcugccaucggagcugucuuuguggacgagaaccaguggaauagcgccaaggaggccguugaagaugagcgcuucugggaccuugugcauagagaacgggagcugcacaaacagggcaagugcgcgaccugcgucuacaacaugauggggaaacgcgaaaagaagcucggagaguuuggcaaagcuaagggguccagagccauuugguacauguggcugggcgcccgguuccuggaguucgaagcucucggauuuaugaaugaggaucacugguucaaccgcgaaaauucucugagcggcguggagggggagggacuucauaaacugggcuauauccucagagacauuuccaagaucccugggggaaacauguacgccgaugacacagcuggcugggauacccggaucacagaagacgaucugcagaaugaggcccgcauuaccgacaucauggaacccgagcacgcgcuucuggccagaucuauuuuuaaacucacguaucaaaacaaggucgugcggguucagcgcccugcuaaaaaugggaccgugauggaugucaucagcagacgggaccagagaggcuccggacaggugggcacauacgggcugaacaccuucacaaacauggaagcccaacugauucgccagauggagucugagggaaucuuuagccccuccgaacucgagaccccgaaucuggcugaacgggugcuugauuggcuggagaaguauggcguugaaagacucaagcgcauggccaucagcggggacgacuguguggucaaaccuauugaugaccgguucgcgacggcccugacagcucuuaacgauaugggaaaggugagaaaagacaucccccagugggagccuucuaagggcuggaaugauuggcagcaaguucccuuuugcucccaucacuuccaccagcugauuaugaaagacgggcgcgagaucguggucccuugucggaaccaggaugaacucgugggcagagcccgcgucagccagggagcuggcuggucucugcgggagaccgccugccuggggaaguccuacgcucaaauguggcagcucauguauuuucauagacgcgaccugcggcuugccgcgaaugccauuuguagcgcugugcccguugauuggaucccgacauccagaaccacguggucuauucacgcccaucaccaguggaugaccacagaagacaugcugagcguguggaaccgggucuggaucgaggaaaauccuuggauggaggauaagacccauaucuccagcuggggagacgugcccuaccucggcaaaagagaggaccaauggugcgggucucugauuggacuuacagcccgcgcuaccugggccacaaacauccagguugcgauuaaucaggugcggagacugaucggcaacgaaaauuaccucgauuauaugaccuccaugaagcgcuucaaaaacgagagcgaccccgaaggggcucugugguga

SEQ ID NO: 18880 - RNA, 9879 nt, Artificial Sequence
  derived and/or modified CDS sequence (opt5) from DENV-1__FJ024455__SS-prME
agcgugaccaugcugcucaugcugaugcccacagcccuugcuuuccaccugacgaccagaggcggggaaccucauaugaucgucuccaagcaggaacgggggaaaucucuccuguuuaagacaagcguuggcgugaacaugugcacccuuauugccauggaccugggggaacucugugaagauacaaugaccuacaaaugcccccgcaucacagagaccgaacccgacgauguggacuguuggugcaaugccacggauaccugggucacauauggaaccuguucccaaacaggcgagcacagacgggacaagcgcucuguggcucuggccccucauguugggcugggacucgagaccagaacggaaacauggaugagcuccgagggcgccuggaaacagauucagcggguggaaaccugggcucugcgccaccccggcuucacagucaucgcccuuuuucuggcucaugccauugggaccucuaucacccagaagggaaucauuuucauccuccugaugcuugugacaccuagcauggcgaugagaugcguuggcauugggucccgggauuuuguggagggacugagcggcgccacgugggucgacguggugcucgagcacgggucuugugucaccacaauggcuaaggauaaacccacccuggacaucgaacugcucaagacagagguuaccaacccugccgugcugcgcaaacuuugcauugaagcuaagaucuccaauacgacaaccgauagcagaugucccacccaaggagaggccacacugguggaagaacaagacgcgaacuucgucugccggcgcaccuuuguggauagaggcuggggcaauggguguggacucuucggcaaagggucucugauuacaugcgccaaguuuaagugcguuacgaaacuugagggaaagaucgugcaguacgaaaaccugaaauauuccgucaucgugaccguucacacaggcgaccagcaucaaguggggaaugagagcaccgaacacggaacaaccgcuacgauuacaccccaagccccuaccaccgagauccagcucacagacuacggcgcucugacccuggauuguucuccccggacgggccucgacuucaacgaaaugguccugcuuacaaugaaggagaaauccuggcuggugcauaagcagugguuucucgaucugccucuucccuggaccagcggggccuccacaucucaagagaccuggaaucgccaggaccugcucgucaccuucaaaacagcccacgcuaagaagcaggaagugguugugcugggaagccaagagggcgcgaugcacacggcccugaccggggcuacagaaauucagaccuccggaacaaccacgaucuuugccggccaucucaaaugcagacugaagauggauaaacuuacacugaaggggaugagcuaugucauguguaccggcucuuucaaacucgagaaggaacuggccgagacccagcacggaacagugcugguucagauuaaguacgagggcaccgacgcuccgugcaaaaucccuuucuccacacaagaugaaaagggggugacgcagaacggacggcuuaucaccgccaaucccauugucacagacaaagagaagccugugaacaucgaagcggagccgcccuuuggcgagagcuauauugugaucggggcuggagaaaaagcccucaagcugucuugguucaagaaaggcagcuccauugggaagauguuugaggccaccgcuagaggcgcccgccggauggcuauccugggagauacagccugggacuucggcucuaucgggggaguuuuuaccagcgucggcaaacucgugcaucagauuuucgggacggcguacggagugcuguuuuccggcgucagcuggaccaugaagaucgggauuggcgugcuucugacauggcucggacucaauucuagauccaccagccugucuaugacauguaucgccguuggccuugugacccucuaccugggggucauggugcaggcugauuccggaugcguuauuaacuggaaaggccgcgaacugaagugugggagcggaaucuucgugacaaaugagguccacaccuggacggaacaauauaaguuucaggccgacuccccuaaacggcucucugcugccauuggcaaggcgugggaggagggggugugcggcaucagaagcgccacacgccuggaaaacaucauguggaaacagauuuccaacgagcuuaaucauauccugcucgaaaacgacaugaaguucaccguuguggucggagauguggcuggcauucuggcccaggggaaaaagaugauccggccgcaacccauggaguacaaauauucuuggaaaagcuggggaaaggcuaagauuaucggcgccgacgugcagaauaccacauuuaucauugaugggccuaacacccccgaauguccugacgaucagagagccuggaauaucugggaggucgaggacuacggauucggcauuuuuacgacaaacaucuggcugaaacuucgcgauuccuauacccagguuugcgaccaccggcucaugagcgcugcgauuaaagauucuaaggccgugcacgcugacaugggcuacuggaucgaauccgagaaaaaugaaacauggaagcuggccagagccagcuucaucgaggugaagaccuguauuuggcccaaaucucauacacugugguccaacgggguccucgaaagcgagaugaucauuccgaagaucuauggaggcccuauuucucaacacaauuaccgccccggguacuucacccagacggcuggaccuuggcaucugggcaaacuugagcuggauuuugaccucugcgaagggaccacagugguuguggaugagcacugcggaaaccggggccccagccugagaaccacaaccgucacgggcaagaucauccacgaaugguguugccgguccuguacacugccuccccuucgcuucagaggggaggacggaugcugguauggcauggagauucggccggugaaagaaaaggaggaaaaucucguuaagagcauggugucugccggguccggagaggucgacagcuuuucccugggccugcucuguaucucuauuaugaucgaagaggugaugagaagccgcuggucccggaaaaugcugaugaccgggacacuugcgguuuucuuucugcucauuaugggacagcugaccuggaacgaucugaucagacuuugcauuauggugggcgcuaaugccucugaccgcaugggcauggggaccacauaccuggcccucauggcuacguucaagaugagaccuauguuugccgucggacugcuguuccggcgccugaccagcagagaggugcuucugcucacaaucggccugucccugguggcgucugucgaacuucccaacagccuggaggaacucggggauggacuggcuaugggcaucaugauucucaaacugcuuaccgacuuucaaucccaucagcugugggccacacuccugagccugaccuucaucaagacgacauuuucucuucacuaugccuggaaaaccauggcuaugguucuguccauugugagccucuucccccugugucucucuaccacaucccagaagaccacauggcugccugugcuucuggggagccugggaugcaagccgcucacgauguuucugaucgccgagaauaaaauuuggggccggcgcucuuggccccuuaacgaaggcaucauggcugucgggaucguguccauucugcucagcucccugcucaagaacgauguuccucuggccggaccccuuaucgcgggcgggaugcugauugccuguuacgugaucagcggaucuagcgcugaccugucccucgagaaagccgcugaggucucuugggaagaggaagccgagcauagcggcgccucccacaauauucugguggaaguucaggaugacgggaccaugaagaucaaagaugaggagagagacgauacacuuaccauccugcucaaggcuacacugcucgcggugucuggagucuauccucugagcauucccgccacccuuuucgugugguacuucuggcagaagaagaagcagcgguccggcguccugugggacacgccuucucccccggaaguggagcgcgcuguucuggaugacggcaucuauagaauuaugcagcgggggcuccugggacgcagccaggugggcgucgggguguuucaagaaaacguuuuccauaccauguggcacgugacaagaggagccguccuuauguaccagggcaaacggcuggagccuuccugggccagcgugaagaaagaccucaucucuuacgggggaggcuggagacugcagggcuccuggaauaccggggaggaagugcagguuauugcugucgagcccggaaagaacccuaaaaaugugcaaacagcccccggcaccuuuaagacaccggaaggggaggugggagcgaucgcucucgauuucaagccuggcacgagcgggucucccauugucaaccgcgaaggaaaaaucgugggccuguauggcaaugggguugugaccacauccggaaccuacgucagcgccaucgcccaggcuaaggccucccaggagggcccuccgcccgagauugaagacgagguguuucggaaaagaaaccuuaccaucauggaucugcacccugggucuggaaagacacgccgguaucugccggcgauuguuagagaagcuaucaaacgcaagcuccggacgcugauucuugcccccaccagaguggucgccagcgagauggcugaagcccugaagggcaugccuauccgcuaccaaacaaccgcugugaaauccgagcauacagggaaggagaucguugaccucaugugccacgccaccuucacgaugcggcugcugagccccgugagagucccuaauuauaacaugauuaucauggaugaagcgcauuuuacagaccccucuuccauugccgcucggggcuacaucagcacccgcgugggaaugggcgaggccgcugccauuuucaugaccgccacaccuccggggucuguggaggcuuuuccccagagcaaugcggucauccaggaugaggaaagagacaucccugagcgguccuggaacucuggauaugaguggauuaccgauuuccccggcaaaacaguuugguuugugccuagcaucaaguccgggaaugacauugccaacugucuccgcaaaaauggaaagagagugauccagcuuucucggaagaccuucgauacggaauaccagaagacaaagaacaacgacugggacuacgucgugaccacagauauuagcgagaugggcgcuaauuucagagccgaccgcguuaucgauccccggagaugccugaaaccggugauucugaaggacgggccugaacgcgucauccucgccggccccaugcccgugaccguugcuuccgccgcgcagcggagaggacgcaucggccggaaccacaauaaagagggggaucaguauauuuacaugggacagccucugaacaaugacgaggaucaugcucacuggacggaagccaagaugcuucuggacaacaucaauacccccgagggcauuaucccugcccucuuugaaccggagagagaaaagagcgcugccauugauggggaguaucgccugagaggagaggcgcggaaaacauucguggaacugaugcgcagaggcgaccuccccgucuggcuuucuuacaagguggccuccgagggguuucaauauagcgaucggcgcuggugcuucgacggcgaaagaaacaaucagguccuggaggaaaacauggauguggagaucuggaccaaagagggagaacggaagaaacugagaccucgcuggcucgacgcucggacauacuccgacccccuggcccuuagagaguuuaaggaguucgcugccggccgccggucuguuagcggggaucugauccucgagauuggaaaacugccucagcaccugacccagagagcucaaaaugcccucgacaaccuugugaugcugcauaauuccgaacagggcgggcgggcguaucgccacgccauggaggagcugcccgauacaaucgaaacccucaugcugcuugcucugauugccgugcucacgggaggcgucacacuguuuuuccugucuggcagagggcucggaaagaccagcaucggccuucuguguguuauggcuuccagcgugcugcucuggauggccucuguggagccgcauuggauugccgcuuccaucauccuggaauuuuuccuuaugguccugcucauuccugagcccgaccggcagcgcaccccucaggauaaccaacuggcguacgugguuaucgggcugcucuuuaugauucuuacaguggccgcuaaugagaugggacugcuggaaaccacaaagaaagaccucggcaucgggcacgucgccguggagaaccaccaucacgccgcuaugcuggaugucgaccuucaucccgccagcgcguggacgcuguacgccguggcuaccacaauuaucaccccuaugaugagacacacaauugaaaacaccacggccaauaucucucucaccgcuaucgccaaccaggcggccauucugaugggacuggauaagggcuggcccaucuccaaaauggacauuggcguuccgcuccuugcucuggggugcuauagccaggugaauccucugacacucaccgccgcuguccugaugcuuguggcccauuacgcuaucauuggacccggccugcaagccaaggcgacacgggaggcccagaaacgcaccgcugccgggaucaugaagaaccccacgguugauggaaucguggcuauugaccucgauccugucguguaugacgccaaguucgaaaaacagcugggccagaucaugcugcucauucuuuguacaucucaaauccugcugaugagaaccacaugggcccucugcgagagcauuacccuggcgaccgggccgcuuacaacgcugugggagggaucccccggcaaguuuuggaauaccacaaucgcugugucuauggccaacaucuuccggggcagcuaccucgcuggggccggacuggccuucucccugaugaaaagccucggcgggggacgcagaggcaccggggcucagggagaaacacuuggcgagaaguggaaacggcagcugaaucagcuguccaagucugaauuuaacaccuauaagagaagcggcauuauggagguugaccgcuccgaagccaaagaggggcucaagcggggagagacgacaaaacacgcggucucuagaggcaccgccaagcugcgcugguucguggaacggaaucuugugaaaccugaggggaaggucaucgaucugggauguggcagagggggauggagcuacuauugcgcuggccucaagaaaguuaccgaagugaagggcuacacaaaagggggacccggccacgaggaaccuauucccauggccaccuacggguggaaccuggugaagcugcauuccggaaaagacgucuuuuucaucccuccggagaagugugauacacuccuuugcgacauuggcgagucuagccccaauccuacgaucgaagaggggcgcacccugcgggugcugaaaaugguugaacccuggcucagaggaaaccaauuuuguauuaagauccugaauccuuauaugcccuccguggucgagacacuugagcagaugcagcgcaagcacggcggcaugcuggugcggaacccgcucagcagaaauucuacccaugaaauguacuggguuuccugcgggacaggaaacaucgugagcgcugucaauaugaccucucgcaugcugcugaaccgguucacgauggcccacagaaaaccuaccuaugagcgcgauguggaccucggcgcggggacaagacacguggccgucgaacccgagguugcuaaccuggauauuaucggacagcggauugaaaauaucaagcaugagcacaaauccaccuggcauuacgacgaggauaaccccuauaagacaugggccuaccacggcagcuaugaagugaaaccuucuggguccgcuagcuccauggugaauggagucgugaaacuucugaccaagcccugggacguuauuccuauggugacacaaaucgccaugaccgauacgacaccguuuggccagcagcgcgucuucaaagagaagguggacaccagaacccccaaagcuaagcggggcacagcccaaaucauggaaguuacggcgaaauggcucuggggguuucugagcagaaacaagaagccucggauuuguacccgcgaggaguucacaagaaaagugcggucuaaugccgcuaucggagccgucuuuguggacgagaaccaguggaauagcgcuaaggaggccguugaagaugagcgcuucugggaccuugugcauagagaacgggagcugcacaaacagggcaagugcgcgaccugcgucuacaacaugauggggaaacgcgaaaagaagcucggagaguuuggcaaagcgaagggguccagagcuauuugguacauguggcugggcgcccgguuccuggaguucgaagcccucggauuuaugaaugaggaucacugguucucucgcgaaaacagccuguccggcguggagggggagggacuucauaaacugggcuauauccucagagacauuucuaagauccccgggggaaauauguacgcugaugacacagccggcugggauacccggaucacagaagacgaucugcagaacgaggcucgcauuaccgacaucauggaaccugagcacgcccuucuggcgaaaagcauuuuuaagcucacguaucaaaauaaagucgugagaguucagcggcccgccaagaacgggaccgugauggaugucaucucccgcagagaccagcggggcucuggacaggugggcacauacgggcugaauaccuucacaaacauggaagcucaacugauuagacagauggagagcgagggaaucuuuuccccgagcgaacucgagaccccuaaccuggccgaacgcgugcuugauuggcuggagaaguauggcguugaacggcucaaaagaauggcuaucucuggggacgacuguguggucaagcccauugaugaccgcuucgccacggcgcugacagcccuuaaugauaugggaaaagugcggaaggacaucccucagugggagcccuccaaaggcuggaacgauuggcagcaaguuccuuuuugcagccaucacuuccaccagcugauuaugaaggacgggagagagaucgugguccccugucgcaaucaggaugaacucgugggccgggcuagagucucucagggagccggcuggucccugcgcgagaccgcuugccugggaaagagcuacgcccaaauguggcagcucauguauuuucaucggagagaccugcgccuugcugccaacgcgauuuguuccgccgugccgguugauuggaucccuacaucucggaccacguggagcauucacgcucaucaccaguggaugaccacagaagacaugcuguccguguggaauagagucuggaucgaggaaaaccccuggauggaggauaaaacccauaucagcucuuggggagacgugcccuaccucggcaagcgggaggaccaauggugcgggucccugauuggacuuacagccagagccaccugggcuacaaauauccagguugccauuaaccaggugcgccggcugaucggcaaugaaaacuaccucgauuauaugaccagcaugaaaagauucaagaaugagucugacccugaaggggcgcugugguga

SEQ ID NO: 18881 - RNA, 9879 nt, Artificial Sequence
  derived and/or modified CDS sequence (opt5) from DENV-1__FJ024456__SS-prME
agcgugaccaugcugcucaugcugaugcccaccgcccuugcuuuccaccugacgaccagaggcggggaaccucauaugaucgucacaaagcaggaacggggaaaaucccuccuguuuaagaccucugccggcguuaacaugugcauccuuaucgccauggaccugggggaacucugugaagauacaaugaccuacaaaugcccccgcauuacagaggcugaacccgacgauguggacuguuggugcaaugccaccgauacgugggugaccuauggaacauguagccaaaccggcgagcaccggcgggacaagcgcuccguugcccuggcuccucauguggggcugggacucgagacaagaaccgaaacguggaugucuagcgagggcgccuggaaacagauccagcggguugaaacaugggcucugcgccaccccggcuucaccgugauugcccuuuuucuggcgcaugccaucgggacauccaucacccagaagggaauuaucuucauucuccugaugcuugucaccccuucuauggcuaugagaugcgugggcaucgggagccgggauuuuguugagggacuguccggcgccacauggguggacgucgugcucgagcacgggagcugugugacgaccauggcuaaggauaaacccacacuggacauugaacugcucaagaccgaggucacaaacccugccguucugcgcaaacuuugcaucgaagcgaagauuucuaauaccacgacagauuccagauguccgacccaaggagaggccacccugauggaagaacaagacgcuaacuucgugugccggcgcacauuuguggauagaggcuggggcaauggguguggacucuucggcaaagggagccugauuaccugcgccaaguuuaagugcgucacaaaacuugagggaaagaucgugcaguacgaaaaccugaaauauucuguuauugugacgguccacaccggcgaccagcaucaaguggggaaugaguccacagaacacggaaccacagcuaccaucacgccccaggccccuaccagcgagauucagcucacagacuacggcgcccugacccuggauuguucuccccggacaggccucgacuucaacgaaaugguucugcuuaccaugaaggagaaauccuggcuggugcauaagcagugguuucucgaucugccucuucccuggacgagcggggcuuccacaucucaagagaccuggaaucgccaggaccugcucgucacauucaaaaccgcgcacgccaagaagcaggaaguggucgugcugggaagccaagagggcgcuaugcacaccgcccugacaggggccacggaaauccagaccuccggaacaaccacaauuuuugcuggccaucucaaaugcagacugaagauggauaaacuuacccugaaggggaugagcuauguuauguguacgggcucuuucaaacucgagaaggaaguggccgagacacagcacggaaccguccuggugcagaucaaguacgagggcaccgacgcgccgugcaaaaucccuuucuccacacaagaugaaaaggggguuauucagaacggacggcugaucaccgcuaaucccauugugacagacaaagagaagccugucaacaucgaagccgagccgcccuuuggcgagagcuauauugugaucggggugggagaaaaagcccuuaagcucucuugguucaagaaaggcagcuccaucgggaagauguuugaggcuacggccagaggcgcucgccggauggccauucugggagauaccgcgugggacuucggcucuaucgggggaguuuuuacaagcgucggcaaacuggugcaucagauuuucgggaccgccuacggagugcucuuuuccggcgucagcuggacaaugaagaucgggauuggcgugcugcuuaccuggcugggacucaauucuagauccacgagccugucuaugaccuguaucgcuguuggccuggugacacuuuaccucggggucauggugcaggccgauuccggaugcguuauuaacuggaaaggccgcgaacugaagugugggagcggaaucuucgugaccaaugagguccacacauggaccgaacaauauaaguuucaggcugacuccccuaaacggcugucugccgcgaucggcaaggccugggaggagggggugugcggcauuagaagcgcuacacgccucgaaaacaucauguggaaacagauuuccaacgagcugaaucauauccuucuggaaaacgacaugaaguucaccguuguggucggagauguggugggcauucucgcccaggggaaaaagaugauccggccgcaacccauggagcacaaauacucuuggaaaagcuggggaaaggcuaagaucauuggcgccgacguccagaauacgacauuuaucauugaugggccuaacacccccgaauguccugacgaucagagagccuggaauaucugggagguugaggacuauggauucggcauuuuuaccacaaacaucuggcugaagcugcgcgauuccuacacccaggcuugcgaccaccggcuuaugagcgcggccaucaaagauucuaaggcugugcaugccgacaugggcuauuggauugaauccgagaaaaaugaaacguggaagcucgccagagcuagcuucaucgaggugaagacauguauuuggcccaaaucucacacccugugguccaacgggguccuggaaagcgagauggugaucccgaagauuuacggaggcccuaucucucaacauaauuaucgccccggguacuucacacagaccgccggaccuuggcaccucggcaaacuggagcuugauuuugaccugugcgaagggacaaccguuguggucgaugagcacugcggaaaccggggccccagccucagaacgaccacagugaccggcaagaucauucaugaaugguguugccgguccuguacacugccuccccugcgcuucaaaggggaggacggaugcugguacggcauggagaucagaccgguuaaggaaaaggaggaaaaucuugugaaaagcauggucucugcgggguccggagagguggacagcuuuucccucggccugcuguguauuucuaucaugauugaagagguuaugcggagcagauggucccgcaagaugcucaugaccgggacgcuggcuguguuccuucugcucaucaugggacagcugacauggaacgaucugauucggcuuugcaucauggucggcgccaaugccucugacagaaugggcauggggaccacauaucuggcucucauggccaccuuuaaaaugcgcccuauguucgcggugggacugcucuuuagacggcugaccagccgcgaggugcuucugcucacaaucggccugucccuggucgcuucuguugaacuucccaacagccuggaggaacucggggauggacuggccaugggcauuaugauccucaagcugcuuacggacuuccaaucccaccagcugugggccacccuccugagccugacauuuauuaaaaccacacuuucucugcauuacgcuuggaagaccauggccauggugcucuccaucgugagccuguucccccucugucugucuacgacaucccagaagaccaccuggcuuccuguccugcuggggagccucggaugcaaaccgcugacaauguuucuuauugcugagaauaagaucuggggcagaaaaucuuggccccugaacgaaggcaucauggccguggggguuguguccauucuccugagcucccuccugaagaacgaugucccucuugcgggaccccugaucgccggcgggaugcugauugcuuguuaugugaucagcggaucuagcgccgaccucucccuggagaaagcugccgagguuucuugggaagaggaagccgagcacagcggcgcuucccauaauauucuuguggaaguccaggaugacgggaccaugaagaucaaagaugaggagcgggacgauacacugacgauccuccugaaggcgacccuccuggccgugucuggagucuacccucuuagcauucccgcuacacuguucgugugguauuuuuggcaaaagaaaaagcagcgcuccggcguucugugggacaccccuucucccccggaaguggagagagccguccucgaugacggcaucuaccggauuaugcagcgcgggcugcuuggaagaagccaggugggcguugggguguuccaagaaaacgucuuccacacaauguggcacgugacccggggagccgugcugauguaucagggcaaacgccucgagccuuccugggcuagcguuaagaaagaccugaucucuuacgggggaggcuggagacuccagggcuccuggaauacgggggaggaaguccaggugauugccguggagcccggaaagaacccuaagaauguccaaaccgcgcccggcacauuuaaaaccccggaaggggaggugggagcuaucgcccuggauuucaagccuggcacaagcgggucucccauuguuaaccgggaaggaaaaaucgugggccuuuacggcaauggggucgugaccacauccggaacguauguuagcgccaucgcucaggccaaggcgucccaggagggcccucugcccgagauugaagacgagguguuuagaaaacgcaaccugaccaucauggaucuccaucccgggucuggaaagacacggagauaccugccugcuauuguccgcgaagccaucaagcggaaacuuagaacccugauucucgccccgacccgcgugguugcuagcgagauggccgaagcucugaagggcaugcccauccgguaucaaacaacggccgugaaauccgagcacaccgggaaggagaucgucgaccugaugugccaugcgacauucaccaugagacuccuuagcccugugcgcgugcccaauuacaacaugauuaucauggaugaagcccacuuuacagacccuucuuccauugcugcccggggcuauaucagcaccagagucggaaugggcgaggcugccgccauuuucaugacggcuacacccccugggucuguugaagcguuuccgcagagcaaugccgugauccaggaugaggaacgggacauccccgagcgcuccuggaacucuggauacgaguggauuaccgauuucccuggcaaaaccgugugguuuguccccagcaucaaguccgggaaugacauugcuaacugucugagaaagaauggaaaacgggugauccagcugucucgcaagacauucgauaccgaauaucagaagacaaagaacaacgacugggacuacguugugaccacggauauuagcgagaugggcgccaauuuuagagccgaccgggucaucgauccuagacgcugccucaaacccgugauucugaaggacgggccggaacggguuauccuugcuggcccuaugcccgugacagucgccuccgcggcucagagacgcggacggaucggcagaaaccauaauaaggagggggaucaguacauuuauaugggacagccccugaacaaugacgaggaucacgcccacuggaccgaagccaaaaugcuccuggacaacaucaauacaccugagggcauuauccccgcucuguucgaaccugagcgcgaaaagagcgccgcgauugauggggaguaccggcucagaggagaggcccgcaaaaccuucguggaacuuaugagacggggcgaccugccggucuggcugucuuauaagguggcuuccgagggguuucaauacagcgaucgcagauggugcuucgacggcgaacggaacaaucagguucucgaggaaaacauggauguggagaucuggacgaaagagggagaacgcaagaaacugagaccccgguggcuugacgccagaaccuauuccgacccucuggcucuccgcgaguuuaaggaguucgccgcuggccggagaucugugagcggggaucugauccuggagauuggaaagcucccccagcaucuuacacagcgcgcccaaaaugcgcuggacaaccuggucaugcuccacaauuccgaacagggcgggcgggccuacagacaugcuauggaggagcugccugauaccaucgaaacacuuaugcugcucgcccugauugcuguucugaccggaggcgugacacucuuuuuccuuucuggccgggggcugggaaaaaccagcaucggccugcucugugugauggccuccagcguccugcuuuggauggccucuguggagccccacuggauugcugcguccaucauccuggaauuuuuccucaugguucugcugauuccggagccugaccgccagagaacgccccaggauaaccaacucgccuauguggucaucgggcuucuguuuaugauucugacaguggcugccaaugagaugggacuccuggaaaccaccaagaaagaccuuggcaucgggcacgucgccguggagaaccaucaccaugcuacaaugcuggauguugaccuccacccugccagcgcguggacccuguacgccguggcuacaacgauuaucacccccaugaugcggcauacaauugaaaacaccacagccaauaucucucugaccgcuaucgccaaccaggcggccauucucaugggacuugauaagggcuggccuaucuccaaaauggacauuggcgucccccugcuggcucucgggugcuacagccaggugaauccgcugacgcuuaccgccgcuguucugaugcucguggcccacuaugcuaucauuggaccuggccugcaagccaaggcgacacgcgaggcccagaagagaaccgcugccgggaucaugaaaaaccccacagucgauggaaucguggcuauugaccuggaucccgugguuuacgacgccaaguucgaaaaacagcucggccagaucaugcuucugauucuguguaccucucaaauccuccugaugcggacgacaugggcccuuugcgagagcauuacccuggcgacagggccucucaccacccugugggagggauccccgggcaaguuuuggaauacaacgaucgcugucucuauggccaacaucuuccgcggcagcuaucuggcuggggccggacucgccuuuucccuuaugaaaagccugggcgggggaagacggggcaccggggcucagggagaaacacugggcgagaaguggaagcgccagcucaaucagcuguccaaaucugaguucaacauuuacaagagaagcggcaucauggagguggaccgguccgaagccaaagaggggcuuaagagaggagagaccacacgccacgcggugucucggggcaccgccaaacugagaugguucgucgaacgcaaucucguuaagcccgaggggaaggugauugaucugggauguggcagagggggauggagcuauuacugcgcuggccugaaaaaggugacggaagucaaaggcuauacaaaagggggaccuggcauggaggaacccaucccuauggccaccaacggguggaaucucgugaaacuucauuccggaaaggacgucuuuuucacacccccugagaaaugugauacacugcugugcgacauuggcgagucuagcccgaaccccaccaucgaagaggggagaacacuccgcgugcugaagauggucgaaccuuggcuucggggaaaucaauuuuguauuaagauccugaaccccuacaugccuuccgugguugagacgcucgagcagaugcagagaaaacacggcggcaugcuggugcgcaauccccugagccggaacucuacccaugaaauguacugggucuccugcgggacaggaaauaucgugagcgcugugaacaugaccucuagaaugcuccugaaccgcuucacaauggcccaccggaagccgaccuaugagagagaugucgaccuuggcgcggggacgcgccacguugccguggaaccugagguggcuaaucuggauauuaucggacagagaauugaaaacaucaaacaugagcacaaguccaccuggcauuacgacgaggauaaucccuauaaaacaugggccuaccacggcagcuaugaagucaagcccucuggguccgcuagcuccauggugaacggaguugugaagcuccugaccaaaccuugggacgucauucccauggugacacaaaucgccaugaccgauacaaccccuuuuggccagcagcggguuuucaaggagaaaguggacacgcgcacaccgaaggcuaaaagaggcaccgcccaaaucauggaagucaccgcgcgguggcuuuggggguuucugagcagaaauaagaagccccggauuuguacacgcgaggaguucacgagaaaagugcggucuaacgccgcuaucggagccguuuuuguggacgagaaucaguggaacagcgcuaaggaggccgucgaagaugagcgcuucugggaccucgugcagaaagaaagagagcugcauaagcagggcaaaugcgcgaccugcgucuacaauaugauggggaagcgggaaaagaaacugggagaguuuggcaaggcgaaagggucccgcgcuauuugguauauguggcucggcgccagauuccuggaguuugaagcccuuggauucaugaacgaggaucacugguucucucgggaaaauagccuguccggcguggagggggagggacuccacaagcugggcuacauccuucgcgacauuucuaaaaucccugggggaaacauguacgcugaugacacagccggcugggauaccagaaucacagaagacgaucugcaaaaugaggcuaagauuaccgacaucauggaacccgagcaugcccuccuggcgacaagcauuuuuaaacugaccuaucagaacaagguugugcggguccagcgcccugccaagaaugggacggugauggaugugaucuccagacgggaccagcgcggcucuggacaaguuggcaccuacgggcucaacacauucaccaacauggaagcucagcugauuagacagauggagagcgagggaaucuuucuucccuccgaacuggagacaccgaaucucgccgaacgggugcuggauuggcuugagaaacacggcgucgaaagacugaagcgcauggcuaucagcggggacgacugugugguuaaaccuauugaugaccgguucgccaccgcgcucacggcccugaacgauaugggaaaggugagaaaagacaucccccagugggagccuucuaagggcuggaaugauuggcaacagguccccuuuugcucccaucacuuccaccagcugauuaugaaggacgggcgcgagaucguggucccuugucggaaccaggaugaacucgugggcagagcucgcguuagccaaggagccggcuggucucugcgggagacagcuugccuugggaaauccuaugcccagauguggcagcugauguacuuucauagacgcgaccuccggcuggcugccaaugcgauuuguagcgccgugcccgucgauugggugccgaccuccagaacaaccuggucuauccacgcucaucaccaauggaugacgaccgaagacaugcuuagcguuuggaaccgcguguggauugaggaaaauccuuggauggaggauaagacacaugucuccagcuggggagacgugcccuaucugggcaaacgggaggaccaguggugcgggucucucaucggacugaccgccagagccacaugggcuuccaacauccagguggccauuaaucagguucggagacugaucggcaacgaaaauuaccucgauuauaugaccagcaugaagcgcuucaaaaacgagggggaccccgaaggcgcgcugugguga

SEQ ID NO: 18882 - RNA, 9879 nt, Artificial Sequence
  derived and/or modified CDS sequence (opt5) from DENV-1__FJ024457__SS-prME
agcgugaccaugcugcucaugcugaugcccacagcccuugcuuuccaccugacgaccagaggcggggaaccucauaugaucgucuccaagcaggaacgggggaaaucucuccuguuuaagacaagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccagacggccggaccuuggcaucucggcaaacuggagcuugauuuugaccugugcgaagggaccacagugguuguggaugagcacugcggaaaccggggccccagccucagaaccacaaccgucacgggcaagaucauccacgaaugguguugccgguccuguacacugccuccccugcgcuucagaggggaggacggaugcugguauggcauggagauucggccggugaaagaaaaggaggaaaaucuuguuaagagcauggugucugcgggguccggagaggucgacagcuuuucccucggccugcuguguaucucuauuaugaucgaagaggugaugagaagccgcuggucccggaaaaugcucaugaccgggacacuggcuguuuucuuucuucugauuaugggacagcucaccuggaacgaucugaucagacugugcauuauggugggcgccaaugccucugaccgcaugggcauggggaccacauaccuugcucugauggccacguucaagaugagaccuauguuugcggucggacuccuguuccggcgccucaccagcagagaggugcugcuucugacaaucggccucucccugguggcuucugucgaacugcccaacagccuugaggaacugggggauggacucgccaugggcaucaugauucugaaacuccugaccgacuuucaaucccaucagcuuugggccacacugcucagccugaccuucaucaagacgacauuuucucugcacuaugcuuggaaaaccauggccaugguucuuuccauugugagccuguucccccucugucugucuaccacaucccagaagaccacauggcucccugugcugcuugggagccugggaugcaagccgcugacgauguuucucaucgcugagaauaaaauuuggggccggcgcucuuggccccugaacgaaggcaucauggccgucgggaucguguccauucuucugagcucccuccugaagaacgauguuccucucgcgggaccccugaucgccggcgggaugcuuauugcuuguuacgugaucagcggaucuagcgccgaccugucccuggagaaagcugccgaggucucuugggaagaggaagccgagcauagcggcgcuucccacaauauucucguggaaguucaggaugacgggaccaugaagaucaaagaugaggagagagacgauacacugaccauccuucugaaggcgacacuccuggccgugucuggagucuauccucucagcauucccgcuacccuguucgugugguacuucuggcagaagaagaagcagcgguccggcguccuuugggacacgccuucucccccggaaguggagcgcgccguucuggaugacggcaucuauagaauuaugcagcgggggcugcucggacgcagccaggugggcgucgggguguuucaagaaaacguuuuccauaccauguggcacgugacaagaggagccguccugauguaccagggcaaacggcuugagccuuccugggcuagcgugaagaaagaccugaucucuuacgggggaggcuggagacuccagggcuccuggaauaccggggaggaagugcagguuauugccgucgagcccggaaagaacccuaaaaaugugcaaacagcgcccggcaccuuuaagacaccggaaggggaggugggagcuaucgcccuggauuucaagccuggcacgagcgggucucccauugucaaccgcgaaggaaaaaucgugggccucuauggcaaugggguugugaccacauccggaaccuacgucagcgccaucgcucaggccaaggcgucccaggagggcccucugcccgagauugaagacgagguguuucggaaaagaaaccuuaccaucauggaucugcaccccgggucuggaaagacacgccgguaucugccugcuauuguuagagaagccaucaaacgcaagcuccggacgcugauucuugccccgaccagaguggucgcuagcgagauggccgaagcucugaagggcaugcccauccgcuaccaaacaaccgccgugaaauccgagcauacagggaaggagaucguugaccucaugugccacgcgaccuucacgaugcggcugcugagcccugugagaguccccaauuauaacaugauuaucauggaugaagcccauuuuacagacccuucuuccauugcugcccggggcuacaucagcacccgcgugggaaugggcgaggcugccgccauuuucaugaccgcuacacccccugggucuguggaagcguuuccgcagagcaaugccgucauccaggaugaggaaagagacauccccgagcgguccuggaacucuggauaugaguggauuaccgauuucccuggcaaaacaguuugguuugugcccagcaucaaguccgggaaugacauugcuaacugucuccgcaaaaauggaaagagagugauccagcuuucucggaagaccuucgauacggaauaccagaaaaccaagaacaacgacugggacuacgucgugaccacagauauuagcgagaugggcgccaauuucagagccgaccgcguuaucgauccucggagaugccugaaacccgugauucugaaggacgggccggaacgcgucauccucgcuggcccuaugcccgugaccguugccuccgcggcucagcggagaggacgcaucggccggaaccacaauaaagagggggaucaguauauuuacaugggacagccccugaacaaugacgaggaucaugcccacuggacggaagccaagaugcuucuggacaacaucaauaccccugagggcauuauccccgcucucuuugaaccugagagagaaaagagcgccgcgauugauggggaguaucgccugagaggagaggcccggaaaacauucguggaacugaugcgcagaggcgaccucccggucuggcuuucuuacaagguggcuuccgagggguuucaauauagcgaucggcgcuggugcuucgacggcgaaagaaacaaucagguccuggaggaaaacauggauguggagaucuggaccaaagagggagaacggaagaaacugagaccccgcuggcucgacgcccggacauacuccgacccucuggcucuuagagaguuuaaggaguucgccgcuggccgccggucuguuagcggggaucugauccucgagauuggaaaacugccccagcaccugacccagagagcccaaaaugcgcucgacaaccuugugaugcugcauaauuccgaacagggcgggcgggccuaucgccacgcuauggaggagcugccugauacaaucgaaacccucaugcugcuugcccugauugcugugcucacgggaggcgucacacuguuuuuccugucuggcagagggcucggaaagaccagcaucggccuucuguguguuauggccuccagcgugcugcucuggauggccucuguggagccccauuggauugcugcguccaucauccuggaauuuuuccuuaugguccugcucauuccggagccugaccggcagcgcacaccccaggauaaccaacuggccuacgugguuaucgggcugcucuuuaugauucuuacaguggcugccaaugagaugggacugcuggaaaccacaaagaaagaccucggcaucgggcacgucgccguggagaaccaccaucacgcugccaugcuggaugucgaccuucauccugcgagcgccuggacgcuguacgcuguggccaccacaauuaucacccccaugaugagacacacaauugaaaacaccacggcuaauaucucucucaccgccaucgcgaaccaggccgcuauucugaugggacuggauaagggcuggccuaucuccaaaauggacauuggcguuccccuccuugcccuggggugcuauagccaggugaauccgcugacacucaccgcugccguccugaugcuuguggcucauuacgccaucauuggaccuggccugcaagcgaaggccacacgggaggcucagaaacgcaccgccgcugggaucaugaagaaccccacgguugauggaaucguggccauugaccucgaucccgucguguaugacgccaaguucgaaaaacagcugggccagaucaugcugcucauucuuuguacaucucaaauccugcugaugagaaccacaugggcgcucugcgagagcauuacccuggcuaccgggccucuuacaacgcugugggagggauccccgggcaaguuuuggaauaccacaaucgccgugucuauggcuaacaucuuccggggcagcuaccucgccggggccggacuggcuuucucccugaugaaaagccucggcgggggacgcagaggcaccggggcccagggagaaacacuuggcgagaaguggaaacggcagcugaaucagcuguccaagucugaauuuaacaccuauaagagaagcggcauuauggagguugaccgcuccgaagcgaaagaggggcucaagcggggagagacgacaaaacacgccgucucuagaggcaccgcuaagcugcgcugguucguggaacggaaucuugugaaacccgaggggaaggucaucgaucugggauguggcagagggggauggagcuacuauugcgccggccucaagaaaguuaccgaagugaagggcuacacaaaagggggaccuggccacgaggaacccauuccuauggcuaccuacggguggaaccuggugaagcugcauuccggaaaagacgucuuuuucauucccccugagaagugugauacacuccuuugcgacauuggcgagucuagcccgaaucccacgaucgaagaggggcgcacccugcgggugcugaaaaugguugaaccuuggcucagaggaaaccaauuuuguauuaagauccugaaucccuauaugccuuccguggucgagacacuugagcagaugcagcgcaagcacggcggcaugcuggugcggaacccccucagcagaaauucuacccaugaaauguacuggguuuccugcgggacaggaaacaucgugagcgccgucaauaugaccucucgcaugcugcugaaccgguucacgauggcgcacagaaaaccgaccuaugagcgcgauguggaccucggcgccgggacaagacacguggcugucgaaccugagguugccaaccuggauauuaucggacagcggauugaaaauaucaagcaugagcacaaauccaccuggcauuacgacgaggauaaccccuauaagacaugggcuuaccacggcagcuaugaagugaaacccucuggguccgccagcuccauggugaauggagucgugaaacuucugaccaagccuugggacguuauucccauggugacacaaaucgcuaugaccgauacgacaccuuuuggccagcagcgcgucuucaaagagaagguggacaccagaaccccgaaagccaagcggggcacagcgcaaaucauggaaguuacggccaaauggcucuggggguuucugagcagaaacaagaagccccggauuuguacccgcgaggaguucacaagaaaagugcggucuaaugcugccaucggagcugucuuuguggacgagaaccaguggaauagcgccaaggaggccguugaagaugagcgcuucugggaccuugugcauagagaacgggagcugcacaaacagggcaagugcgcgaccugcgucuacaacaugauggggaaacgcgaaaagaagcucggagaguuuggcaaagcuaagggguccagagccauuugguacauguggcugggcgcccgguuccuggaguucgaagcucucggauuuaugaaugaggaucacugguucucucgcgaaaacagccuguccggcguggagggggagggacuucauaaacugggcuauauccucagagacauuucuaagaucccugggggaaauauguacgccgaugacacagcuggcugggauacccggaucacagaagacgaucugcagaacgaggcccgcauuaccgacaucauggaacccgagcacgcgcuucuggccagaagcauuuuuaaacucacguaucaaaauaaggucgugcggguucagcgcccugcuaaaaacgggaccgugauggaugucaucuccagacgggaccagagaggcucuggacaggugggcacauacgggcugaauaccuucacaaacauggaagcccaacugauucgccagauggagagcgagggaaucuuuucccccagcgaacucgagaccccgauccuggcugaacgggugcuugauuggcuggagaaguauggcguugaaagacucaagcgcauggccauuucuggggacgacuguguggucaaaccuaucgaugaccgguucgcgacggcccugacagcucuuaacgauaugggaaaggugagaaaagacauuccccagugggagccuuccaagggcuggaaugauuggcagcaaguucccuuuugcagccaucacuuccaccagcugaucaugaaagacgggcgcgagauuguggucccuugucggaaccaggaugaacucgugggcagagcccgcgucucucagggagcuggcuggucccugcgggagaccgccugccugggaaagagcuacgcucaaauguggcagcucauguauuuucauagacgcgaccugcggcuugccgcgaaugccaucuguuccgcugugcccguugauuggauuccgacaucuagaaccacguggagcauccacgcccaucaccaguggaugaccacagaagacaugcuguccguguggaaccgggucuggaucgaggaaaauccuuggauggaggauaagacccauauuagcucuuggggagacgugcccuaccucggcaaaagagaggaccaauggugcgggucccugaucggacuuacagcccgcgcuaccugggccacaaacauucagguugcgaucaaucaggugcggagacugauuggcaacgaaaauuaccucgauuauaugaccagcaugaagcgcuucaaaaacgagucugaccccgaaggggcucugugguga

SEQ ID NO: 18883 - RNA, 9879 nt, Artificial Sequence
  derived and/or modified CDS sequence (opt5) from DENV-1__FJ205881__SS-prME
agcgugaccaugcugcuucugcuuaugcccacagcccuggcuuuccaccugacgaccagaggcggggaaccucauaugaucguguccaagcaggaacgggggaaaucucugcuuuuuaagaccagcgccggcguuaacaugugcacccugaucgcgauggaccucggggaacugugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguggcccuggccccucauguggggcucggacuggagaccagaacggaaacauggaugagcuccgagggcgcuuggaaacagauucagcggguugaaaccugggcccuucgccaccccggcuucacagugaucgcucuguuucucgcccaugcgauugggaccucuaucacccagaagggaaucauuuucauccugcuuaugcuggucacaccuagcauggccaugagaugcgugggcauugggucccgggauuuuguugagggacucagcggcgcuacguggguggacgucgugcuggagcacgggucuugugugaccacaauggccaaggauaaacccacccuggacaucgaacuccugaagacagaggucaccaacccugcuguucuucgcaaacugugcauugaagccaagaucuccaauacgacaaccgauagcagauguccgacccaaggagaggcgacacucguggaagaacaagacgccaacuucgugugccggcgcaccuuugucgauagaggcuggggcaauggguguggacuguucggcaaagggucucuuauuacaugcgcuaaguuuaagugcgugacgaaacuggagggaaagaucguucaguacgaaaaccucaaauauuccgugaucgucaccgugcacacaggcgaccagcaucaaguugggaaugagagcaccgaacacggaacaaccgccacgauuacaccccaagcuccuaccaccgagauccagcugacagacuacggcgcccugacccucgauuguucuccccggacgggccuggacuucaacgaaauggugcuucugacaaugaaggagaaauccuggcucguccauaagcagugguuucuggaucuuccucugcccuggaccagcggggccuccacaucucaagagaccuggaaucgccaggaccuccuggugaccuucaaaacagcucacgcgaagaagcaggaagucgugguucugggaagccaagagggcgccaugcacacggcucucaccggggccacagaaauucagaccuccggaacaaccacgaucuuugccggccaucugaaaugcagacuuaagauggauaaacugacacucaaggggaugagcuaugugauguguaccggcucuuucaaacuggagaaggaacuggcugagacccagcacggaacaguccuugugcagauuaaguacgagggcaccgacgccccgugcaaaaucccuuucuccacacaagaugaaaaggggguuacgcagaacggacggcucaucaccgcgaaucccauugugacagacaaagagaagccugucaacaucgaagcugagccgcccuuuggcgagagcuauauugugaucggggccggagaaaaagcccugaagcugucuugguucaagaaaggcagcuccauugggaagauguuugaggcuaccgccagaggcgcucgccggauggccauccucggagauacagcgugggacuucggcucuaucgggggaguguuuaccagcguuggcaaacugguccaucagauuuucgggacggccuacggagugcucuuuuccggcgugagcuggaccaugaagaucgggauuggcguccugcucacauggcugggacucaauucuagauccaccagccuuucuaugacauguaucgcugugggccucguuacccuguaccugggggugaugguccaggccgauuccggaugcgugauuaacuggaaaggccgcgaacucaagugugggagcggaaucuucguuacaaaugaggugcacaccuggacggaacaauauaaguuucaggcugacuccccuaaacggcugucugccgcgauuggcaaggccugggaggagggggucugcggcaucagaagcgcuacacgccuugaaaacaucauguggaaacagauuuccaacgagcugaaucauauccuccuggaaaacgacaugaaguucaccgugguugugggagaugucgccggcauucuggcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggagguggaggacuacggauucggcauuuuuacgacaaacaucuggcuuaagcuccgcgauuccuauacccaggucugcgaccaccggcugaugagcgcggccauuaaagauucuaaggcuguucacgccgacaugggcuacuggaucgaauccgagaaaaaugaaacauggaagcuggccagagcuagcuucaucgaggugaagaccuguauuuggcccaaaucucauacacucugguccaacggggugcuggaaagcgagaugaucauuccgaagaucuauggaggcccuauuucucaacacaauuaccgccccggguacuucacccagacggccggaccuuggcaucuuggcaaacuggagcucgauuuugaccugugcgaagggaccacagucgugguugaugagcacugcggaaaccggggccccagccugagaaccacaaccgugacgggcaagaucauccacgaaugguguugccgguccuguacacuuccuccccuccgcuucagaggggaggacggaugcugguauggcauggagauucggccggucaaagaaaaggaggaaaaucuggucaagagcaugguuucugcgggguccggagagguggacagcuuuucccugggccuccuguguaucucuauuaugaucgaagaggucaugagaagccgcuggucccggaaaaugcuuaugaccgggacacuggcuguguucuuucuccugauuaugggacagcugaccuggaacgaucuuaucagacugugcauuaugguuggcgccaaugccucugaccgcaugggcauggggaccacauaccucgcucugauggccacguucaagaugagaccuauguuugcggugggacuccuguuccggcgccuuaccagcagagagguccugcuccugacaaucggccugucccuuguggcuucuguggaacugcccaacagccucgaggaacugggggauggacucgccaugggcaucaugauucugaaacuucugaccgacuuucaaucccaucagcucugggccacacugcugagccuuaccuucaucaagacgacauuuucucugcacuaugcuuggaaaaccauggccaugguccucuccauuguuagccuguucccccucugucugucuaccacaucccagaagaccacauggcuuccugugcugcuggggagccucggaugcaagccgcugacgauguuucuuaucgcugagaauaaaauuuggggccggcgcucuuggccccugaacgaaggcaucauggccguggggaucgucuccauucuccugagcucccuccugaagaacgaugugccucuugcgggaccccugaucgccggcgggaugcugauugcuuguuacguuaucagcggaucuagcgccgaccucucccuggagaaagcugccgaggugucuugggaagaggaagccgagcauagcggcgcuucccacaauauucuugucgaagugcaggaugacgggaccaugaagaucaaagaugaggagagagacgauacacugaccauccuccugaaggcgacacuccuggccguuucuggaguguauccucuuagcauucccgcuacccuguucgucugguacuucuggcagaagaagaagcagcgguccggcgugcugugggacacgccuucucccccggaagucgagcgcgccgugcucgaugacggcaucuauagaauuaugcagcgggggcugcuuggacgcagccagguuggcgugggggucuuucaagaaaacguguuccauaccauguggcacguuacaagaggagccgugcugauguaccagggcaaacggcucgagccuuccugggcuagcgucaagaaagaccugaucucuuacgggggaggcuggagacuccagggcuccuggaauaccggggaggaaguccaggugauugccguugagcccggaaagaacccuaaaaauguccaaacagcgcccggcaccuuuaagacaccggaaggggaggugggagcuaucgcccuggauuucaagccuggcacgagcgggucucccauugugaaccgcgaaggaaaaaucgucggccuuuauggcaauggggugguuaccacauccggaaccuacgugagcgccaucgcucaggccaagaccucccaggagggcccucugcccgagauugaagacgaggucuuucggaaaagaaaccugacaaucauggaucuccaccccgggucuggaaagacgcgccgguaucugccugcgauugugagagaagcuaucaaacgcaaacuucggacccugauucucgccccgacaagaguuguggccagcgagauggcugaagcccugaagggcaugcccauccgcuaccaaaccacagcugucaaauccgagcauaccgggaaggagaucguggaccugaugugccacgccacguucacaaugcggcuccuuagcccuguuagagugcccaauuauaacaugauuaucauggaugaagcgcauuuuaccgacccuucuuccauugccgcucggggcuacaucagcacccgcgucggaaugggcgaggccgcugccauuuucaugacagccacacccccugggucuguggaggcuuuuccgcagagcaaugcggugauccaggaugaggaaagagacauccccgagcgguccuggaacucuggauaugaguggauuacagauuucccuggcaaaaccgucugguuuguucccagcaucaaguccgggaaugacauugccaacugucugcgcaaaaauggaaagagagugauccagcugucucggaagacguucgauacagaauaccagaagaccaagaacaacgacugggacuacguggucacaaccgauauuagcgagaugggcgcuaauuucagagccgaccgcgugaucgauccucggagaugccucaaacccguuauucugaaggacgggccggaacgcgugauccuugccggcccuaugcccgucacgguggcuuccgccgcgcagcggagaggacgcaucggccggaaccacaauaaagagggggaucaguauauuuacaugggacagccccugaacaaugacgaggaucaugcucacuggaccgaagccaagaugcuccuggacaacaucaauacaccugagggcauuauccccgcccuguuugaaccugagagagaaaagagcgcugccauugauggggaguaucgccucagaggagaggcgcggaaaaccuucguugaacuuaugcgcagaggcgaccugccgguguggcugucuuacaaggucgccuccgagggguuucaauauagcgaucggcgcuggugcuucgacggcgaaagaaacaaucaggugcucgaggaaaacauggaugucgagaucuggacaaaagagggagaacggaagaaacugagaccccgcuggcuugacgcucggaccuacuccgacccucuggcccucagagaguuuaaggaguucgcugccggccgccggucugugagcggggaucugauccuggagauuggaaaacucccccagcaccuuacacagagagcucaaaaugcccuggacaaccugguuaugcuccauaauuccgaacagggcgggcgggcguaucgccacgccauggaggagcugccugauaccaucgaaacgcuuaugcugcucgcucugauugccgugcugacaggaggcgugacccucuuuuuccuuucuggcagagggcugggaaagaccagcaucggccugcucugugucauggcuuccagcguucugcuuuggauggccucuguggagccccauuggauugccgcuuccaucauccuggaauuuuuccucauggugcugcugauuccggagccugaccggcagcgcacaccccaggauaaccaacucgcguacgucgugaucgggcuucuguuuaugauucugaccguugccgcuaaugagaugggacuccuggaaacaacgaagaaagaccuuggcaucgggcacguggccgucgagaaccaccaucacgccgcuaugcuggauguggaccuccauccugccagcgcguggacccuguacgccgucgcuacaaccauuaucacacccaugaugagacacaccauugaaaacacgaccgccaauaucucucugacagcuaucgccaaccaggcggccauucucaugggacuugauaagggcuggccuaucuccaaaauggacauuggcgugccccugcuggcucucgggugcuauagccagguuaauccgcugacccuuacagccgcugugcugaugcucgucgcccauuacgcuaucauuggaccuggccugcaagccaaggcgacccgggaggcccagaaacgcacggcugccgggaucaugaagaaccccacaguggauggaaucguugcuauugaccuggaucccguggucuaugacgccaaguucgaaaaacagcucggccagaucaugcuucugauucuguguaccucucaaauccuccugaugagaacaaccugggcccuuugcgagagcauuacccuggcgacagggccucucacgacccugugggagggauccccgggcaaguuuuggaauacaaccaucgcugugucuauggccaacaucuuccggggcagcuaccuggcuggggccggacucgccuucucccuuaugaaaagccugggcgggggacgcagaggcacaggggcucagggagaaacccugggcgagaaguggaaacggcagcucaaucagcuguccaagucugaauuuaacacguauaagagaagcggcauuauggagguggaccgcuccgaagccaaagaggggcuuaagcggggagagacaaccaaacacgcgguuucuagaggcaccgccaagcugcgcugguucgucgaacggaaucucgugaaacccgaggggaaggugaucgaucugggauguggcagagggggauggagcuacuauugcgcuggccugaagaaagucacagaaguuaagggcuacaccaaagggggaccuggccacgaggaacccauuccuauggccacauacggguggaaccucgugaaacuucauuccggaaaagacguguuuuucauucccccugagaagugugauacgcugcugugcgacauuggcgagucuagcccgaaucccaccaucgaagaggggcgcacacuccggguccugaaaaugguggaaccuuggcuuagaggaaaccaauuuuguauuaagauccugaaucccuauaugccuuccguuguggagacccucgagcagaugcagcgcaagcacggcggcaugcugguccggaacccccugagcagaaauucuacacaugaaauguacuggguguccugcgggaccggaaacaucguuagcgcugugaauaugacgucucgcaugcuccugaaccgguucaccauggcccacagaaaaccgacauaugagcgcgaugucgaccuuggcgcggggaccagacacguggccguggaaccugaggucgcuaaccuggauauuaucggacagcggauugaaaauaucaagcaugagcacaaauccacauggcauuacgacgaggauaaccccuauaagaccugggccuaccacggcagcuaugaaguuaaacccucuggguccgcuagcuccauggugaauggaguggucaagcuccugacaaagccuugggacgugauucccaugguuacccaaaucgccaugacggauacaaccccuuuuggccagcagcgcguguucaaagagaaggucgacaccagaacaccgaaagcuaagcggggcacggcccaaaucauggaagugaccgcgaaauggcuuuggggguuucugagcagaaacaagaagccccggauuuguacacgcgaggaguucaccagaaaaguucggucuaaugccgcuaucggagccguguuugucgacgagaaccaguggaauagcgcuaaggaggccguggaagaugagcgcuucugggaccucguucauagagaacgggagcugcacaaacagggcaagugcgccacaugcguguacaacaugauggggaaacgcgaaaagaagcugggagaguuuggcaaagcgaagggguccagagcuauuugguacauguggcucggcgcccgguuccuggaguucgaagcccuuggauuuaugaaugaggaucacugguucucucgcgaaaacagccuguccggcgucgagggggagggacuccauaaacugggcuauauccuuagagacauuucuaagaucccugggggaaauauguacgcugaugacaccgccggcugggauacacggaucaccgaagacgaucugcagaacgaggcucgcauuacggacaucauggaacccgagcacgcccuccuggcgaaaagcauuuuuaagcugaccuaucaaaauaaaguggucagagugcagcggccugccaagaacgggacaguuauggaugugaucucccgcagagaccagcggggcucuggacaggucggcaccuacgggcucaauacauucaccaacauggaagcucaacugauuagacagauggagagcgagggaaucuuuucccccagcgaacuugagacgccgaaccuggccgaacgcgugcucgauuggcuggagaaguauggcguggaacggcuuaaaagaauggcuaucucuggggacgacuguguugugaagccuauugaugaccgcuucgccacagcgcugaccgcccucaaugauaugggaaaaguccggaaggacaucccccagugggagccuuccaaaggcuggaacgauuggcagcaagugcccuuuugcagccaucacuuccaccagcugauuaugaaggacgggagagagaucguugugccuugucgcaaucaggaugaacuggucggccgggcuagagugucucagggagccggcuggucccuccgcgagacagcuugccugggaaagagcuacgcccaaauguggcagcuuauguauuuucaucggagagaccugcgccucgcugccaacgcgauuuguuccgccguccccguggauuggaucccgaccucucggacgaccuggagcauucacgcucaucaccaguggaugacaaccgaagacaugcuguccguuuggaauagaguguggaucgaggaaaacccuuggauggaggauaaaacacauaucagcucuuggggagacguccccuaccuuggcaagcgggaggaccaauggugcgggucccugauuggacucaccgccagagccacaugggcuaccaauauccagguggccauuaaccagguucgccggcugaucggcaaugaaaacuaccuggauuauaugacgagcaugaaaagauucaagaaugagucugaccccgaaggggcgcucugguga

SEQ ID NO: 18884 - RNA, 9879 nt, Artificial Sequence
  derived and/or modified CDS sequence (opt5) from DENV-1__FJ205882__SS-prME
agcgugaccaugcugcucaugcugaugcccacagcccuugcuuuccaccugacgaccagaggcggggagccucauaugaucgucuccaagcaggaacggggaaaaucucuccuguuuaagacaagcgccggcguuaacaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagagcaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuucuaccgagauccagcucacagacuacggcgcccugacccuggauuguuccccccggacaggccucgacuucaacgaaauggugcugcuuaccaugaaggagaaaagcuggcugguccauaagcagugguuucucgaucugccucuucccuggacguccggggcuucuacaagccaagagaccuggaaucgccaggaccugcucgugacauucaaaaccgcgcacgccaagaagcaggaagucgugguucugggaucccaagagggcgcuaugcacaccgcccugacaggggccacggaaauucagaccagcggaacaaccacaaucuuugcuggccaucucaaaugcagacugaagauggauaaacuuacccugaaggggaugucuuaugugauguguacgggcuccuucaaacucgagaaggaagucgccgagacacagcacggaaccgugcugguucagauuaaguacgagggcaccgacgcgccgugcaaaaucccuuucagcacacaagaugaaaagggggugacccagaacggacggcugaucacagcuaaucccauugucacggacaaagagaagccugugaacaucgaagccgagccccccuuuggcgagucuuauauugugaucggggccggagaaaaagcucuuaagcucagcugguucaagaaaggcuccucuauugggaagauguuugaggccaccgcuagaggcgcccgccggauggcgauccugggagauacagccugggacuucggcagcaucgggggaguuuuuaccuccgucggcaaacuggugcaucagauuuucgggacagcuuacggagugcucuuuagcggcgucucuuggaccaugaagaucgggauuggcgugcugcuuacguggcugggacucaauuccagaagcaccucucuguccaugacauguaucgccguuggccuggugacccuuuaccucggggucauggugcaggcugauagcggaugcguuauuaacuggaaaggccgcgaacugaaguguggguccggaaucuucgugacaaaugagguccacaccuggacagaacaauauaaguuucaggccgacucuccuaaacggcugagcgcggccauuggcaaggcuugggacgagggggugugcggcaucagauccgccacccgccucgagaacaucauguggaaacagauuucuaacgaacugaaucauauccuucuggagaacgauaugaaguucacgguuguggucggagacguggcuggcauucucgcccaggggaaaaagaugauccggccgcaacccauggaauacaaauauagcuggaaguccuggggaaaggccaaaauuaucggcgcugaugugcagaauacaaccuuuaucauugacgggccuaacacccccgaguguccugaugaccagagagcguggaauaucuggaaggucgaagaucacggauucggcauuuuucccacaaacaucuggcugaaacugcgcgacagcuacacccagguuugcgaucaccggcuuaugucugccgcuauuaaggacuccaaagccgugcaugccgauaugggcuauuggaucgagagcgagaagaaugaaacguggaagcucgcuagagccucuuucaucgaggugaaaacauguauuuggccgaagucccacacccuguggagcaacgggguccuggaaucugagaugaucauuccuaaaaucuacggaggccccauuagccaacauaauuaucgcccuggguacuucacacagaccgcgggacccuggcaccucggcaagcuggaacuugacuuuaaccugugcgaggggacaaccgugguuguggaugagcacugcggaaaucggggcccuucccucagaacgaccacagucaccggcaaaaucauccaugaaugguguugccggagcuguacacugcccccgcugcgcuucaagggggaggacggaugcugguacggcauggaaauuagaccugugaaggagaaagaggaaaaccuuguuaagucuaugguguccgcugggagcggagaggucgacuccuuuucucucggccugcuguguaucagcauuaugaucgaagaggugaugcgguccagauggucucgcaaaaugcucaugaccgggacgcuggccguuuucuuucuucugauuaugggacagcucacauggaaugaucugauccggcugugcauuauggugggcgccaacgcuagcgacagaaugggcauggggaccacauaucuugcccugauggcgaccuucaagaugcgccccaugcucgcugucggacugcucuuuagacggcugaccucccgcgaagugcuucugcucacaaucggccugucucugguggccagcgucgagcuucccaauucccuggaggaacucggggauggacuggccaugggcaucaugauucucaaacugcuuacggacuuccaaagccaccagcugugggcuacccuccugucucugacauuuaucaagaccacauacucccuucauuaugccuggaagaccauggcuaugguucugagcauugugucucucuucccucugugucucuccacgacaagccagaaaaccaccuggcugccggugcuucuggggucucugggaugcaagccccucacaauguuucugaucgccgagaacaaaauuuggggcagaaaguccuggccucuuaacgaaggcaucauggcggucgggaucgugagcauucugcucuccagccugcucaaaaaugauguuccccuggccggaccucuuaucgcuggcgggaugcugauugccuguuacgugaucucuggaagcuccgcugaccugucucucgagaaggccgccgaagucagcugggaggaggaagcugagcacuccggcgcgucucauaacauucugguggaaguucaggaugacgggaccaugaaaaucaaggaugaggaacgggacgauacacuuacgauccugcucaaggccacccugcucgcugugagcggagucuauccccuguccauuccugccacacuuuucgugugguacuuuuggcaaaaaaagaaacagcgcucuggcguccugugggacacccccagcccgccugagguggagagagccguucuggaugacggcaucuaucggauuaugcagcgcgggcuccugggaagaucccaggugggcgucgggguguuccaagaaaauguuuuccacacaauguggcacgugacccggggagcuguccuuauguaccagggcaagcgccuggagcccagcugggccucugugaaaaaggaccucaucuccuacgggggaggcuggagacugcagggcagcuggaacacgggggaagaggugcagguuauugcggucgagccuggaaagaaucccaaaaacgugcaaaccgcuccgggcacauuuaagaccucugaaggggaggugggagccaucgcccucgauuucaaaccuggcacauccgggagccccauugucaaucgggaaggaaagaucgugggccuguauggcaacgggguugugaccacauccggaacguacgucucugcuaucgcccaggcgaaagcuagccaggagggcccucuucccgaaauugagaaugagguguuuagaaagcgcaaccugaccaucauggaccugcaucccggguccggaaagacacggagauaucucccugccauuguucgcgaagccaucaaacggaagcugagaacccuuauucuggcuccgacccgcguggucgccagcgagauggcugaagcccucaaaggcaugcccauccgguaccaaacaacggcggugaagucugagcacaccgggaaagaaaucguugaucugaugugccaugccacauucaccaugagacugcucuccccugugcgcguccccaauuauaacaugauuaucauggacgaggcucacuuuacagauccuagcucuauugccgcucggggcuacaucagcaccagagugggaaugggcgaggccgccgcuauuuucaugacggcgacacccccuggguccguggaagccuuuccgcagucuaaugcugucauccaggacgaggaacgggauauccccgagcgcagcuggaacuccggauaugaauggauuaccgacuucccuggcaagaccguuugguuugugcccucuaucaagagcgggaaugauauugccaacugucuuagaaaaaacggaaagcgggugauccagcugucccgcaaaacauucgacaccgaguaccaaaagacaaaaaauaacgauugggacuacgucgugaccacggacauuagcgagaugggcgccaauuuuagagcugaucggguuaucgacccuagacgcugccugaagcccgugauucucaaggaugggccggaacgggucauccuggccggcccuaugcccgugacaguugcgucugcugcccagagacgcggacggaucggcagaaaccauaauaaagagggggaccaguauauuuacaugggacagccccuuaacaaugaugaagaccacgcccacuggaccgaggcuaagaugcugcucgauaacaucaauacaccugagggcauuauccccgcccuguucgaaccugagcgcgaaaaauccgcggccauugacggggaguaucggcugagaggagaagcucgcaagaccuucguggagcucaugagacggggcgaucuuccggucuggcugagcuacaaaguggccuccgagggguuucaauauucugaccgcagauggugcuucgauggcgaacggaacaaucagguccuggaggaaaacauggacguggagaucuggacgaaggaaggagagcgcaaaaagcucagaccccgguggcuggaugcuagaaccuacagcgacccucuugcccugcgcgaguuuaaggaauucgcugccggccggaaauccguuucuggggaccucauccuggagauuggaaagcugccccagcaucucacacagagagcgcaaaaugcccuugauaaccuggugaugcugcacaauagcgaacagggcgggcgcgcuuaucggcaugccauggaggaacucccugacaccaucgagacacugaugcuucuggcucucauugccgugcugaccggaggcgucacacuguuuuuccucuccggcagagggcuuggaaaaaccagcaucggccugcuguguguuauggccucuuccgugcuccuguggauggcuagcguggagccccacuggauugcggccucuaucauccuugaauuuuuccugaugguccuccugauuccggagccugaucggcagcgcacgccccaggacaaccaacuggcuuacgugguuaucgggcuccuuuuuaugauucugacaguggccgccaacgaaaugggacugcucgagaccaccaagaaagaucugggcaucgggcacgucgcuguggagaaucaucaccaugccgcgaugcuugacgucgaucugcacccugccuccgcuuggacacucuacgccguggcuaccacaauuaucacgcccaugaugagacauaccauugaaaacacaaccgccaauaucagccugacagcgaucgccaaccaggcugccauucugaugggacucgacaagggcuggccuaucucuaagauggauauuggcguuccccuucuggcucuggggugcuauagccaggugaauccgcucacccugacggccgcuguccuuaugcugguggcccacuacgcgaucauuggaccuggccuccaagccaaagcuacccgggaggcccagaagcgcacagcugccgggaucaugaaaaaccccaccguugacggaaucguggccauugaucuggaccccgucguguaugaugcgaaguucgaaaaacagcugggccagaucaugcuccuuauucuguguacaucccaaauccugcucaugagaaccacgugggcucugugcgagucuauuacacuugccaccgggccucugacaacccucugggaaggaagcccgggcaaguuuuggaauaccacaaucgcuguguccauggccaacaucuuccggggcagcuaccuggccggggcuggacuggccuuuucccucaugaagucucuuggcgggggacgcagaggcacgggggcgcagggagagacccugggcgagaaauggaagcggcagcugaaucagcucagcaaauccgaauucaacacauauaagcgcucuggcauuauggagguugacagaagcgaagccaaagaggggcugaagcggggagaaaccacaaagcacgcugucuccagaggcaccgccaaacuucgcugguucguggagcggaaucuggugaagcccgaggggaaagucaucgaccucggauguggcagagggggauggucuuacuauugcgcuggccugaagaaaguuacggaagugaagggcuacacaaaagggggaccuggccaugaggaacccauuccuauggccaccuacggguggaaccuggugaagcuccacagcggaaaggaugucuuuuucauccccccugagaaaugugacacccuucugugcgauauuggcgaauccagcccgaaucccacaaucgaggaggggcgcacccugcgggugcucaagaugguugaaccuuggcugagaggaaaccaauuuuguauuaaaauccuuaaucccuauaugccuucuguggucgagacacuggaacagaugcagcgcaagcauggcggcaugcucgugcggaacccccuguccagaaauagcacgcacgagauguacuggguuucuugcgggaccggaaacaucguguccgcggucaacaugacaagccgcaugcugcucaaucgguucaccauggcccacagaaaaccgacauaugagcgcgacguggaucugggcgcugggacccggcauguggccgucgaaccugagguugcuaaccuugacauuaucggacagagaauugaaaauaucaagcacgagcauaagucuacguggcacuacgaugaagacaaccccuauaaaaccugggccuaccauggcuccuaugaggugaagcccagcggguccgcuagcucuauggugaauggagucgugaaacugcucacaaagccuugggauguuauucccauggugacccaaaucgccaugacagacaccacaccuuuuggccagcagcgcgucuucaaagagaagguggauaccagaacgccgaaggcgaaacggggcacagcccaaaucauggaaguuaccgcuaaguggcuguggggguuucuuagccgcaacaaaaagcccagaauuuguacccgggaggaauucacaagaaaagugcgguccaaugccgcuaucggagccgucuuuguggacgagaaccaguggaauucugccaaggaagcgguugaggacgagcgcuucugggaucuggugcacagagaacgggagcuccacaagcagggcaaaugcgcuacgugcgucuacaacaugauggggaagcgcgaaaaaaagcugggagaguuuggcaaagccaaggggagcagagccauuugguacauguggcugggcgcucgguuccucgaauuugaggcccugggauucaugaaugaggaccauugguucucccgcgaaaacucucuuagcggcguggagggggaaggacugcacaaacucggcuauauccugagagauauuuccaagaucccugggggaaauauguacgcugacgauaccgccggcugggacacacggaucaccgaggaugaccuucagaacgaggcgaagauuacagauaucauggaacccgagcaugcccugcucgcuaaaucuauuuuuaagcugaccuaucaaaauaaagucgugcgcguucagagaccugccaagaacgggacagugauggacgucaucagccggcgcgaucagagaggcuccggacaggugggcaccuacgggcugaacacguucaccaauauggaagcucaacucauucggcagauggagagcgaaggaaucuuuucucccuccgagcuggagacaccgaaccuugccggccgcgugcuggacuggcucgaaaaacacgggguugagagacugaagcggauggcgaucagcggagaugacuguguggucaagccuauugacgauagauucgccaccgcucuuacagcccugaaugacaugggcaaagugcgcaaggauaucccccagugggaaccuucuaaaggguggaacgacuggcagcaaguucccuuuugcucccaccauuuccaccagcucauuaugaaggauggccgggagaucguggucccuuguagaaaucaggacgaacuggugggacgcgcucgggucagccagggcgccggguggucccugagagagaccgcuugccucggaaaaucuuaugcccaaauguggcagcugauguacuuucaucgccgggaucuuagacuggcggccaacgcuauuuguagcgccgugcccguugacugggugccgacgucccgcacaaccuggagcauccacgcccaucaccaguggaugacaaccgaggauaugcucucugucuggaaucggguguggauugaagagaacccuuggauggaagacaagacgcacaucuccagcuggggcgauguucccuaucuggggaagagagaggaccaauggugcggaucucuuaucggccugaccgcucgcgccacaugggcgaccaauauucagguggcuaucaaccagguccggagacucauugggaaugaaaacuaccuggacuacaugacaagcaugaaacgguucaagaaugaguccgaucccgagggcgcccugugguga

SEQ ID NO: 18885 - RNA, 9879 nt, Artificial Sequence
  derived and/or modified CDS sequence (opt5) from DENV-1__FJ390388__SS-prME
agcgugaccaugcugcucaugcugaugcccacggcccuugcuuuccaccugacgacccggggcggggagccucauaugauuguguccaagcaggaacggggaaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcguuggcaaacucguccaucagauuuucgggacggccuacggagugcuguuuuccggcgugagcuggaccaugaagaucgggauuggcguccuuaugacauggcugggacucaauucuagauccaccagccugucuaugacauguaucgcugugggccugguuacccuuuaccucggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcugucugccgcgauuggcaaggccugggaggagggggucugcggcaucagaagcgcuacacgccucgaaaacaucauguggaaacagauuuccaacgagcugaaucauauccuucuggaaaacgacaugaaguucaccgugguugugggagaugucgccggcauucucgcucaggggaaaaagaugauccggccgcaacccauggagcacaaauacucuuggaaaagcuggggaaaggccaagauuaucggcgccgacgugcagaauaccacauuuaucauugaugggccuaacacccccgaauguccugacgaucagagagcuuggaauaucugggagguggaggacuauggauucggcauuuuuacgacaaacaucuggcugaagcugcgcgauuccuacacccaggucugcgaccaccggcuuaugagcgcggccauuaaagauucuaaggcuguucaugccgacaugggcuauuggaucgaauccgagaaaaaugaaacauggaagcucgccagagcuagcuucaucgaggugaagaccuguauuuggcccaaaucucacacacugugguccaacggggugcuggaaagcgagaugaucauuccgaagaucuacggaggcccuauuucucaacauaauuaucgccccggguacuucacccagacggccggaccuuggcaccucggcaaacuggagcuugauuuugaccugugcgaagggaccacagucgugguugaugagcacugcggaaaccggggccccagccucagaaccacaaccgugacgggcaagaucauccaugaaugguguugccgguccuguacacugccuccccugcgcuucagaggggaggacggaugcugguacggcauggagauucggccggucaaagaaaaggaggaaaaucuugucaagagcaugguuucugcgggguccggagagguggacagcuuuucccucggccugcuguguaucucuauuaugaucgaagaggucaugagaagccgcuggucccggaaaaugcucaugaccgggacacuggcuguguucuuucuucugauuguuggacagcucaccuggaacgaucugaucagacugugcauuauggugggcgccaaugccucugaccgcaugggcauggggaccacauaucuugcucugauggccacguucaagaugagaccuauguuugcggucggacuccuguuccggcgccucaccagcagagaggugcugcuucugacaaucggccucucccugguggcuucugucgaacugcccaacagccuugaggaacugggggauggacucgccaugggcaucaugauucugaaacuccugaccgacuuucaaucccaccagcuuugggccacacugcucagccugaccuucaucaagacgacauuuucucugcauuacgcuuggaaaaccauggccaugguucuuuccguggugagccuguucccccucugucugucuaccacaucccagaagaccacauggcucccuguccugcuugggagccugggaugcaagccgcugacgauguuucucauugcugagaauaaaaucuggggccggcgcucuuggccccugaacgaaggcauuauggccguggggaucguuuccauccuucugagcucccuccugaagaacgaugugccucucgcgggaccccugauugccggcgggaugcuuaucgcuuguuaugucauuagcggaucuagcgccgaccugucccuggagaaagcugccgaggugucuugggaagaggaagccgagcacagcggcgcuucccauaauauccucguugaagugcaggaugacgggaccaugaagauuaaagaugaggagagagacgauacacugaccauccuucugaaggcgacacuccuggccgucucuggaguguacccucucagcauccccgcuacccuguucgucugguauuucuggcagaagaagaagcagcgguccggcgugcuuugggacacgccuucucccccggaaguugagcgcgccgugcuggaugacggcauuuacagaaucaugcagcgggggcugcucggacgcagccaggucggcguggggguuuuucaagaaaacguguuccacaccauguggcacgucacaagaggagccgugcugauguaucagggcaaacggcuugagccuuccugggcuagcgugaagaaagaccugauuucuuacgggggaggcuggagacuccagggcuccuggaauaccggggaggaaguucaggucaucgccguggagcccggaaagaacccuaaaaaugugcaaacagcgcccggcaccuuuaagacaccggaaggggaggucggagcuauugcccuggauuucaagccuggcacgagcgggucucccaucgugaaccgcgaacggaaaauuguuggacucuacggcaauggcguggucaccacauccgggaccuaugugagcgccaucgcucaggccaaggcgucccaggagggaccucugcccgagaucgaagacgagguuuuuagaaaacgcaaccuuaccauuauggaucugcaucccggcucugggaagacacggagauaccugccugcuaucgugcgcgaagccauuaaacggaagcucagaacgcugauccuugccccgacccgcgucguggcuagcgagauggccgaagcucugaagggaaugcccauucgguaucaaacaaccgccguuaaauccgagcacacaggcaaggagaucguggaccucaugugccaugcgaccuucacgaugagacugcugagcccuguccgggugcccaauuacaacaugaucauuauggaugaagcccacuuuacagacccuucuuccaucgcugcccgcggguauauuagcaccagagugggcaugggagaggcugccgccaucuucaugaccgcuacacccccuggcucugucgaagcguuuccgcagagcaaugccguuauucaggaugaggaacgggacauccccgagcgcuccuggaacucuggguacgaguggaucaccgauuucccuggaaaaacagugugguuugugcccagcauuaaguccggcaaugacaucgcuaacugucuccgcaaaaaugggaagcgggucauucagcuuucuagaaagaccuucgauacggaauaucagaaaaccaagaacaacgacugggacuacgugguuaccacagauaucagcgagaugggagccaauuuccgcgccgaccgggugauugauccuagacgcugccugaaacccgucauccugaaggacggcccggaacgggugauucucgcugggccuaugcccguuaccguggccuccgcggcucagagacgcggccggaucggaagaaaccauaauaaagagggcgaucaguacaucuauauggggcagccccugaacaaugacgaggaucacgcccacuggacggaagccaagaugcuucuggacaacauuaauaccccugagggaaucauucccgcucucuuugaaccugagcgcgaaaagagcgccgcgaucgauggcgaguacagacugagaggggaagcccgcaaaacauucgucgaacugaugagacggggagaccucccgguguggcuuucuuauaaggucgcuuccgagggcuuucaauacagcgaucgcagauggugcuucgacggggaacggaacaaucaggugcuggaggaaaacauggauguugagauuuggaccaaagagggcgaaagaaagaaacugcgcccccgguggcucgacgccagaacauauuccgacccucuggcucuuagagaguuuaaggaguucgccgcuggacggagaucugugagcggcgaucugauccucgagaucgggaaacugccccagcaucugacccagcgggcccaaaaugcgcucgacaaccuugugaugcugcacaauuccgaacagggaggccgcgccuacagacaugcuauggaggagcugccugauacaauugaaacccucaugcugcuugcccugaucgcuguccucacaggcgggguuacacuguuuuuccugucugggcggggccucgggaagaccagcauuggacuucugugugugauggccuccagcgugcugcucuggauggccucugucgagccccacuggaucgcugcguccauuauccuggaauuuuuccuuauggugcugcucaucccggagccugaccgccagagaacaccccaggauaaccaacuggccuauguugugauuggccugcucuuuaugauccuuacagucgcugccaaugagauggggcugcuggaaaccacaaagaaagaccucggaauuggccacguggccgucgagaaccaucaccaugcugccaugcuggauguggaccuucacccugcgagcgccuggacgcuguacgcuguugccaccacaaucauuacccccaugaugcggcauacaaucgaaaacaccacggcuaauauuucucucaccgccaucgcgaaccaggccgcuauccugauggggcuggauaagggauggccuauuuccaaaauggacaucggcgugccccuccuugcccugggcugcuacagccaggucaauccgcugacacucaccgcugccgugcugaugcuuguugcucacuaugccauuaucgggccuggacugcaagcgaaggccacacgcgaggcucagaaaagaaccgccgcuggcauuaugaagaaccccacgguggaugggaucgucgccaucgaccucgaucccgugguguacgacgccaaguucgaaaaacagcugggacagauuaugcugcucauccuuuguacaucucaaauucugcugaugcggaccacaugggcgcucugcgagagcaucacccuggcuaccggcccucuuacaacgcugugggagggguccccgggaaaguuuuggaauaccacaauugccguuucuauggcuaacaucuuccgcggcagcuaucucgccggcgccgggcuggcuuucucccugaugaaaagccucggaggcgggagacggggaaccggcgcccagggggaaacacuuggagagaaguggaaaagacagcugaaucagcuguccaagucugaauuuaacaccuacaagcgcagcggcaucauggaggucgaccgguccgaagcgaaagagggccucaagagaggggagacgacaaaacacgccgugucucgcggaaccgcuaagcugcggugguucguggaaagaaaucuugucaaacccgagggcaagguuauugaucugggguguggacgcggcggguggagcuauuacugcgccggacucaagaaagugaccgaagugaagggcuauacaaaaggcgggccuggacaugaggaacccaucccuauggcuaccuacggcuggaaccuggucaagcugcacuccgggaaagacguguuuuucauucccccugagaagugugauacacuccuuugcgacaucggagagucuagcccgaaucccacgauugaagagggccggacccugagaguucugaaaaugguggaaccuuggcuccgcgggaaccaauuuuguaucaagauucugaaucccuacaugccuuccgucguggagacacuugagcagaugcagcggaagcauggaggcaugcugguuagaaacccccucagccgcaauucuacccacgaaauguauuggguguccugcggcacagggaacaucgucagcgccgugaauaugaccucucggaugcugcugaacagauucacgauggcgcaccgcaaaccgaccuacgagagagauguggaccucggagccggcacacggcaugucgcuguugaaccugagguggccaaccuggauaucauugggcagcgcaucgaaaauauuaagcacgagcauaaauccaccuggcacuaugacgaggauaaccccuacaagacaugggcuuaucauggaagcuacgaagugaaacccucuggcuccgccagcuccauggucaauggggugguuaaacuucugaccaagccuugggacgugauccccauggucacacaaauugcuaugaccgauacgacaccuuuuggacagcagagaguguucaaagagaagguugacacccggaccccgaaagccaagagaggcacagcgcaaaucauggaagugacggccaaauggcucuggggcuuucugagccggaacaagaagccccgcaucuguaccagagaggaguucacacggaaaguccgcucuaaugcugccauuggggcuguguuuguugacgagaaccaguggaauagcgccaaggaggccguggaagaugagagauucugggaccuuguccaccgggaacgcgagcugcacaaacagggaaagugcgcgaccugcguguauaacaugaugggcaaaagagaaaagaagcucggggaguuuggaaaagcuaagggcucccgggccaucugguacauguggcugggggcccgcuuccuggaguucgaagcucucggcuuuaugaaugaggaucauugguucucuagagaaaacagccuguccggagucgagggcgaggggcuucacaaacugggauacauucuccgggacaucucuaagauuccuggcgggaauauguaugccgaugacacagcuggaugggauacccgcaucacagaagacgaucugcagaacgaggccagaaucaccgacauuauggaacccgagcaugcgcuucuggccaaaagcaucuuuaagcucacguaccaaaauaaagugguucgggugcagcgcccugcuaagaacggcaccgucauggaugugauuuccagacgggaccagagagggucuggccaggugggaacauauggccugaauaccuucacaaacauggaagcccaacugauccgccagauggagagcgaggggaucuuuucccccagcgaacucgagaccccgaaccuggcugaacggguucuugauuggcuggagaaguacggaguggaaagacucaaacgcauggccaucucuggcgacgacugugucgugaagccuaucgaugaccgguucgcgacggcccugacagcucuuaaugauauggggaaaguuagaaaggacauuccccagugggagccuuccaaaggauggaacgauuggcagcaagugcccuuuugcagccaccacuuccaucagcugaucaugaaggacggccgcgagauugucgugccuugucggaaucaggaugaacucgucgggagagcccgcgugucucagggcgcuggauggucccugcgggagaccgccugccugggcaagagcuaugcucaaauguggcagcucauguacuuucacagacgcgaccugcggcuugccgcgaacgccaucuguuccgcuguucccguggauuggauuccgacaucuagaaccacguggagcauccaugcccaccaucaguggaugaccacagaagacaugcuguccgucuggaaucggguguggauugaggaaaacccuuggauggaggauaaaacccacaucagcucuuggggagacguucccuaucucggaaagagagaggaccaauggugcggcucccugaucgggcuuacagcccgcgcuaccugggccacaaauauucagguggcgaucaaccagguccggagacugauuggaaaugaaaacuaccucgauuacaugaccagcaugaaacgcuucaagaaugagucugaccccgaaggcgcucugugguga

SEQ ID NO: 18886 - RNA, 9879 nt, Artificial Sequence
  derived and/or modified CDS sequence (opt5) from DENV-1__FJ024464__SS-prME
agcgugaccaugcugcucaugcugaugcccacagcccuugcuuuccaccugacgaccagaggcggggaaccucauaugauugucuccaagcaggaacggggaaaaucucuccuguuuaagacaagcgccggcguuaacaugugcacccuuauugccauggaccugggggaacucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgugcgccggauggcuauccugggagauacagccugggacuucggcucuaucgggggaguuuuuaccagcgucggcaaacucgugcaucagauuuucgggacggcguacggagugcuguuuuccggcgucagcuggaccaugaagaucgggauuggcgugcuucugacauggcucggacucaauucuagauccaccagccugucuaugacauguaucgccguuggccuugugacccucuaccugggggucauggugcaggcugauuccggaugcguuauuaacuggaaaggccgcgaacugaagugugggagcggaaucuucgugacaaaugagguccacaccuggacggaacaauauaaguuucaggccgacuccccuaaacggcucucugcugccauuggcaaggcgugggaggagggggugugcggcaucagaagcgccacacgccuggaaaacaucauguggaaacagauuuccaacgagcuuaaucauauccugcucgaaaacgacaugaaguucaccguuguggucggagauguggcuggcauucuggcccaggggaaaaagaugauccggccgcaacccauggaguacaaauauucuuggaaaagcuggggaaaggcuaagauuaucggcgccgacgugcagaauaccacauuuaucauugaugggccuaacacccccgaauguccugacgaucagagagccuggaauaucugggaggucgaggacuacggauucggcauuuuuacgacaaacaucuggcugaaacuucgcgauuccuauacccagguuugcgaccaccggcucaugagcgcugcgauuaaagauucuaaggccgugcacgcugacaugggcuacuggaucgaauccgagaaaaaugaaacauggaagcuggccagagccagcuucaucgaggugaagaccuguauuuggcccaaaucucauacacugugguccaacgggguccucgaaagcgagaugaucauuccgaagaucuauggaggcccuaugucucaacacaauuaccgccccggguacuucacccagacggcuggaccuuggcaucugggcaaacuugagcuggauuuugaccucugcgaagggaccacagugguuguggaugagcacugcggaaaccggggccccagccugagaaccacaaccgucacgggcaagauuauccacgaaugguguugccgguccuguacacugccuccccuucgcuucagaggggaggacggaugcugguauggcauggagauccggccggugaaagaaaaggaggaaaaucucguuaagagcauggugucugccggguccggagaggucgacagcuuuucccugggccugcucuguauuucuaucaugauugaagaggugaugagaagccgcuggucccggaaaaugcugaugaccgggacacuugcgguuuucuuucugcucaucaugggacagcugaccuggaacgaucugauuagacuuugcaucauggugggcgcuaaugccucugaccgcaugggcauggggaccacauaccuggcccucauggcuacguucaagaugagaccuauguuugccgucggacugcuguuccggcgccugaccagcagagaggugcuucugcucacaauuggccugucccugguggcgucugucgaacuucccaacagccuggaggaacucggggauggacuggcuaugggcaucaugauccucaaacugcuuaccgacuuucaaucccaucagcugugggccacacuccugagccugaccuucauuaagacgacauuuucucuucacuaugccuggaaaaccauggcuaugguucuguccaucgugagccucuucccccugugucucucuaccacaucccagaagaccacauggcugccugugcuucuggggagccugggaugcaagccgcucacgauguuucugauugccgagaauaaaaucuggggccggcgcucuuggccccuuaacgaaggcauuauggcugucgggaucguguccauccugcucagcucccugcucaagaacgauguuccucuggccggaccccuuauugcgggcgggaugcugaucgccuguuacgugauuagcggaucuagcgcugaccugucccucgagaaagccgcugaggucucuugggaagaggaagccgagcauagcggcgccucccacaauauccugguggaaguucaggaugacgggaccaugaagauuaaagaugaggagagagacgauacacuuaccauccugcucaaggcuacacugcucgcggugucuggagucuauccucugagcauccccgccacccuuuucgugugguacuucuggcagaagaagaagcagcgguccggcguccugugggacacgccuucucccccggaaguggagcgcgcuguucuggaugacggcauuuauagaaucaugcagcgggggcuccugggacgcagccaggugggcgucgggguguuucaagaaaacguuuuccauaccauguggcacgugacaagaggagccguccuuauguaccagggcaaacggcuggagccuuccugggccagcgugaagaaagaccucauuucuuacgggggaggcuggagacugcagggcuccuggaauaccggggaggaagugcagguuaucgcugucgagcccggaaagaacccuaaaaaugugcaaacagcccccggcaccuuuaagacaccggaaggggaggugggagcgauugcucucgauuucaagccuggcacgagcgggucucccaucgucaaccgcgaaggaaaaauugugggccuguauggcaaugggguugugaccacauccggaaccuacgucagcgccaucgcccaggcuaaggccucccaggagggcccucuucccgagaucgaagacgagguguuucggaaaagaaaccugaccauuauggaucugcaccccgggucuggaaagacacgccgguaucucccugcgaucguuagagaagcuauuaaacgcaagcugcggacgcuuauccuggccccgaccagaguggucgccagcgagauggcugaagcccucaagggcaugcccauucgcuaccaaacaaccgcugugaaauccgagcauacagggaaggagaucguugaccugaugugccacgccaccuucacgaugcggcugcucagcccugugagaguccccaauuauaacaugaucauuauggaugaagcgcauuuuacagacccuucuuccaucgccgcucggggcuacauuagcacccgcgugggaaugggcgaggccgcugccaucuucaugaccgccacacccccugggucuguggaggcuuuuccgcagagcaaugcggucauucaggaugaggaaagagacauccccgagcgguccuggaacucuggauaugaguggaucaccgauuucccuggcaaaacaguuugguuugugcccagcauuaaguccgggaaugacaucgccaacugucuucgcaaaaauggaaagagagugauucagcugucucggaagaccuucgauacggaauaccagaagaccaagaacaacgacugggacuacgucgugaccacagauaucagcgagaugggcgcuaauuucagagccgaccgcguuauugauccucggagaugccugaaacccgugauccucaaggacgggccggaacgcgucauucuggccggcccuaugcccgugaccguugcuuccgccgcgcagcggagaggacgcaucggccggaaccacaauaaagagggggaucaguauaucuacaugggacagccccuuaacaaugacgaggaucaugcucacuggacggaagccaagaugcugcucgacaacauuaauaccccugagggcaucauucccgcccuguuugaaccugagagagaaaagagcgcugccaucgauggggaguaucgccugagaggagaggcgcggaaaacauucguggaacucaugcgcagaggcgaccuuccggucuggcugucuuacaagguggccuccgagggguuucaauauagcgaucggcgcuggugcuucgacggcgaaagaaacaaucagguccuggaggaaaacauggauguggagauuuggaccaaagagggagaacggaagaaacucagaccccgcuggcuggacgcucggacauacuccgacccucuugcccugagagaguuuaaggaguucgcugccggccgccggucuguuagcggggaucucauccuggagaucggaaaacugccccagcaccucacccagagagcucaaaaugcccuugacaaccuggugaugcugcauaauuccgaacagggcgggcgggcguaucgccacgccauggaggagcucccugauacaauugaaacccugaugcuucuggcucucaucgccgugcugacgggaggcgucacacuguuuuuccucucuggcagagggcuuggaaagaccagcauuggccugcuguguguuauggcuuccagcgugcuccuguggauggccucuguggagccccauuggaucgccgcuuccauuauccuugaauuuuuccugaugguccuccugaucccggagccugaccggcagcgcacaccccaggauaaccaacuggcguacgugguuauugggcuccuuuuuaugauccugacaguggccgcuaaugagaugggacugcucgaaaccacaaagaaagaccugggcauugggcacgucgccguggagaaccaccaucacgccgcuaugcuugaugucgaccugcauccugccagcgcguggacgcucuacgccguggcuaccacaaucauuacccccaugaugagacacacaaucgaaaacaccacggccaauauuucucugaccgcuaucgccaaccaggcggccauccugaugggacucgauaagggcuggccuauuuccaaaauggacaucggcguuccccuucuggcucuggggugcuauagccaggugaauccgcucacacugaccgccgcuguccuuaugcugguggcccauuacgcuauuaucggaccuggccuccaagccaaggcgacacgggaggcccagaaacgcaccgcugccgggauuaugaagaaccccacgguugauggaaucguggcuaucgaccuggaucccgucguguaugacgccaaguucgaaaaacagcugggccagauuaugcuccuuauccuguguacaucucaaauucugcucaugagaaccacaugggcccugugcgagagcaucacccuugcgaccgggccucugacaacgcucugggagggauccccgggcaaguuuuggaauaccacaauugcugugucuauggccaacaucuuccggggcagcuaccuggcuggggccggacuggccuucucccucaugaaaagccuuggcgggggacgcagaggcaccggggcucagggagaaacacugggcgagaaguggaaacggcagcugaaucagcucuccaagucugaauuuaacaccuauaagagaagcggcaucauggagguugaccgcuccgaagccaaagaggggcugaagcggggagagacgacaaaacacgcggucucuagaggcaccgccaaacuucgcugguucguggaacggaaucuggugaaacccgaggggaaggucauugaucucggauguggcagagggggauggagcuacuauugcgcuggccugaagaaaguuaccgaagugaagggcuacacaaaagggggaccuggccacgaggaacccaucccuauggccaccuacggguggaaccuggugaagcuccauuccggaaaagacgucuuuuucauucccccugagaagugugauacacuucugugcgacaucggcgagucuagcccgaaucccacgauugaagaggggcgcacccugcgggugcucaaaaugguugaaccuuggcugagaggaaaccaauuuuguaucaagauucuuaaucccuauaugccuuccguggucgagacacuggagcagaugcagcgcaagcacggcggcaugcucgugcggaacccccugagcagaaauucuacccaugaaauguacuggguuuccugcgggacaggaaacaucgugagcgcugucaauaugaccucucgcaugcugcucaaccgguucacgauggcccacagaaaaccgaccuaugagcgcgauguggaccugggcgcggggacaagacacguggccgucgaaccugagguugcuaaccuugauaucauuggacagcggaucgaaaauauuaagcaugagcacaaauccaccuggcauuacgacgaggauaaccccuauaagacaugggccuaccacggcagcuaugaagugaaacccucuggguccgcuagcuccauggugaauggagucgugaagcugcucaccaagccuugggacguuauccccauggugacacaaauugccaugaccgauacgacaccuuuuggccagcagcgcgucuucaaagagaagguggacaccagaaccccgaaagcuaagcggggcacagcccaaaucauggaaguuacggcgaaauggcuguggggguuucuuagcagaaacaagaagccccggaucuguacccgcgaggaguucacaagaaaagugcggucuaaugccgcuauuggagccgucuuuguggacgagaaccaguggaauagcgcuaaggaggccguugaagaugagcgcuucugggaccuggugcauagagaacgggagcuccacaaacagggcaagugcgcgaccugcgucuacaacaugauggggaaacgcgaaaagaagcugggagaguuuggcaaagcgaagggguccagagcuaucugguacauguggcugggcgcccgguuccucgaguucgaagcccugggauuuaugaaugaggaucacugguucucucgcgaaaacagccuuuccggcguggagggggagggacugcauaaacucggcuauauucugagagacaucucuaagauuccugggggaaauauguacgcugaugacacagccggcugggauacccggaucacagaagacgaucuucagaacgaggcucgcaucaccgacauuauggaacccgagcacgcccugcucgcgaaaagcaucuuuaagcugacguaucaaaauaaagucgugagaguucagcggccugccaagaacgggaccgugauggaugucauuucccgcagagaccagcggggcucuggacaggugggcacauacgggcugaauaccuucacaaacauggaagcucaacucaucagacagauggagagcgagggaaucuuuucccccagcgaacuggagaccccgaaccuugccaagcgcgugcuggauuggcucgaaaaauauggcguugagcggcugaagagaauggcuaucucuggggacgacuguguggucaaaccuaucgaugaccgcuucgccacggcgcuuacagcccugaaugauaugggaaaggugcggaaagacauuccccagugggaaccuuccaagggcuggaacgauuggcagcaaguucccuuuugcagccaucacuuccaccagcucaucaugaaggacgggagagagauuguggucccuugucgcaaucaggaugagcuggugggccgggcuagagucucucagggagccggcuggucccugcgcgaaaccgcuugccucgggaaaagcuacgcccaaauguggcagcugauguauuuucaucggagagaccuucgccuggcugccaacgcgaucuguuccgccgugcccguugauuggauuccgacaucucggaccacguggagcauccacgcucaucaccaguggaugaccacagaggacaugcucuccguguggaauagagucuggauugaagagaacccuuggauggaagauaagacccauaucagcucuuggggagacgugcccuaccugggcaaacgggaggaccaauggugcgggucccuuaucggacugacagccagagccaccugggcuacaaauauucagguugccaucaaccaggugcgccggcucauuggcaaugagaacuaccuggauuauaugaccagcaugaagagauucaaaaaugaaucugaccccgagggggcgcugugguga

SEQ ID NO: 18887 - RNA, 9879 nt, Artificial Sequence
  derived and/or modified CDS sequence (opt5) from DENV-1__FJ410191__SS-prME
agcgugaccaugcugcugaugcugaugcccaccgcccuugcuuuccaccugacgaccagaggaggggagccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagaagguugaaacaugggcucuccggcaccccggcuuuaccgugaucgcccuguuccuugcgcaugccauugggacaucuaucacccagaagggaaucauuuuuauccugcucaugcuggucaccccuagcauggcuaugcgcugcgugggcauuggguccagagauuucguugagggacuuagcggcgccacauggguggacgucgugcuggagcacgggucuugugugacgaccauggcuaaagauaagcccacacucgacaucgaacugcugaaaaccgaggucacaaacccugccguucuccggaagcugugcauugaagcgaaaaucuccaauaccacgacagauagccgcuguccgacccaaggagaggccacccuuguggaagaacaagacgcuaacuuugugugcagacggacauucgucgaucgcggcuggggcaauggguguggacuguuuggcaaggggucucucauuaccugcgccaaguucaaaugcgugacaaagcuggagggaaaaacgguucagcacgaaaaccuuaaguacuccgugaucgucaccgugcauacaggcgaccagcaccaaguugggaaugagagcaccgaacauggaacaaccgcuacgaucacaccccaggccccuucuacagagauucagcugaccgacuauggcgcccucacacuggauuguucccccagaaccggccuggacuuuaacgaaauggugcuccugacgaugaaagaaaagagcuggcuuguccacaaacagugguuccuggaucucccucugcccuggacauccggggcuucuaccagccaagagacauggaaucggaaggaccuucuggugaccuuuaagaccgcgcacgccaaaaagcaggaagucgugguucucggaucccaggagggcgcuaugcauacagcccugacgggggccaccgaaauccaaacaagcggaaccacaaccauuuucgcuggccaccugaaaugccgccucaagauggauaaacugacgcuuaaggggacaucuuacgugauguguaccggcuccuucaagcuggagaaagaagucgccgagacccagcauggaacagugcucguucagaucaaguaugagggcaccgacgcgccgugcaaaauuccuuuuagcacacaggaugaaaagggggugacgcaaaacggaagacugaucaccgcuaaucccaucgucacagacaaagagaagccugugaacauugaagccgagccgcccuucggcgagucuuacaucgugauuggggccggagaaaaggcucugaaacuuagcugguuuaagaaaggcuccucuaucgggaagauguucgaggccaccgcucggggcgccagacgcauggcgauucucggagauacagccugggacuuuggcagcaucgggggaguuuucaccuccgucggcaaacuggugcaccagaucuuugggacggcuuauggagugcuguucagcggcgucucuuggaccaugaagauugggaucggcgugcuccugacauggcuuggacucaauucccggagcaccucucucuccaugacauguauugccguuggccuggugacccuguaccuuggggucauggugcaggcugauagcggaugcguuaucaacuggaagggcagagaacucaaauguggguccggaauuuuugugacaaaugagguccauaccuggacggaacaguacaaguuccaagccgacucuccuaaacgccugagcgcggccaucggcaaggcuugggaggagggggugugcggcauucgguccgccacaagacuggaaaacaucauguggaaacagaucucuaacgagcucaaucacauucugcuugaaaacgacaugaaguuuaccguuguggucggagauguggcuggcauccuggcccaggggaaaaagaugauucgcccgcagcccauggaguauaaguacagcuggaaauccuggggaaaggccaaaaucauuggcgcugacgugcaaaauaccacauucaucaucgaugggccuaacacccccgaauguccugacgaucagcgggcguggaauauuugggaggucgaggacuauggauuuggcaucuucacgacaaacauuuggcucaagcugagagauagcuacacccagguuugcgaccaccgccugaugucugccgcuaucaaagauuccaaggccgugcaugccgacaugggcuauuggauugaaagcgagaagaaugaaacauggaaacuugcucgggccucuuucaucgaggugaagaccuguaucuggcccaaaucccacacacucuggagcaacgggguccuggaaucugagaugauuaucccgaagauuuacggaggcccuaccagccagcauaauuauagacccggguacuuuacgcaaaccgcgggaccuuggcaccugggcaaacucgagcuggauuucgaccuuugcgaagggacaaccgugguuguggaugagcacugcggaaaccgcggccccucccugcggacaaccacggucacaggcaagaucauucaugaaugguguugcagaagcuguacccucccuccccugcgguuuaagggggaggacggaugcugguacggcauggagauccgcccggugaaagaaaaggaggaaaaucugguuaaaucuaugguguccgcugggagcggagaggucgacuccuucucucuuggccuccuguguaucagcauuaugaucgaagaggugaugagaucccgguggucuagaaagaugcugaugacagggacccucgccgucuuuuuccugcuuauuaugggacagcugaccuggaacgaucucauccgccugugcauuauggugggcgccaaugcuagcgaccggaugggcauggggacaacguaucuggcccuuauggcgaccuuuaaaaugagaccuauguucgcugucggacugcucuuucgcagacugacaucccgggaggugcuccugcuuaccaucggccugucucucguggccagcgucgaacugcccaacucccuggaggaacuuggggauggacuggccaugggcauuaugauccucaagcugcucacagacuuccagagccaccaacugugggcuacccuucugucucucacguuuaucaagacaaccuucucccugcauuacgccuggaaaaccauggcuaugguucugagcauugugucucuuuuuccccugugucucuccacaaccagccagaagacaacguggcugccugugcuccuggggucucuuggaugcaaaccgcugaccauguuccugaucgccgagaauaagauuuggggccgcaaauccuggccccucaacgaaggcaucauggcggucgggauugugagcauccugcuuuccagccugcucaagaacgauguuccucuggccggaccccucaucgcuggcgggaugcugauugccuguuaugugaucucuggaagcuccgcugaccuuucucuggagaaagccgccgaggucagcugggaagaggaagcugagcacuccggcgcgucucauaauauucugguggaaguucaggaugacgggacaaugaagaucaaggaugaggagagagacgauacccucacaauucugcuuaaagccacccugcucgcugugagcggagucuacccucuguccauccccgccacgcuguucgugugguauuuuuggcagaagaaaaagcaacggucuggcguccugugggacaccccuagcccucccgaaguggagcgcgccguucuugaugacggcaucuacagaauuaugcagcgggggcugcugggacgcucccaggugggcgucgggguguuccaggaaaacguuuuucacacaauguggcacgugaccagaggagcuguccucauguaucaaggcaaacggcuggagcccagcugggccucugugaagaaggaccuuaucuccuacgggggaggcuggcgccugcagggcagcuggaauacaggggaggaagugcagguuauugcggucgagcccggcaagaauccuaagaaugugcagaccgcucccggcacauucaaaacgucugaaggggaggugggagccaucgcccucgauuuuaagccgggcaccuccgggagcccuauugucaacagagaaggaaaaaucgugggccuguacggcaaugggguugugacaaccuccggaaccuaugucucugcuauugcccaagcgaaggcuagccaggagggcccccucccugagaucgaagacgagguguuccggaagagaaaccugacaaucauggaucuucaucccggguccggaaaaacgcgccgguaccugcccgccauuguuagagaagccaucaagcgcaaacugcggacccucauucuggcuccuacaagaguggucgccagcgagauggcugaagcccuuaagggcaugccgauccgcuaucagaccacagcggugaaaggggagcacaccggcaaggagauuguugaccugaugugccaugccacguuuacaaugcggcuccugucucccgugagagucccuaauuacaacaugaucaucauggaugaagcucacuucaccgaccccuccagcauugccgcucgcggauauaucucuacccgggugggcaugggggaggccgccgcuauuuuuaugacagcgaccccucccggaagcguggaagccuucccucaauccaaugcugucauccaggaugaggaaagagacauuccggagcggucuuggaacagcggcuacgaguggaucacagauuuucccgggaagaccguuugguucgugccuuccaucaaaucuggaaaugacauugccaacugucugcgcaagaauggcaaaagagugauccagcucagccggaagacguucgauacagaauaucagaaaaccaagaacaacgacugggacuacgucgugacaaccgauauuuccgagaugggggccaauuuucgcgcugacagaguuaucgauccccggagaugccuuaagccugugauucugaaagacggccccgaacgcgucauccuggccggaccgaugccugugacgguugcgagcgcugcccaacggagaggccgcauugggcggaaccauaauaaggagggagaucaguacaucuauaugggccagccccucaacaaugacgaggaucacgcccacuggaccgaagcuaaaaugcugcuugacaacaucaauacacccgaggggauuaucccugcccuguucgaacccgagagagaaaagucugcggccauugauggagaguaccgccuccggggcgaggcuagaaaaaccuuuguggaacugaugcgcagaggggaccugccugucuggcucuccuauaagguggccagcgagggcuuccaguacuccgaucggcgcuggugcuuugacggagaaagaaacaaucaaguccuugaggaaaacauggauguggagaucuggacaaaagagggcgaacggaagaagcugcgcccgagauggcuggacgcucggaccuauucugacccccucgcccugagagaguucaaagaauuugcugccgggcgccggagcguuuccggagaucuuauucuggagaucggcaagcucccucagcaucugacacagagagcgcagaaugcccuggacaaccucgugaugcuucacaauucugaacaagggggacgcgcuuaccggcaugccauggaggagcugcccgauaccaucgaaacgcugaugcuccuggcucuuauugccgugcugacaggcggcgucacccucuucuuucugagcgggagaggacugggcaaaaccuccaucgggcuccuuuguguuauggccagcucugcucugcuguggauggcguccguggagccucacuggauugccgcuagcaucauucucgaguucuuucugauggugcuucugauccccgagccggaccggcagcgcacaccucaggauaaccagcucgccuaugucgugaucggacugcuguucaugauucucaccguugccgcuaaugagaugggccuucuggaaacaacgaagagagaccuggggaucggacacguggccgucgagaaccaucaccaugcggccaugcucgauguggaccugcaccccgcuucugccuggacccuuuacgcugucgccacaaccauuaucacaccuaugaugcggcauaccauugaaaacacgaccgcgaauaucucccugacagccauugcuaaccaagccgcuauccucaugggccuggauaaaggcuggcccaucagcaagauggacauuggggugccucugcucgcccuuggaugcuacucucagguuaauccccugacccugacagcugccgugcucaugcuggucgcgcacuaugccaucauuggcccggggcuucaggcuaaggccacccgcgaggcucagaaaagaacggccgccggaaucaugaagaacccuacaguggauggcauuguugcgaucgaccuggaucccguggucuacgacgcuaaauuugaaaagcagcucgggcagaucaugcugcuggugcucuguaccagccagauucuucugaugcggacaaccugggcccugugcgaguccaucacccucgcuacaggaccccugacgacccuuugggagggcucuccuggcaaauucuggaauacaaccauugccgugagcauggccaacaucuuccgcggguccuaucuggcuggagccggccucgcguuuagccugaugaagucccucgggggaggcagacgggggacaggagcccaaggcgaaacccucggcgagaaguggaaacgccagcuuaaucagcugucuaagagcgaguucaacacguacaaaagauccgggauuauggagguugaccggucugaagcuaaggagggacugaaaagaggcgagacaaccaagcacgccgucagccgcgggaccgcuaagcuccggugguuuguggaaagaaaucuggugaaaccggagggaaaggucaucgaucuuggcugugggcgcggaggcugguccuauuacugcgccggccugaaaaagguuacagaagugaaaggguauaccaagggaggccccgggcaugaggaaccuauccccauggcgacauacggauggaaccucgugaaacugcacucuggcaaggacgucuucuuuauuccucccgagaagugugauacgcugcucugcgacaucggggagagcuccccuaauccgaccauugaagagggacggacacuuagagugcugaaaaugguugaacccuggcugcgcggcaaccaguucuguaucaagauucucaauccuuacaugcccagcguggucgagacccuggagcaaaugcagcggaaacauggcgggaugcuugugagaaacccucugucucgcaauuccacacacgaaauguauuggguuagcugcggaaccggcaacaucgugucugccgucaauaugacgucccggaugcuccugaacagauuuaccauggcucaccgcaagcccacauacgagcgggauguggaccugggggccggaaccagacauguggcugucgaaccggagguugccaaccucgauauuaucggccagcgcaucgaaaauauuaaacacgagcauaagagcacauggcacuaugacgaggauaacccuuacaagaccugggcuuaucaugggucuuacgaagugaaacccuccggaagcgccuccagcauggugaauggcgucgugaagcugcuuacaaaacccugggacguuaucccuauggugacccagauugcgaugacggauacaacccccuucggccaacagagagucuuuaaggagaaaguggacacccggacaccuaaggccaagcgcgggacggcucagaucauggaaguuaccgccaaauggcuguggggauuccucucuagaaacaagaaaccgcggauuuguacaagagaggaauuuacccggaaggugcgcagcaaugcugccaucggcgccgucuucguggacgagaaccaauggaacuccgcgaaagaggcuguugaagaugagagauuuugggaccuggugcaccgggaacgcgagcuucacaagcaggggaagugcgccacaugcgucuauaacaugaugggaaaaagagaaaagaaacugggcgaguucgggaaggccaaaggcucucgggcuaucugguacauguggcucggagcccgcuuccuggaguuugaagcucugggcuucaugaaugaggaucauugguuuagcagagaaaacucccucucugggguggagggagagggccugcacaaacuuggguacauucugcgggacaucagcaaaauucccggaggcaauauguaugccgaugacaccgcggggugggauacacgcaucaccgaagacgaucuccagaacgaggccaagauuacggacaucauggaaccugagcaugcucugcuugccaaguccaucuucaaacugaccuaccagaauaaggucgugagaguucaacggcccgcuaaaaacggcacagugauggaugucauuucucgcagagaccagcggggaagcggccagguggggaccuauggacucaauacauuuaccaacaucgaagcccagcugauucgccaaauggaguccgaggaaaucuucagcccuucugagcuggaaacgcccaaccucgcgggcagagugcuggauuggcuugagaagcacgggguugaacggcugaaaagaauggccauuuccggagacgacuguguggucaagccgaucgaugaccgcuuugcuacagcccucaccgcucugaaugauaugggcaaggugcggaaagacaucccucagugggagcccagcaagggguggaacgauuggcagcagguuccuuucugcucucaccauuuucaccaacuuauuaugaaagacggcagagagaucgugguccccugucgcaaucaggaugaacuggugggacgggccagagucucccagggcgcuggguggagccuccgcgagacagccugccugggaaaguccuacgcgcagauguggcaacugauguauuuccaucggagagaccuccgccuggccgcuaacgccauuuguucugccgugccuguugauugggugcccaccagccggacgaccugguccauccacgcucaucaccaguggaugacaaccgaagacaugcuuagcgucuggaauagaguguggauugaggaaaacccguggauggaggauaaaacacacaucucuuccuggggcgacguuccuuaccuggggaagcgcgaggaccaguggugcggaagccucauuggccugaccgcccgggcgacaugggcuaccaauauccaaguggccaucaaccaggucagacggcuuauugggaaugaaaacuaucuggauuacaugacgucuaugaagagauuuaaaaaugagagcgaccccgaaggcgcccucugguga

SEQ ID NO: 18888 - RNA, 9879 nt, Artificial Sequence
  derived and/or modified CDS sequence (opt5) from DENV-1__FJ432723__SS-prME
agcgugaccaugcugcucaugcugaugcccaccgcccuugcuuuccaccugacgacccggggcggggaaccucauaugaucgucaccaagcaggaacggggaaaaucccuccuguuuaagaccucugccggcguuaacaugugcacccuuauugcgauggaccugggggaacucugugaagauaccaugacauacaaaugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuugucacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguguuuacaagcguuggcaaacugguccaucagauuuucgggaccgcuuacggagugcucuuuuccggcgugagcuggacgaugaagaucgggauuggcguccugcuuaccuggcugggacucaauucuagauccacaagccugucuaugaccuguaucgccgugggccugguuacacuuuaccucggggugaugguccaggcugauuccggaugcgugauuaacuggaaaggccgcgaacugaagugugggagcggaaucuucguuaccaaugaggugcacacauggaccgaacaauauaaguuucaggccgacuccccuaaacggcugucugcggccauuggcaaggcuugggaggagggggucugcggcaucagaagcgccacgcgccucgaaaacaucauguggaaacagauuuccaacgagcugaaucauauccuucuggaaaacgacaugaaguucacagugguugugggagaugucgugggcauucucgcucaggggaaaaagaugauccggccgcaacccauggagcacaaauacucuuggaaaagcuggggaaaggccaagauuaucggcgccgacgugcagaauaccaccuuuaucauugaugggccuaacacacccgaauguccugacgaucagagagcuuggaauaucugggaggucgaggacuauggauucggcauuuuuaccacgaacaucuggcugaagcugcgcgauuccuacacacagguuugcgaccaccggcuuaugagcgcggccauuaaagauucuaaggcugugcaugccgacaugggcuauuggaucgaauccgagaaaaaugaaaccuggaagcucgccagagcuagcuucaucgaggugaagacauguauuuggcccaaaucucacacccugugguccaacgggguccuggaaagcgagaugaucauuccgaagaucuacggaggcccuauuucucaacauaauuaucgccccggguacuucacacagaccgccggaccuuggcaccucggcaaacuggagcuugauuuugaccugugcgaagggacgaccgugguuguggaugagcacugcggaaaccggggccccagccucagaacaaccacagucaccggcaagaucauccaugaaugguguugccgguccuguacgcugccuccccugcgcuucaaaggggaggacggaugcugguacggcauggagauuagaccggugaaggaaaaggaggaaaaucuuguuaaaagcauggugucugcgggguccggagaggucgacagcuuuucccucggccugcuguguaucucuauuaugaucgaagaggugaugcggagcagauggucccgcaagaugcucaugacagggacccuggcuguuuuccuucugcucauuaugggacagcugacauggaacgaucugauccggcuuugcauuauggugggcgccaaugccucugacagaaugggcauggggaccaccuaucuggcucucaucgccacauuuaaaaugcgcccuauguucgcggucggacugcucuuuagacggcugacgagccgcgaggugcuucugcucaccaucggccugucccugguggcuucugucgaacuucccaacagccuggaggaacucggggauggacuggccaugggcauuaugauccucaagcugcuuacagacuuccaaucccaccagcugugggccacccuccugagcuuuacauucauuaaaaccacgcugucucuucauuacgcuuggaagacaauggccaugguucuguccaucgugagccucuuuccccugugucucucuaccaccucccagaagacaaccuggcugccugugcuucuggggagccugggaugcaaaccgcucacaauguuccugauugcugagaauaagaucuggggcagaaaaucuuggccccuuaacgaaggcaucauggccgucggggugguuuccauucugcucagcucccugcucaagaacgaugugccucuggcgggaccccuuaucgccggcgggaugcugauugcuuguuaugucaucagcggaucuagcgccgaccugucccucgagaaagcugccgaggugucuugggaagaggaagccgagcacagcggcgcuucccauaauauucugguugaagugcaggaugacgggacgaugaagaucaaagaugaggagcgggacgauacccuuacaauccugcucaaggcgacccugcucgccgucucuggaguguacccucugagcauucccgcuacacuuuuugucugguauuucuggcaaaagaaaaagcagcgcuccggcgugcugugggacaccccuucucccccggaaguugagagagccgugcuggaugacggcaucuaccggauuaugcagcgcgggcuccugggaagaagccaggucggcguggggguuuuccaagaaaacguguuucacacgauguggcacgucacccggggagccgugcuuauguaucagggcaaacgccuggagccuuccugggcuagcgugaagaaagaccucaucucuuacgggggaggcuggagacugcagggcuccuggaauacaggggaggaaguucaggucauugccguggagcccggaaagaacccuaagaaugugcaaaccgcgcccggcacauucaaaaccccggaaggggaggucggagcuaucgcccucgauuuuaagccuggcacaagcgggucucccauugugaaccgggaaggaaaaaucguuggccuguacggcaaugggguggucacgaccuccggaacauaugugagcgccaucgcucaggccaaggcgucccaggagggcccucuucccgagauugaagacgagguuuucagaaaacgcaaccugaccaucauggaucugcaucccgggucuggaaagacccggagauaccucccugcuauugugcgcgaagccaucaagcggaaacugagaacacuuauucuggccccgacgcgcgucguggcuagcgagauggccgaagcucucaagggcaugcccauccgguaucaaaccacagccguuaaauccgagcacaccgggaaggagaucguggaccugaugugccaugcgacauuuaccaugagacugcucagcccuguccgcgugcccaauuacaacaugauuaucauggaugaagcccacuucacggacccuucuuccauugcugcccggggcuauaucagcacaagagugggaaugggcgaggcugccgccauuuuuaugaccgcuacacccccugggucugucgaagcguucccgcagagcaaugccguuauccaggaugaggaacgggacauccccgagcgcuccuggaacucuggauacgaguggauuacagauuuuccuggcaaaaccgugugguucgugcccagcaucaaguccgggaaugacauugcuaacugucuuagaaagaauggaaaacgggucauccagcugucucgcaagacauuugauaccgaauaucagaagacgaagaacaacgacugggacuacgugguuacaaccgauauuagcgagaugggcgccaauuucagagccgaccgggugaucgauccuagacgcugccugaaacccgucauucucaaggacgggccggaacgggugauccuggcuggcccuaugcccguuacaguggccuccgcggcucagagacgcggacggaucggcagaaaccauaauaaggagggggaucaguacauuuauaugggacagccccuuaacaaugacgaggaucacgcccacuggaccgaagccaaaaugcugcucgacaacaucaauacgccugagggcauuauccccgcucuguucgaaccugagcgcgaaaagagcgccgcgauugauggggaguaccggcugagaggagaggcccgcaaaaccuuugucgaacucaugagacggggcgaccuuccgguguggcugucuuauaaggucgcuuccgagggguuccaauacagcgaucgcagauggugcuuugacggcgaacggaacaaucaggugcuggaggaaaacauggauguugagaucuggacaaaagagggagaacgcaagaaacucagaccccgguggcuggacgccagaaccuauuccgacccucuugcucugcgcgaguucaaggaauuugccgcuggccggagaucugugagcggggaucucauccuggagauuggaaagcugccccagcaucucacacagcgcgcccaaaaugcgcuugacaaccuggugaugcugcacaauuccgaacagggcgggcgggccuacagacaugcuauggaggagcucccugauaccaucgaaacacugaugcuucuggcccucauugcuguccugaccggaggcguuacgcuguucuuucucucuggccgggggcuuggaaaaacaagcaucggccugcugugugugauggccuccagcgugcuccuguggauggccucugucgagccccacuggauugcugcguccaucauccuugaguucuuucugauggugcuccugauuccggagccugaccgccagagaacaccccaggauaaccaacuggccuauguugugaucgggcuccuuuucaugauucugaccgucgcugccaaugagaugggacugcucgaaacaaccaagaaagaccugggcaucgggcacguggccgucgagaaccaucaccaugcuacaaugcuugauguggaccugcacccugccagcgcguggacgcucuacgccguugcuaccacaauuaucacccccaugaugcggcauacaauugaaaacaccacggccaauaucucucugaccgcuaucgccaaccaggcggccauucugaugggacucgauaagggcuggccuaucuccaaaauggacauuggcgugccccuucuggcucuggggugcuacagccaggucaauccgcucacacugaccgccgcugugcuuaugcugguugcccacuaugcuaucauuggaccuggccuccaagccaaggcgacacgcgaggcccagaagagaaccgcugccgggaucaugaaaaaccccacgguggauggaaucgucgcuauugaccuggaucccgugguguacgacgccaaguuugaaaaacagcugggccagaucaugcuccuuauucuguguacaucucaaauccugcucaugcggaccacaugggcccugugcgagagcauuacccuugcgaccgggccucugacaacgcucugggagggauccccgggcaaguucuggaauaccacaaucgcuguuucuauggccaacaucuuucgcggcagcuaucuggcuggggccggacuggccuucucccucaugaaaagccuuggcgggggaagacggggcaccggggcucagggagaaacacugggcgagaaguggaagcgccagcugaaucagcucuccaaaucugaguucaacaccuacaagagaagcggcauuauggaggucgaccgguccgaagccaaagaggggcugaagagaggagagacgacacgccacgcggugucucggggcaccgccaaacuuagaugguuuguggaacgcaaucuggucaagcccgaggggaagguuaucgaucucggauguggcagagggggauggagcuauuacugcgcuggccugaaaaaggugaccgaagugaaaggcuauacaaaagggggaccuggccaugaggaacccauuccuauggccaccuacggguggaaccuggucaaacuccacuccggaaaggacguguucuuuacacccccugagaaaugugauacgcuucugugcgacaucggcgagucuagcccgaaucccaccauugaagaggggagaacacugcgcguucucaagaugguggaaccuuggcugcggggaaaccaauucuguaucaagauucuuaaucccuacaugccuuccgucguggagacccuggagcagaugcagagaaaacauggcggcaugcucguucgcaacccccugagcagaaauucuacacacgaaauguauuggguguccugcgggaccggaaacaucgucagcgcugugaauaugacgucuagaaugcugcucaaccgcuuuaccauggcccaccggaagccgacauacgagagagauguggaccugggcgcggggacccgccaugucgccguugaaccugagguggcuaaccuugauaucauuggacagagaaucgaaaauauuaaacacgagcauaaguccacauggcacuaugacgaggauaaccccuacaaaaccugggccuaucauggcagcuacgaagugaagcccucuggguccgcuagcuccauggucaauggagugguuaagcugcucacaaaaccuugggacgugauccccauggucacccaaauugccaugacggauacaaccccuuucggccagcagcggguguuuaaggagaaaguugacacccgcacaccgaaggcuaaaagaggcacggcccaaaucauggaagugaccgcgaaguggcuguggggguuccuuagccggaacaagaaacccagaaucuguacacgggaggaauuuacccgcaaggucagaucuaaugccgcuauuggagccguguucguugacgagaaccaguggaauagcgcuaaagaggccguggaagaugagcgguuuugggaccugguccagaaggaacgcgagcuccacaaacagggcaagugcgccacaugcguguauaacaugauggggaagagagagaaaaagcugggagaguucggcaaagcgaaggggucccgggcuaucugguacauguggcugggcgcccgcuuucucgaguucgaagcccugggauucaugaaugaggaucacugguuuucuagagaaaacagccuuuccggcgucgagggggagggacugcauaaacucggcuacauucugcgggacaucucuaagauuccugggggaaauauguaugcugaugacaccgccggcugggauacacgcaucaccgaagacgaucuucaaaacgaggcuaaaaucacggacauuauggaacccgagcacgcccugcucgcgaccagcaucuucaagcugacauaccagaauaaggugguuagagugcagcggccugccaaaaacgggaccgucauggaugugauuucccgcagagaccagcggggcucuggacaagugggcacauaugggcugaauaccuuuacgaacauggaagcucagcucauccgccagauggagagcgagggaauuuuccugcccggcgaacuugagacaccgaaccuggccgaaagaguucucgauuggcuggagaaguacgggguggaacggcuuaaaagaauggcuaucuccggagacgacugugucgugaagccuaucgaugaccgcuuugccaccgcgcugacagcccucaaugauaugggcaaaguucggaaggacauuccccagugggagccuagcaagggguggaacgauuggcaacaggugcccuucugcucucaucacuuucaccagcugaucaugaaagacggcagagagauugucgugccuugucgcaaucaggaugaacuggucggacgggcuagagugucccaaggcgccggguggagccuccgcgagaccgcuugccugggaaagucuuaugcccagauguggcagcuuauguacuuccaucggagagaccugcgccucgcugccaacgcgaucuguuccgccguucccguggauugggucccgacgagccggaccacaugguccauucacgcucaucaccaauggaugaccacagaagacaugcugucuguguggaauagaguuuggaucgaggaaaacccuuggauggaggauaaaacccaugugagcuccuggggcgacguccccuaucuugggaagcgcgaggaccaguggugcggaagccugauuggccucacagcccgggccaccugggcuucuaauauccagguggccaucaaccaggugagacggcugauugggaaugaaaacuaccuggauuacaugacguccaugaaaagauuuaagaaugagggcgaccccgaaggagcgcucugguga

SEQ ID NO: 18889 - RNA, 9879 nt, Artificial Sequence
  derived and/or modified CDS sequence (opt5) from DENV-1__FJ410192__SS-prME
agcgugaccaugcugcucaugcugaugcccacagcccuugcuuuccaccugacgaccagaggcggggaaccucauaugaucguguccaagcaggaacggggaaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcguuggcaaacucguccaucagauuuucgggacggccuacggagugcuguuuuccggcgugagcuggaccaugaagaucgggauuggcguccuucugacauggcucggacucaauucuagauccaccagccugucuaugacauguaucgcugugggccuuguuacccucuaccugggggugaugguccaggccgauuccggaugcgugauuaacuggaaaggccgcgaacugaagugugggagcggaaucuucguuacaaaugaggugcacaccuggacggaacaauauaaguuucaggcugacuccccuaaacggcucucugccgcgauuggcaaggccugggaggagggggucugcggcaucagaagcgcuacacgccuggaaaacaucauguggaaacagauuuccaacgagcuuaaucauauccugcucgaaaacgacaugaaguucaccgugguugugggagaugucgccggcauucuggcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggagguggaggacuacggauucggcauuuuuacgacaaacaucuggcugaaacuucgcgauuccuauacccaggucugcgaccaccggcucaugagcgcggccauuaaagauucuaaggcuguucacgccgacaugggcuacuggaucgaauccgagaaaaaugaaacauggaagcuggccagagcuagcuucaucgaggugaagaccuguauuuggcccaaaucucauacacugugguccaacggggugcucgaaagcgagaugaucauuccgaagaucuauggaggcccuauuucucaacacaauuaccgccccggguacuucacccagacggccggaccuuggcaucugggcaaacuugagcuggauuuugaccucugcgaagggaccacagucgugguugaugagcacugcggaaaccggggccccagccugagaaccacaaccgugacgggcaagaucauccacgaaugguguugccgguccuguacacugccuccccuucgcuucagaggggaggacggaugcugguauggcauggagauucggccggucaaagaaaaggaggaaaaucucgucaagagcaugguuucugcgggguccggagagguggacagcuuuucccugggccugcucuguaucucuauuaugaucgaagaggucaugagaagccgcuggucccggaaaaugcugaugaccgggacacuugcuguguucuuucugcucauuaugggacagcugaccuggaacgaucugaucagacuuugcauuaugguuggcgccaaugccucugaccgcaugggcauggggaccacauaccuggcucucauggccacguucaagaugagaccuauguuugcggugggacugcuguuccggcgccugaccagcagagagguccuucugcucacaaucggccugucccugguggcuucuguggaacuucccaacagccuggaggaacucggggauggacuggccaugggcaucaugauucucaaacugcuuaccgacuuucaaucccaucagcugugggccacacuccugagccugaccuucaucaagacgacauuuucucuucacuaugcuuggaaaaccauggccaugauucuguccaucgucagccucuucccccugugucucucuaccacaucccagaagaccacauggcugccuguucuucuggggagccugggaugcaagccgcucacgauguuucugauugcugagaauaaaaucuggggccggcgcucuuggccccuuaacgaaggcaucauggccguggggauuguguccauccugcucagcucccugcucaagaacgaugucccucuggcgggaccccuuauugccggcgggaugcugaucgcuuguuacgugauuagcggaucuagcgccgaccugucccucgagaaagcugccgagguuucuugggaagaggaagccgagcauagcggcgcuucccacaauauccugguggaaguccaggaugacgggaccaugaagaucaaagaugaggagagagacgauacacuuaccauucugcucaaggcgacacugcucgccgugucuggaguuuauccucugagcauccccgcuacccuuuucgugugguacuucuggcagaagaagaagcagcgguccggcguccugugggacacgccuucucccccggaaguggagcgcgccguccuggaugacggcauuuauagaaucaugcagcgggggcuccugggacgcagccaggugggcguugggguguuucaagaaaacgucuuccauaccauguggcacgugacaagaggagccguucuuauguaccagggcaaacggcuggagccuuccugggcuagcgugaagaaagaccucauuucuuacgggggaggcuggagacugcagggcuccuggaauaccggggaggaaguccaggugaucgccguggagcccggaaagaacccuaaaaauguucaaacagcgcccggcaccuuuaagacaccggaaggggaggucggagcuauugcccucgauuucaagccuggcacgagcgggucucccaucgugaaccgcgaaggaaaaaucgugggccuguauggcaauggggucgugaccacauccggaaccuacguuagcgccauugcucaggccaaggcgucccaggagggcccucuucccgagaucgaagacgagguguuucggaaaagaaaccugaccauuauggaucugcaccccgggucuggaaagacacgccgguaucucccugcuaucgucagagaagccauuaaacgcaagcugcggacgcuuauccuggccccgaccagagugguugcuagcgagauggccgaagcucucaagggcaugcccauccgcuaccaaacaaccgccgugaaauccgagcauacagggaaggagauugucgaccugaugugccacgcgaccuucacgaugcggcugcucagcccugugagaguucccaauuauaacaugaucauuauggaugaagcccauuuuacagacccuucuuccaucgcugcccggggcuacauuagcacccgcgugggaaugggcgaggcugccgccaucuucaugaccgcuacacccccugggucugucgaagcguuuccgcagagcaaugccgugauccaggaugaggaaagagacauucccgagcgguccuggaacucuggauaugaguggaucaccgauuucccuggcaaaacagugugguuuguccccagcauuaaguccgggaaugacaucgcuaacugucuucgcaaaaauggaaagagaguuauucagcugucucggaagaccuucgauacggaauaccagaagaccaagaacaacgacugggacuacguggugaccacagauaucagcgagaugggcgccaauuucagagccgaccgcgucauugauccucggagaugccugaaacccgugauccucaaggacgggccggaacgcguuauccuggcuggcccuaugcccgugaccgucgccuccgcggcucagcggagaggacgcauuggccggaaccacaauaaagagggggaucaguauaucuacaugggacagccccuuaacaaugacgaggaucaugcccacuggacggaagccaagaugcugcucgacaacauuaauaccccugagggcaucauucccgcucuguuugaaccugagagagaaaagagcgccgcgaucgauggggaguaucgccugagaggagaggcccggaaaacauucguggaacucaugcgcagaggcgaccuuccgguuuggcugucuuacaagguggcuuccgagggguuucaauauagcgaucggcgcuggugcuucgacggcgaaagaaacaaucagguccuggaggaaaacauggauguggagaucuggaccaaagagggagaacggaagaaacucagaccccgcuggcuggacgcccggacauacuccgacccucuugcucugagagaguuuaaggaguucgccgcuggccgccggucugucagcggggaucucauucuggagaucggaaaacugccccagcaccucacccagagagcccaaaaugcgcuugacaaccuggugaugcugcauaauuccgaacagggcgggcgggccuaucgccacgcuauggaggagcucccugauacaauugaaacccugaugcuucuggcccucaucgcuguucugacgggaggcgugacacuguuuuuccucucuggcagagggcuuggaaagaccagcauuggccugcugugugugauggccuccagcguccuccuguggauggccucuguugagccccauuggaucgcugcguccaucauucuugaauuuuuccugauggugcuccugaucccggagccugaccggcagcgcacaccccaggauaaccaacuggccuacguggucauugggcuccuuuuuaugauccugacaguggcugccaaugagaugggacugcucgaaaccacaaagaaagaccugggcauugggcacguugccguggagaaccaccaucacgcugccaugcuugaugucgaccugcauccugcgagcgccuggacgcucuacgcuguggccaccacaaucauuacccccaugaugagacacacaaucgaaaacaccacggcuaauaucucucugaccgccauugcgaaccaggccgcuauccugaugggacucgauaagggcuggccuauuuccaaaauggacaucggcgucccccuucuggcccuggggugcuauagccaggugaauccgcucacacugaccgcugccguucuuaugcugguggcucauuacgccauuaucggaccuggccuccaagcgaaggccacacgggaggcucagaaacgcaccgccgcugggaucaugaagaaccccacggucgauggaauuguggccaucgaccuggaucccguuguguaugacgccaaguucgaaaaacagcugggccagauuaugcuccuuauccuguguacaucucaaauucugcucaugagaaccacaugggcgcugugcgagagcaucacccuugcuaccgggccucugacaacgcucugggagggauccccgggcaaguuuuggaauaccacaaucgccgucucuauggcuaacauuuuccggggcagcuaccuggccggggccggacuggcuuucucccucaugaaaagccuuggcgggggacgcagaggcaccggggcccagggagaaacacugggcgagaaguggaaacggcagcugaaucagcucuccaagucugaauuuaacaccuauaagagaagcggcaucauggagguggaccgcuccgaagcgaaagaggggcugaagcggggagagacgacaaaacacgccgugucuagaggcaccgcuaaacuucgcugguucguugaacggaaucuggucaaacccgaggggaaggugauugaucucggauguggcagagggggauggagcuacuauugcgccggccugaagaaagugaccgaagucaagggcuacacaaaagggggaccuggccacgaggaacccaucccuauggcuaccuacggguggaaccugguuaagcuccauuccggaaaagacguguuuuucauucccccugagaagugugauacacuucugugcgacaucggcgagucuagcccgaaucccacgauugaagaggggcgcacccugcgggugcucaaaauggucgaaccuuggcugagaggaaaccaauuuuguaucaagauccuuaaucccuauaugccuuccgugguugagacacuggagcagaugcagcgcaagcacggcggcaugcucgugcggaacccccugagcagaaauucuacccaugaaauguacugggucuccugcgggacaggaaacauugugagcgccguuaauaugaccucucgcaugcugcucaaccgguucacgauggcgcacagaaaaccgaccuaugagcgcgauguggaccugggcgccgggacaagacacgucgcuguggaaccugagguggccaaccuugauaucauuggacagcggaucgaaaauauuaagcaugagcacaaauccaccuggcauuacgacgaggauaaccccuauaagacaugggcuuaccacggcagcuaugaagucaaacccucuggguccgccagcuccaugguuaauggaguggugaagcugcucaccaagccuugggacgucauccccauggugacacaaaucgcuaugaccgauacgacaccuuuuggccagcagcgcguuuucaaagagaagguggacaccagaaccccgaaagccaagcggggcacagcgcaaauuauggaagucacggccaaauggcuguggggguuucuuagcagaaacaagaagccccggaucuguacccgcgaggaguucacaagaaaagugcggucuaaugcugccauuggagcuguuuuuguggacgagaaccaguggaauagcgccaaggaggccgucgaagaugagcgcuucugggaccuggugcauagagaacgggagcuccacaaacagggcaagugcgcgaccugcguuuacaacaugauggggaaacgcgaaaagaagcugggagaguuuggcaaagcuaagggguccagagccaucugguacauguggcugggcgcccgguuccucgaguucgaagcucugggauuuaugaaugaggaucacugguucucucgcgaaaacagccuuuccggcguggagggggagggacugcauaaacucggcuauauucugagagacaucucuaagaucccugggggaaauauguacgccgaugacacagcuggcugggauacccggauuacagaagacgaucuucagaacgaggcccgcaucaccgacauuauggaacccgagcacgcgcugcucgccaaaagcaucuuuaagcugacguaucaaaauaaagucgugagaguccaguccccugcuaagaacgggaccgugauggauguuauuucucggcgcgaccagagaggcagcggacaggugggcacauacgggcugaauaccuucacaaacauggaagcccaacucauccggcagauggaguccgagggaaucuuuagccccucugaacuggagaccccgaaccuugcugaaagaguccuggauuggcucgagaaguauggcguggaacgccugaaacggauggccauuuccggggacgacugugugguuaagccuaucgaugacagauucgcgacggcccuuacagcucugaaugauaugggaaaagugcgcaaggacauuccccagugggagccuagcaaaggcuggaacgauuggcagcaaguccccuuuugcucucaucacuuccaccagcucaucaugaaggacgggcgggagauugugguuccuuguagaaaucaggaugaacuggugggccgcgcccgggucucccagggagcuggcuggagccugagagagaccgccugccucgggaaguccuacgcucaaauguggcagcugauguauuuucaucgccgggaccuuagacuggccgcgaacgccaucuguucugcugugcccgucgauuggauuccgacaagccgcaccacgugguccauccacgcccaucaccaguggaugaccacagaagacaugcucagcguguggaaucggguuuggaucgaggaaaacccuuggauggaggauaaaacccauauuucuuccuggggagacgugcccuaccugggcaagagagaggaccaauggugcgggagccuuaucggacugacagcccgggcuaccugggccacaaauauucaggucgcgaucaaccaggugagacgccucauuggcaaugaaaacuaccuggauuauaugaccucuaugaaacgguucaagaaugagagcgaccccgaaggggcucugugguga

SEQ ID NO: 18890 - RNA, 9879 nt, Artificial Sequence
  derived and/or modified CDS sequence (opt5) from DENV-1__FJ410194__SS-prME
agcgugaccaugcugcucaugcugaugcccaccgcccuugcuuuccaccugacgaccagaggaggggaaccucauaugaucgucuccaagcaggaacggggaaaaucucuccuguuuaagaccagcgccggcguuaacaugugcacccuuauugcgauggaccugggggaacucugugaagauaccaugaccuacaaaugccccagaaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccaggccgcgggaccuuggcaucucggcaaacuggagcuugauuuugaccugugcgaagggacgaccgugguuguggaugagcacugcggaaaccggggccccagccucagaacaaccacagucaccggcaagaucauccacgaaugguguugccgguccuguacgcugccuccccugcgcuucagaggggaggacggaugcugguauggcauggagauucggccggugaaagaaaaggaggaaaaucuuguuaagagcauggugucugcuggguccggagaggucgacagcuuuucccucggccugcuguguaucucuauuaugaucgaagaggugaugagaagccgcuggucccggagaaugcucaugacagggacccuggccguuuucuuucuucugauuaugggacagcucacauggaacgaucugauccgccugugcauuauggugggcgccaaugcuucugacagaaugggcauggggaccaccuaccuugcccugauggcgacauucaaaaugcggccuauguuugcugucggacuccuguuccgcagacucacgagccgggaggugcugcuucugaccaucggccucucccugguggccucugucgaacugcccaacagccuugaggaacugggggauggacucgccaugggcaucaugauucugaagcuccugacagacuuucaaucccaucagcuuugggcuacccugcucagccugacauucaucaaaaccacguuuucucugcacuaugccuggaagacaauggcuaugguucuuuccauugugagccuguucccccucugucugucuaccaccucccagaaaacaaccuggcucccugugcugcuugggagccugggaugcaagccgcugacaauguuucucaucgccgagaauaagauuuggggccgcagaucuuggccccugaacgaaggcaucauggcggucgggaucguguccauucuucugagcucccuccugaaaaacgauguuccucucgccggaccccugaucgcuggcgggaugcuuauugccuguuacgugaucagcggaucuagcgcugaccugucccuggagaaggccgccgaggucucuugggaagaggaagcugagcauagcggcgcgucccacaauauucucguggaaguucaggaugacgggacgaugaaaaucaaggaugaggagcgggacgauacccugacaauccuucugaaagccacccuccuggcugugucuggagucuauccucucagcauucccgccacacuguucgugugguacuucuggcaaaagaaaaagcagcgcuccggcguccuuugggacaccccuucucccccggaaguggagagagccguucuggaugacggcaucuaucggauuaugcagcgcgggcugcucggaagaagccaggugggcgucgggguguuucaagaaaacguuuuccauacgauguggcacgugacccggggagcuguccugauguaccagggcaagagacuugagccuuccugggccagcgugaaaaaggaccugaucucuuacgggggaggcuggcgccuccagggcuccuggaauacaggggaggaagugcagguuauugcggucgagcccggcaagaacccuaagaaugugcaaaccgcucccggcacauuuaaaaccccggaaggggaggugggagccaucgcccuggauuucaagccuggcacaagcgggucucccauugucaaccgggaaggaaagaucgugggccucuauggcaaugggguugugacgaccuccggaacauacgucagcgcuaucgcccaggcgaaggcuucccaggagggcccucugcccgagauugaagacgagguguuuagaaagcgcaaccuuaccaucauggaucugcaccccgggucuggaaaaacccggagauaucugccugccauuguucgcgaagccaucaagcggaaacucagaacacugauucuugcuccgacgcgcguggucgccagcgagauggcugaagcccugaagggcaugcccauccgguaccaaaccacagcggugaaguccgagcauaccgggaaagagaucguugaccucaugugccacgccacauucaccaugagacugcugagcccugugcggguccccaauuauaacaugauuaucauggaugaagcucauuuuacggacccuucuuccauugccgcucgcggcuacaucagcacaagagugggaaugggcgaggccgccgcuauuuucaugaccgcgacacccccugggucuguggaagccuuuccgcagagcaaugcugucauccaggaugaggaacgggacauccccgagcgcuccuggaacucuggauaugaguggauuacagauuucccuggcaagaccguuugguuugugcccagcaucaaauccgggaaugacauugccaacugucucagaaagaauggaaaacgggugauccagcuuucuagaaagacauucgauaccgaauaccaaaagacgaaaaacaacgacugggacuacgucgugacaaccgauauuagcgagaugggcgccaauuuccgcgcugaccggguuaucgauccuagacgcugccugaagcccgugauucugaaagacgggccggaacgggucauccucgccggcccuaugcccgugacaguugcguccgcugcccagagacgcggacggaucggcagaaaccacaauaaggagggggaucaguauauuuacaugggacagccccugaacaaugacgaggaucaugcccacuggaccgaagcuaaaaugcuucuggacaacaucaauacgccugagggcauuauccccgcccucuuugaaccugagcgcgaaaagagcgcggccauugauggggaguauagacugcggggagaggcucgcaagaccuucguggaacugaugagacggggcgaccucccggucuggcuuucuuacaaaguggccuccgagggguuucaauauagcgaucgcagauggugcuucgacggcgaacggaacaaucagguccuggaggaaaacauggauguggagaucuggacaaaggagggagaacgcaagaaacugcgcccccgguggcucgacgcuagaaccuacuccgacccucuggcccuucgcgaguuuaaagaguucgcugccggccggagaucuguuagcggggaucugauccucgagauuggaaagcugccccagcaccugacacagcgggcgcaaaaugcccucgacaaccuugugaugcugcauaauuccgaacagggcgggcgcgcuuauagacacgccauggaggagcugccugauaccaucgaaacacucaugcugcuugcucugauugccgugcucaccggaggcgucacgcuguuuuuccugucuggccgggggcucggaaaaacaagcaucggccuucuguguguuauggccuccagcgugcugcucuggauggcuucuguggagccccauuggauugcggccuccaucauccuggaauuuuuccuuaugguccugcucauuccggagccugaccgccagagaacaccccaggauaaccaacuggcuuacgugguuaucgggcugcucuuuaugauucuuaccguggccgccaaugagaugggacugcuggaaacaaccaagaaggaccucggcaucgggcacgucgcuguggagaaccaccaucacgccgcgaugcuggaugucgaccuucauccugccagcgcuuggacacuguacgccguggcuacgaccauuaucacacccaugaugcggcacaccauugaaaacacaaccgccaauaucucucucacggcgaucgccaaccaggcugccauucugaugggacuggauaaaggcuggccuaucuccaagauggacauuggcguuccccuccuugcucuggggugcuauagccaggugaauccgcugacccucacagccgcuguccugaugcuuguggcccauuacgcgaucauuggaccuggccugcaagccaaagcuacccgcgaggcccagaagagaacagcugccgggaucaugaaaaaccccaccguugauggaaucguggccauugaccucgaucccgucguguaugacgcgaaguucgaaaagcagcugggccagaucaugcugcucauucuuuguacgucucaaauccugcugaugcggacaaccugggcucucugcgagagcauuacacuggccaccgggccucuuaccacacugugggagggauccccgggcaaauuuuggaauacgaccaucgcugugucuauggccaacaucuuccgcggcagcuaccucgccggggcuggacuggccuucucccugaugaaaagccucggcgggggaagacggggcacaggggcgcagggagaaacccuuggcgagaaauggaagagacagcugaaucagcuguccaaaucugaauuuaacacauauaagcgcagcggcauuauggagguugaccgguccgaagccaaggaggggcucaaaagaggagagaccacgaagcacgcugucucucgcggcacagccaaacugcggugguucguggaaagaaaucuugugaagcccgaggggaaagucaucgaucugggauguggccgcgggggauggagcuacuauugcgcuggccucaagaagguuaccgaagugaaaggcuacaccaaaggcgggccugggcacgaggaacccauuccuauggccacauacggguggaaccuggugaaacugcccuccggaaaggacgucuuuuucaucccuccggagaaaugugauacccuccuuugcgacauuggcgagucuagccccaauccuacaaucgaagaggggcggacgcugagagugcugaagaugguugaacccuggcuccgcggaaaccaauuuuguauuaaaauccugaauccuuauaugcccuccguggucgagacccuugagcagaugcagcggaagcauggcggcaugcuggugagaaacccgcucagccgcaauucuacacacgaaauguacuggguuuccugcgggaccggaaacaucgugagcgcggucaauaugacaucucggaugcugcugaacagauucaccauggcccaucgcaagccuacguaugagagagauguggaccucggcgcugggacccggcacguggccgucgaacccgagguugcuaaccuggauauuaucggacagcgcauugaaaauaucaaacacgagcauaaguccacauggcacuacgacgaggauaaccccuauaaaaccugggccuaccauggcagcuaugaagugaagccuucuggguccgcuagcuccauggugaauggagucgugaaacuucugacaaagcccugggacguuauuccuauggugacccaaaucgccaugacagauaccacgccguuuggccagcagagagucuucaaggagaaaguggacacacggacccccaaggcgaaaagaggcaccgcccaaaucauggaaguuacagcuaaguggcucuggggguuucugagccggaacaaaaagccucgcauuuguacgagagaggaguucacccggaaggugcgcucuaaugccgcuaucggagccgucuuuguggacgagaaccaguggaauagcgccaaagaggcgguugaagaugagagauucugggaccuugugcaccgggaacgcgagcugcauaagcagggcaaaugcgcuacaugcgucuacaacaugauggggaagagagagaaaaagcucggagaguuuggcaaggccaaagggucccgggccauuugguacauguggcugggcgcucgcuuccuggaguucgaagcccucggauuuaugaaugaggaucacugguucucuagagaaaacagccuguccggcguggagggggagggacuucacaagcugggcuauauccuccgggacauuucuaaaauccccgggggaaauauguacgcugaugacaccgccggcugggauacacgcaucaccgaagacgaucugcagaacgagccuagaauuacagacaucauggaacccgagcaugcgcuucuggccaagagcauuuuuaaacucaccuaucaaaauaaggucgugcggguucaguccccggcuaaaaacgggacggugauggaugucaucucucgcagagaccagcggggcagcggacaggugggcaccuacgggcugaauacauucaccaacauggaagcccaacugauuagacagauggaguccgagggaaucuuuagcccuucugaacucgagacacccaaccuggcugaacgcgugcuugauuggcuggagaaguauggcguugaacggcucaagagaauggccaucuccggggacgacuguguggucaaaccuauugaugaccgcuucgcgaccgcccugacggcucuuaaugauaugggaaaggugcggaaagacaucccccagugggagccuagcaagggcuggaacgauuggcagcaaguucccuuuuggucucaccauuuccaccagcugauuaugaaagacgggagagagaucguggucccgugccgcaaucaggaugaacucgugggccgggccagagucucccagggagcuggcuggagccugcgcgagacagccugucuggcuaaguccuacgcccaaauguggcagcucauguauuuucaccggagagaccugcgccuugcggccaacgcuauuugcucugccgugccuguugauuggauccccaccagccggacaaccugguccauucaugcccaccaucaguggaugacgaccgaagacaugcugagcguguggaauagagucuggaucgaggaaaaccccuggauggaggauaagacacacaucucuuccuggggagacgugccuuaccucggaaaacgggaggaccaaugguguggcagccugauugggcuuaccgcuagagccacaugggcgaccaauauccagguugcuauuaaccaggugcgccggcugaucggaaaugaaaacuaccucgauuauaugacaucuaugaagagauucaaaaaugagagcgacccggaaggcgcccugugguga

SEQ ID NO: 18891 - RNA, 9879 nt, Artificial Sequence
  derived and/or modified CDS sequence (opt5) from DENV-1__FJ432725__SS-prME
agcgugaccaugcugcugaugcugaugcccaccgcccuugcuuuccaccugacgaccagaggaggggaaccucauaugaucgucuccaagcaggaacgggggaaaucucuccuguuuaagaccagcgccggcguuaacaugugcacccuuauugcgauggaccugggggaacucugugaagauaccaugaccuacaaaugccccagaaucacagaaaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccaggccgcgggaccuuggcaucucggcaaacuggagcuugauuuugaccugugcgaagggacgaccgugguuguggaugagcacugcggaaaccggggccccagccucagaacaaccacagucaccggcaagaucauccacgaaugguguugccgguccuguacgcugccuccccugcgcuucagaggggaggacggaugcugguauggcauggagauucggccggugaaagaaaaggaggaaaaucuuguuaagagcauggugucugcuggguccggagaggucgacagcuuuucccucggccugcuguguaucucuauuaugaucgaagaggugaugagaagccgcuggucccggagaaugcucaugacagggacccuggccguuuucuuucuucugauuaugggacagcucacauggaacgaucugauccgccugugcauuauggugggcgccaaugcuucugacagaaugggcauggggaccaccuaccuugcccugauggcgacauucaaaaugcggccuauguuugcugucggacuccuguuccgcagacucacgagccgggaggugcugcuucugaccaucggccucucccugguggccucugucgaacugcccaacagccuugaggaacugggggauggacucgccaugggcaucaugauucugaagcuccugacagacuuucaaucccaucagcuuugggcuacccugcucagccugacauucaucaaaaccacguuuucucugcacuaugccuggaagacaauggcuaugguucuuuccauugugagccuguucccccucugucugucuaccaccucccagaaaacaaccuggcucccugugcugcuugggagccugggaugcaagccgcugacaauguuucucaucgccgagaauaagauuuggggccgcagaucuuggccccugaacgaaggcaucauggcggucgggaucguguccauucuucugagcucccuccugaaaaacgauguuccucucgccggaccccugaucgcuggcgggaugcuuauugccuguuacgugaucagcggaucuagcgcugaccugucccuggagaaggccgccgaggucucuugggaagaggaagcugagcauagcggcgcgucccacaauauucucguggaaguucaggaugacgggacgaugaaaaucaaggaugaggagcgggacgauacccugacaauccuucugaaagccacccuccuggcugugucuggagucuauccucucagcauucccgccacacuguucgugugguacuucuggcaaaagaaaaagcagcgcuccggcguccuuugggacaccccuucucccccggaaguggagagagccguucuggaugacggcaucuaucggauuaugcagcgcgggcugcucggaagaagccaggugggcgucgggguguuucaagaaaacguuuuccauacgauguggcacgugacccggggagcuguccugauguaccagggcaagagacuugagccuuccugggccagcgugaaaaaggaccugaucucuuacgggggaggcuggcgccuccagggcuccuggaauacaggggaggaagugcagguuauugcggucgagcccggcaagaacccuaagaaugugcaaaccgcucccggcacauuuaaaaccccggaaggggaggugggagccaucgcccuggauuucaagccuggcacaagcgggucucccauugucaaccgggaaggaaagaucgugggccucuauggcaaugggguugugacgaccuccggaacauacgucagcgcuaucgcccaggcgaaggcuucccaggagggcccucugcccgagauugaagacgagguguuuagaaagcgcaaccuuaccaucauggaucugcaccccgggucuggaaaaacccggagauaucugccugccauuguucgcgaagccaucaagcggaaacucagaacacugauucuugcuccgacgcgcguggucgccagcgagauggcugaagcccugaagggcaugcccauccgguaccaaaccacagcggugaaguccgagcauaccgggaaagagaucguugaccucaugugccacgccacauucaccaugagacugcugagcccugugcggguccccaauuauaacaugauuaucauggaugaagcucauuuuacggacccuucuuccauugccgcucgcggcuacaucagcacaagagugggaaugggcgaggccgccgcuauuuucaugaccgcgacacccccugggucuguggaagccuuuccgcagagcaaugcugucauccaggaugaggaacgggacauccccgagcgcuccuggaacucuggauaugaguggauuacagauuucccuggcaagaccguuugguuugugcccagcaucaaauccgggaaugacauugccaacugucucagaaagaauggaaaacgggugauccagcuuucuagaaagacauucgauaccgaauaccaaaagacgaaaaacaacgacugggacuacgucgugacaaccgauauuagcgagaugggcgccaauuuccgcgcugaccggguuaucgauccuagacgcugccugaagcccgugauucugaaagacgggccggaacgggucauccucgccggcccuaugcccgugacaguugcguccgcugcccagagacgcggacggaucggcagaaaccacaauaaggagggggaucaguauauuuacaugggacagccccugaacaaugacgaggaucaugcccacuggaccgaagcuaaaaugcuucuggacaacaucaauacgccugagggcauuauccccgcccucuuugaaccugagcgcgaaaagagcgcggccauugauggggaguauagacugcggggagaggcucgcaagaccuucguggaacugaugagacggggcgaccucccggucuggcuuucuuacaaaguggccuccgagggguuucaauauagcgaucgcagauggugcuucgacggcgaacggaacaaucagguccuggaggaaaacauggauguggagaucuggacaaaggagggagaacgcaagaaacugcgcccccgguggcucgacgcuagaaccuacuccgacccucuggcccuucgcgaguuuaaagaguucgcugccggccggagaucuguuagcggggaucugauccucgagauuggaaagcugccccagcaccugacacagcgggcgcaaaaugcccucgacaaccuugugaugcugcauaauuccgaacagggcgggcgcgcuuauagacacgccauggaggagcugccugauaccaucgaaacacucaugcugcuugcucugauugccggagugaccggcggcgucacgcucguuuuucugucugggcggggacugggcaaaacaagcaucgggcuccuuugugugauggccuccagcgugcugcuguggauggcuucugucgagccccauuggauugcggccuccaucauccucgaguucuuucugauggugcuucugauuccggagccugaccgccagagaacaccccaggauaaccaacucgcuuacguugugaucggacugcuguucaugauucucaccgucgccgccaaugagaugggccuucuggaaacaaccaagaaggaccuggggaucggacacguggcugucgagaaccaccaucacgccgcgaugcucgauguggaccugcauccugccagcgcuuggacacuuuacgccguugcuacgaccauuaucacacccaugaugcggcacaccauugaaaacacaaccgccaauaucucucugacggcgaucgccaaccaggcugccauucucaugggccuggcuaaaggcuggccuaucuccaagauggauauuggggugccccugcucgcccuuggaugcuauagccaggucaauccgcugacccugacagcuccugugcucaugcugguugcccauuacgcgaucauuggccccgggcuucaagccaaagcuacccgcgaggcccagaagagaacagcugccggaaucaugaaaaaccccaccguggacggcaucgucgccauugaucuggacccugugguguaugaugcgaaguuugaaaagcagcucgggcagaucaugcugcugauucucuguacgucucaaauccuucugaugcggacaaccugggcucugugcgagagcauuacacucgccaccggaccgcugaccacacuuugggagggcucccccggcaaauucuggaauacgaccaucgcuguuucuauggccaacaucuuucgcgggagcuaccuggccggagcuggccucgccuucucccugaugaaaagccucgggggcgggagacgggggacaggagcgcagggcgaaacccucggcgagaaauggaagagacagcuuaaucagcuguccaaaucugaguucaacacauauaagcgcagcgggauuauggaggucgaccgguccgaagccaaggagggacugaaaagaggcgagaccacgaagcacgcugugucucgcgggacagccaaacuccggugguuuguggaaagaaaucuggucaagccugagggaaaaguuaucgaccuuggcugugggcgcggaggcuggagcuacuauugcgcuggccugaagaaggugaccgaagugaaaggguacaccaagggaggccccgggcacgaggaaccuauucccauggccacauacggauggaaccucgucaaacugcauuccggcaaggauguguucuuuaucccuccggagaaaugugacacccugcucugcgauauuggggagucuagccccaauccuacaaucgaagagggacggacgcuuagaguucugaagaugguggaacccuggcugcgcggcaaccaauucuguauuaaaauccucaauccuuauaugcccuccgucguggagacccuggagcagaugcagcggaagcacggcgggaugcuuguuagaaacccgcugagccgcaauucuacacaugaaauguacuggguguccugcggaaccggcaacaucgucagcgcggugaauaugacaucucggaugcuccugaacagauuuaccauggcccaccgcaagccuacguaugagagagacguggaucugggggcuggaccccggcacgucgccguugaacccgagguggcuaaccucgacauuaucggccagcgcauugaaaauaucaaacaugagcacaaguccaccuggcauuacgaugaggacaacccuuauaaaacaugggccuaccacgggagcuaugaagugaagcccucuggauccgcuagcuccauggucaauggcgugguuaaacugcuuaccaagccuugggaugugauuccgauggucacacaaaucgccaugaccgacacaacccccuucggccagcagagaguguuuaaggagaaaguugauacgcggacaccuaaggcgaaaagagggaccgcccaaaucauggaagugaccgcuaaguggcuguggggauuccucagccggaacaaaaagccccgcauuuguacaagagaggaauuuacgcggaagguccgcucuaaugccgcuaucggcgccguguucguugacgagaaccaguggaauagcgccaaagaggcgguggaagacgagagauuuugggaucuggggcaucgggaacgcgagcuucacaagcagggaaaaugcgcuaccugcgucuccaacaugaugggcaagagagagaaaaagcugggggaguucggcaagccuaaaggaucucggcccauuugguacauguggcucggcgcccgcuuucuggaguucgaagcccugggguucaugaaugaggaccacugguuuagcagagaaaacucccucucuggaguggagggcgaggggcugcauaaacuuggauacauccugcgggauauuagcaaaaucccgggcgggaauauguaugcugacgauacagccggcugggacacccgcaucacagaagaugaccuccagaacgaggcuagaauuaccgauaucauggaaccugagcacgcccugcuugcgaaguccauuuucaaacugacauaccaaaauaaggucgugcggguucagcgccccgccaaaaacggaaccgugauggacgucaucucuagcagagaucagcggggcuccggacaggugggaacguauggccucaauaccuuuacaaacauggaagcucaacugauuagacagauggagagcgaggggaucuucucuccuuccgaacuggagacccccaaccucgccgaacgcgugcuggacuggcuugagaaguacggaguugaacggcugaagagaauggcuaucagcggcgaugacuguguggucaaaccuauugacgaucgcuuugccacagcgcucaccgcccugaaugacauggggaaggugcggaaagauaucccccagugggagccgucuaagggcuggaacgacuggcagcaaguuccuuucugcucccaucacuuucaccagcuuauuaugaaagauggaagagagaucgugguccccugucgcaaucaggacgaacuggugggccgggcuagagucagccagggggccggauggucccuccgcgagacggcuugccugggcaagucuuaugcccaaauguggcagcugauguacuuccaucggagagaucuccgccuggcugccaacgcgauuuguagcgccgugcccguugacuggaucccuacaucccggaccacauggagcauucacgcucaucaccaguggaugaccacggaagauaugcuuucuguguggaauagagucuggaucgaggaaaacccguggauggaggacaagacccauaucuccagcuggggagaugugcccuaucugggaaaacgggaggaccaauggugcggcucucucauugggcugacagccagagccaccugggcuacaaauauccagguugccauuaaccaggugcgccggcuuaucggcaaugaaaacuaccuggacuacaugaccagcaugaagagauuuaaaaaugaguccgauccugaaggagcgcucugguga

SEQ ID NO: 18892 - RNA, 9879 nt, Artificial Sequence
  derived and/or modified CDS sequence (opt5) from DENV-1__FJ432729__SS-prME
agcgugaccaugcugcucaugcugaugcccaccgcccuugcuuuccaccugacgacccggggcggggagccucauaugaucgucacaaagcaggaacggggaaagucccuccuguuuaagaccucugccggcguuaacaugugcacacuuauugccauggaccugggggagcucugugaagauaccaugacauacaagugcccccgcaucaccgaggcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugucauugggaccuccaucacccagaagggaaucauuuucauccuccugaugcuugugacaccuucuauggccaugagaugcguuggcauugggagccgggauuuuguggagggacuguccggcgcuacgugggucgacguggugcucgagcacgggagcugugucaccacaauggccaaggauaaacccacccuggacaucgaacugcucaagacagagguuaccaacccugcugugcugcgcaaacuuugcauugaagccaagaucucuaauacgacaaccgauuccagauguccgacccaaggagaggcgacacugauggaagaacaagacgccaacuucgugugccggcgcaccuuugucgauagaggcuggggcaauggguguggacucuucggcaaagggagccugauuacaugcgcuaaguuuaagugcgugacgaaacuugagggaaagaucguucaguacgaaaaccugaaauauucugugaucgucaccgugcacacaggcgaccagcaucaaguugggaaugaguccaccgaacacggaacaauugccaccaucacgccccaggcuccuaccagcgagauucagcucacagacuacggcgcccugacccuggauuguucuccccggacaggccucgacuucaacgaaauggugcugcuuaccaugaaggagaaauccuggcugguccauaagcagugguuucucgaucugccucuucccuggacgagcggggccuccacaucucaagagaccuggaaucgccaggaccugcucgugacauucaaaaccgcucacgcgaagaagcaggaagucgugguucugggaagccaagagggcgccaugcacaccgcucugacaggggccacggaaauccagaccuccggaacaaccacaauuuuugccggccaucucaaaugcagacugaagauggauaaacuuacccugaaggggaugagcuaugugauguguacgggcucuuucaaacucgagaaggaagucgcugagacacagcacggaaccgugcugguucagaucaaguacgagggcaccgacgccccgugcaaaaucccuuucuccacacaagaugaaaagggggugacccagaacggacggcugauuacagcgaaucccaucgucacggacaaagagaagccugugaacauugaagcugagccgcccuuuggcgagagcuauaucgugauuggggccggagaaaaagcccuuaagcucucuugguucaagaaaggcagcuccaucgggaagauguuugaggcuaccgccagaggcgcucgccggauggccauccugggagauacagcgugggacuucggcucuauugggggaguuuuuaccagcgucggcaaacuggugcaucagaucuucgggacagccuacggagugcucuuuuccggcgucagcuggaccaugaagauugggaucggcgugcugcuuacguggcugggacucaauucuagauccaccagccugucuaugacauguauugcuguuggccuggugacccuuuaccucggggucauggugcaggccgauuccggaugcguuaucaacuggaaaggccgcgaacugaagugugggagcggaauuuucgugacaaaugagguccacaccuggacagaacaauauaaguuucaggcugacuccccuaaacggcugucugccgcgaucggcaaggccugggaggagggggugugcggcaucagaagcgcuacccgccucgaaaacauuauguggaaacagaucuccaacgagcugaaucauauucuucuggaaaacgacaugaaguucacgguuguggucggagauguggugggcauccucgcccaggggaaaaagaugauucggccgcaacccauggagcacaaauacucuuggaaaagcuggggaaaggcuaagaucaucggcgccgacguccagaauacaaccuuuauuaucgaugggccuaacacccccgaauguccugacgaucagagagccuggaauauuugggagguugaggacuauggauucggcaucuuuacaaccaacauuuggcugaagcugcgcgauucccacacacaggugugcgaccaucggcuuaugagcgcugcgaucaaagauucuaaggccgugcacgcugacaugggcuacuggaucgaauccgagaaaaaugaaacauggaagcucgccagagccagcuucauugaggucaagaccuguaucuggcccaaaucucauacacugugguccaacggggugcuggaaagcgagaugauuaucccgaagauuuauggaggcccuaucucucaacacaauuaccgccccggguauuucacccagacagcuggaccuuggcaccucggcaaacuggagcuugauuuugaccugugcgaagggaccacgguuguggucgaugagcauugcggaaaccggggccccagccucagaaccacaaccgugacaggcaagaucauucacgaaugguguugccgguccuguacccugccuccccugcgcuucaaaggggaggacggaugcugguacggcauggagaucagaccgguuaaggaaaaggaggaaaaucuugugaaaagcauggucucugccggguccggagagguggacagcuuuucccucggccugcuguguauuucuaucaugauugaagagguuaugcggagcagauggucccgcaagaugcucaugacggggacacuggcgguguuccuucugcucaucaugggacagcugaccuggaacgaucugauucggcuuugcaucauggucggcgcuaaugccucugacagaaugggcauggggacaaccuaccuggcccucauggcuaccuuuaaaaugcgcccuauguucgccgugggacugcucuuuagacggcugacaagccgcgaggugcuucugcucacgaucggccugucccuggucgcgucuguugaacuucccaacagccuggaggaacucggggauggacuggcuaugggcauuaugauccucaagcugcuuaccgacuuccaaucccaucagcugugggccacacuccugagccugaccuuuauuaaaacaacccuuucucugcacuaugccuggaagacgauggcuauggugcucuccaucgugagccuguucccccucugucugucuacaaccucccagaagaccacauggcuuccuguccugcuggggagccucggaugcaaaccgcuggccaugcuucugauugcugagaauaagaucuggggcagaaaaucuuggccccucaacgaaggcaucauggccguggggguuguguccauucugcucagcucccugcuuaagaacgaugucccucuggcgggaccccugaucgccggcgggaugcucauugcuuguuacgugaucagcggaucuagcgccgaccugucccuugagaaagcugccgagguuucuugggaagaggaagccgagcauagcggcgcuucccacaauauucugguggaaguccaggaugacgggaccaugaagaucaaagaugaggagcgggacgauacacucacgauccugcucaaggcgacccugcuugccgugucuggagucuauccucugagcauucccgcuacacuguuugugugguacuucuggcaaaagaaaaagcagcgcuccggcguucucugggacaccccuucucccccggaaguggagagagccguccuggaugacggcaucuaucggauuaugcagcgcgggcuucugggaagaagccaggugggcguugggguguuucaagaaaacgucuuccacacaauguggcaugugacccggggagccgugcucauguaccagggcaaacgccuggagccuuccugggcuagcguuaagaaagaccucaucucuuaugggggaggcuggagacugcagggcuccuggaauacgggggaggaaguccaggugauugccguggagcccggaaagaacccuaagaauguccaaaccgcgcccggcacauucaaaaccccggaaggggaggugggagcuaucgcccuugauuuuaagccuggcacaagcgggucucccauuguuaaccgggaaggaaaaaucgugggccuguacggcaauggggucgugaccacauccggaacguacguuagcgccaucgcucaggccaaggcgucccaggagggcccucugcccgagauugaagacgagguguucagaaaacgcaaccucaccaucauggaucugcaccccgggucuggaaagacacggagauaucuuccugcuauuguccgcgaagccaucaagcggaaacugagaacccucauucuggccccgacccgcgugguugcuagcgagauggccgaagcucugaagggcaugcccauccgguaccaaacaacggccgugaaauccgagcauaccgggaaggagaucgucgaccucaugugccacgcgacauuuaccaugagacuucugagcccugugcgcgugcccaauuauaacaugauuaucauggaugaagcccauuucacagacccuucuuccauugcugcccggggcuacaucagcaccagagucggaaugggcgaggcugccgccauuuuuaugacggcuacacccccugggucuguugaagcguucccgcagagcaaugccgugauccaggaugaggaacgggacauccccgagcgcuccuggaacucuggauaugaguggauuaccgauuuuccuggcaaaaccgugugguucguccccagcaucaaguccgggaaugacauugcuaacugucugagaaagaauggaaaacgggugauccagcucucucgcaagacauuugauaccgaauaccagaagacgaagaacaacgacugggacuauguugugaccacggauauuagcgagaugggcgccaauuucagagccgaccgggucaucgauccuagacgcugccugaaacccgugauucuuaaggacgggccggaacggguuauccuggcuggcccuaugcccgugacagucgccuccgcggcucagagacgcggacggaucggcagaaaccacaauaaggagggggaucaguacauuuacaugggacagccccucaacaaugacgaggaucacgcccauuggaccgaagccaaaaugcugcuggacaacaucaauacaccugagggcauuauccccgcucucuuugaaccugagcgcgaaaagagcgccgcgauugauggggaguaucggcuuagaggagaggcccgcaaaaccuucguggaacugaugagacggggcgaccugccggucuggcucucuuacaagguggcuuccgagggguuccaauauagcgaucgcagauggugcuuugacggcgaacggaacaaucagguucuggaggaaaacauggauguggagaucuggacgaaagagggagaacgcaagaaacuuagaccccgguggcuggacgccagaaccuacuccgacccucucgcucugcgcgaguucaaggaauuugccgcuggccggagaucugugagcggggaucugauccucgagauuggaaaacuuccccagcaccugacacagcgcgcccaaaaugcgcuggacaaccucgucaugcugcauaauuccgaacagggcgggcgggccuauagacacgcuauggaggagcuuccugauaccaucgaaacacugaugcuccuggcccugauugcuguucucaccggaggcgugacacuuuucuuucugucuggccgggggcugggaaaaaccagcaucggccuccugugugugauggccuccagcguccuucuguggauggccucuguggagccccacuggauugcugcguccaucauccucgaguucuuucugaugguucugcucauuccggagccugaccgccagagaacgccccaggauaaccaacuugccuacguggucaucgggcugcuguucaugauucucacaguggcugccaaugagaugggacugcuugaaaccaccaagaaagaccugggcaucgggcaugucgccguggagaaccaccaucacgcuacaaugcucgauguugaccugcauccugccagcgcguggacccuguaugccguggcuacaacgauuaucacccccaugaugcggcacacaauugaaaacaccacagccaauaucucucucaccgcuaucgccaaccaggcggccauucuuaugggacuggauaagggcuggccuaucuccaaaauggacauuggcgucccccugcucgcucuggggugcuacagccaggugaauccgcuuacgcugaccgccgcuguucucaugcugguggcccacuacgcuaucauuggaccuggccugcaagccaaggcgacacgcgaggcccagaagagaaccgcugccgggaucaugaaaaaccccacagucgauggaaucguggcuauugaccucgaucccgugguuuaugacgccaaguuugaaaaacagcuuggccagaucaugcugcugauucucuguaccucucaaauccugcuuaugcggacgacaugggcccugugcgagagcauuacccucgcgacagggccucugaccacccugugggagggauccccgggcaaguucuggaauacaacgaucgcugucucuauggccaacaucuuucgcggcagcuaccucgcuggggccggacuugccuucucccugaugaaaagccugggcgggggaagacggggcaccggggcucagggagaaacacucggcgagaaguggaagcgccagcugaaucagcuuuccaaaucugaauuuaacauuuauaagagaagcggcaucauggagguggaccgguccgaagccaaagaggggcugaagagaggagagaccacacgccaugcggugucucggggcaccgccaaacucagaugguucgucgaacgcaaucugguuaagcccgaggggaaggugauugaucugggauguggcagagggggauggagcuacuauugcgcuggccucaaaaaggugacggaagucaaaggcuacacaaaagggggaccuggccacgaggaacccaucccuauggccaccuauggguggaaccuugugaaacugcauuccggaaaggacguuuucuuuacacccccugagaaaugugauacacugcucugcgacauuggcgagucuagcccgaaucccaccaucgaagaggggagaacacugcgcgugcuuaagauggucgaaccuuggcugcggggaaaccaauucuguauuaagauccucaaucccuacaugccuuccgugguugagacgcuggagcagaugcagagaaaacacggcggcaugcuggugcgcaacccccucagcagaaauucuacccacgaaauguacugggucuccugcgggacaggaaacaucgugagcgcugugaauaugaccucuagaaugcugcuuaaccgcuuuacaauggcccaucggaagccgaccuaugagagagaugucgaccugggcgcggggacgcgccacguugccguggaaccugagguggcuaaccucgauauuaucggacagagaauugaaaauaucaaacaugagcacaaguccaccuggcauuacgacgaggauaaccccuauaaaacaugggccuaccacggcagcuaugaagucaagcccucuggguccgcuagcuccauggugaauggaguugugaagcugcuuaccaaaccuugggacgucauucccauggugacacaaaucgccaugaccgauacaaccccuuucggccagcagcggguuuuuaaggagaaaguggacacgcgcacaccgaaggcuaaaagaggcaccgcccaaaucauggaagucaccgcgcgguggcuguggggguuccucagcagaaacaagaagccccggauuuguacacgcgaggaauuuacgagaaaagugcggucuaaugccgcuaucggagccguuuucguggacgagaaccaguggaauagcgcuaaggaggccgucgaagaugagcgcuuuugggaccuggugcagaaagaaagagagcugcacaagcagggcaaaugcgcgaccugcgucuacaacaugauggggaagcgggaaaagaaacucggagaguucggcaaggcgaaagggucccgcgcuauuugguauauguggcugggcgccagauuucuugaguucgaagcccugggauuuaugaaugaggaucauugguucucucgggaaaacagccucuccggcguggagggggagggacugcacaaacuuggcuacauccugcgcgacauuucuaaaaucccugggggaaauauguacgcugaugacacagccggcugggauaccagaaucacagaagacgaucuccaaaacgaggcucggauuaccgacaucauggaacccgagcaugcccugcuggcgacaagcauuuucaagcucaccuaucagaauaaaguugugcgcguccagagaccugccaagaacgggacggugauggaugugaucucccggcgcgaccagagaggcucuggacaaguuggcaccuacgggcugaauacauuuaccaacauggaagcucagcuuauucggcagauggagagcgagggaaucuuccugcccuccgaacucgagacacagaaccuggccgaaagagugcuugauuggcuggagaaguauggcgucgaacgccucaaacggauggcuaucagcggggacgacugugugguuaagccgauugaugacagauuugccaccgcgcugacggcccugaaugauaugggaaaagugcgcaaggacaucccucaaugggagcccucuaaaggcuggaacgauuggcagcaggucccuuucugcucccaccacuuucaucagcucauuaugaaggacgggcgggagaucgugguccccuguagaaaucaagaugaacuggugggccgcgcucggguuagccagggagccggcuggucucuuagagagacagcuugccuggggaaguccuacgcccagauguggcaacucauguauuuccaccgccgggaccugagacuugcugccaacgcgauuuguagcgccgugccugucgauugggugcccaccucccgcacaaccuggucuauccaugcucaccaucaguggaugacgaccgaagacaugcugagcguuuggaaucggguguggauugaggaaaacccguggauggaggauaaaacacacgucuccagcuggggagacgugccuuaccucggcaagagagaggaccaguggugcgggucucugaucggacugaccgcccgggccacaugggcuuccaauauccagguggccauuaaccaaguuagacgccucaucggcaaugaaaacuaucuggauuacaugaccagcaugaaacgguuuaagaaugagggggaccccgaaggcgcgcuuugguga

SEQ ID NO: 18893 - RNA, 9879 nt, Artificial Sequence
  derived and/or modified CDS sequence (opt5) from DENV-1__FJ432730__SS-prME
agcgugaccaugcugcugaugcugaugcccacagcccuugcuuuccaccugacgaccagaggcggggaaccucauaugaucgucuccaagcaggaacggggaaaaucucuccuguuuaagacaagcgccggcguuaauaugugcacccuuauugcgauggaccugggggaguucugugaagauacaaugaccuacaaaugcccgagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaugaccacaauuuucgcuggccaucugaagugcagacucaaaauggauaagcugacccuuaaagggaugucuuaugugauguguacgggcuccuucaagcuggagaaggaagucgccgagacacagcacggaaccgugcucguucagaucaaauacgagggcaccgacgcgccgugcaagauuccuuuuagcacacaggaugaaaaaggggugacccaaaacggacggcugaucacagcuaaucccaucgucacggacaaggagaaaccugugaacauugaagccgagccgcccuucggcgagucuuauaucgugauuggggccggagaaaaggcucugaaacuuagcugguuuaaaaagggcuccucuaucgggaaaauguucgaggccaccgcuagaggcgcccgccggauggcgauucucggagauacagccugggacuuuggcagcaucgggggaguuuucaccuccgucggcaagcuggugcaucagaucuuugggacagcuuacggagugcuguucagcggcgucucuuggaccaugaaaauugggaucggcgugcuccugacguggcuuggacucaauuccagaagcaccucucucuccaugacauguauugccguuggccuggugacccuguaccuuggggucauggugcaggcugauagcggaugcguuaucaacuggaagggccgcgaacucaaguguggguccggaauuuuugugacaaaugagguccacaccuggacagaacaguauaaauuccaagccgacucuccuaagcggcugagcgcggccaucggcaaggcuugggaggagggggugugcggcauuagauccgccacccgccuggaaaacaucauguggaagcagaucucuaacgagcucaaucauauucugcuugaaaacgacaugaaauuuacgguuguggucggagauguggcuggcauccuggcccaggggaagaaaaugauucggccgcagcccauggaguacaaguauagcuggaaguccuggggaaaagccaagaucauuggcgcugacgugcaaaauacaaccuucaucaucgaugggccuaacacccccgaauguccugacgaucagagagcguggaauauuugggaggucgaggacuacggauuuggcaucuucacaaccaacauuuggcucaaacugcgcgauagcuauacgcagguuugcgaccaccggcugaugucugccgcuaucaaggauuccaaagccgugcacgccgacaugggcuacuggauugaaagcgagaagaaugaaacauggaaacuugcuagagccucuuucaucgaggugaaaaccuguaucuggcccaagucccauacacucuggagcaacgggguccuggaaucugagaugauuaucccgaaaauuuauggaggcccuaucagccagcacaauuaccgccccggguacuuuacccaaacagcgggaccuuggcaucugggcaagcucgagcuggauuucgaccuuugcgaagggaccacggugguuguggaugagcacugcggaaaccggggccccucccugagaaccacaaccgucacaggcaaaauuauccacgaaugguguugccggagcuguacccucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacggggacacucgccgucuuuuuccugcuuaucaugggacagcugaccuggaacgaucucauucggcugugcaucauggugggcgccaaugcuagcgacagaaugggcauggggacaaccuaccuggcccuuauggcgaccuuuaagaugcgcccuauguucgcugucggacugcucuuuagacggcugacaucccgcgaggugcuccugcuuacgauuggccugucucucguggccagcgucgaacugcccaacucccuggaggaacuuggggauggacuggccaugggcaucaugauccucaaacugcucaccgacuuccagagccaucaacugugggcuacacuucugucucucaccuuuauuaagacaaccuucucccugcacuaugccuggaagacgauggcuaugguucugagcaucgugucucuuuuuccccugugucucuccacaaccagccagaaaaccacauggcugccugugcuccuggggucucuuggaugcaagccgcugaccauguuccugauugccgagaauaaaaucuggggcagaaaguccuggccccucaacgaaggcauuauggcggucgggaucgugagcauccugcuuuccagccugcucaaaaacgauguuccucuggccggaccccucauugcuggcgggaugcugaucgccuguuacgugauuucuggaagcuccgcugaccuuucucuggagaaggccgccgaggucagcugggaagaggaagcugagcauuccggcgcgucucacaauauccugguggaaguucaggaugacgggacaaugaaaauuaaggaugaggagcgggacgauacgcucaccauccugcuuaaggccacacugcucgcugugagcggagucuauccucuguccauccccgccacccucuucgugugguacuuuuggcagaaaaagaaacaacgcucuggcguccugugggacacaccuuccccucccgaaguggagagagccguucuugaugacggcauuuaucggaucaugcagcgcgggcugcugggaagaucccaggugggcgucgggguguuccaggaaaacguuuuucauaccauguggcacgugacgcggggagcuguccucauguaccaaggcaagcgccuggagcccagcugggccucugugaaaaaggaccuuauuuccuacgggggaggcuggagacugcagggcagcuggaauaccggggaggaagugcagguuaucgcggucgagcccggaaagaacccuaaaaaugugcagacagcucccggcaccuucaagacaucugaaggggaggugggagccauugcccucgauuuuaaaccgggcaccuccgggagcccuaucgucaaccgggaaggaaagauugugggccuguauggcaaugggguugugacaacguccggaaccuacgucucugcuaucgcccaagcgaaagcuagccaggagggcccccucccugagaucgaagacgagguguucagaaagcgcaaccugacaauuauggaucuucaccccggguccggaaagacccggagauaucugcccgccaucguucgcgaagccauuaaacggaagcugagaacccucauccuggcuccuacacgcguggucgccagcgagauggcugaagcccuuaaaggcaugccgauucgguaccagacgaccgcggugaagucugagcauacagggaaagagaucguugaccugaugugccacgccaccuuuacaaugagacuccugucccccgugcgcgucccuaauuauaacaugaucauuauggaugaagcucauuucaccgaccccagcucuaucgccgcucggggcuacauuagcacgagagugggaaugggcgaggccgccgcuaucuuuaugacagcgaccccucccggguccguggaagccuucccucaaucuaaugcugucauucaggaugaggaacgggacaucccggagcgcagcuggaacuccggauaugaguggaucaccgauuuucccggcaagacaguuugguucgugccuucuauuaagagcgggaaugacaucgccaacugucugcgcaagaauggaaagcgggugauucagcucucccgcaaaaccuucgauacagaauaccagaagaccaaaaacaacgacugggacuacgucgugacgacagauaucagcgagaugggcgccaauuuuagagcugaccggguuauugaucccagacgcugccuuaagccugugauccugaaggacgggcccgaacgggucauucuggccggcccgaugccugugaccguugcgucugcugcccaaagacgcggacggaucggcagaaaccacaauaaagagggggaucaguauaucuacaugggacagccccucaacaaugacgaggaucaugcccacuggacagaagcuaagaugcugcuugacaacauuaauacccccgagggcaucauuccugcccuguucgaacccgagcgcgaaaaauccgcggccaucgauggggaguaucggcucagaggagaggcucgcaagacguuuguggaacugaugagacggggcgaccugccugucuggcucagcuacaaaguggccuccgagggguuccaguauucugaucgcagauggugcuuugacggcgaacggaacaaucaaguccuugaggaaaacauggauguggagauuuggaccaaggagggagaacgcaaaaagcugagaccgcgguggcuggacgcuagaacauacagcgacccccucgcccugcgcgaguucaaggaauuugcugccggccggagauccguuucuggggaucuuauccuggagaucggaaaacucccucagcaccugacccagcgcgcgcagaaugcccuggacaaccucgugaugcuucauaauagcgaacaaggcgggcgggcuuauagacacgccauggaggagcugcccgauacaauugaaacccugaugcuccuggcucuuaucgccgugcugacaggaggcgucacccucuucuuucuguccggccgggggcugggaaagacgagcauuggccuccuuuguguuauggccucuuccgugcugcuguggauggcuagcguggagccucauuggaucgcggccucuauuauccucgaguucuuucugaugguccuucugauccccgagccggaccgccagagaacaccucaggauaaccagcucgcuuacgugguuauugggcugcuguucaugauccucaccguggccgccaaugagaugggacuucuggaaaccaccaagaaggaccugggcauugggcacgucgcuguggagaaccaccaucacgccgcgaugcucgaugucgaccugcaucccgccuccgcuuggacccuuuacgccguggcuacaacgaucauuaccccuaugaugcggcacacaaucgaaaacaccacagccaauauuagccugaccgcgaucgccaaccaagcugccauccucaugggacuggauaaaggcuggcccauuucuaagauggacaucggcguuccucugcucgcucuugggugcuauagccaggugaauccccugacgcugaccgccgcuguccucaugcugguggcccauuacgcgauuaucggaccgggccuucaggccaaggcuacacgcgaggcccagaagagaaccgcugccgggauuaugaagaacccuacaguugauggaaucguggccaucgaccuggaucccgucguguaugacgcgaaauuugaaaagcagcucggccagauuaugcugcugauccucuguaccucccagauucuucugaugcggacgacaugggcucugugcgagucuaucacccucgccacagggccccugaccacccuuugggagggaagcccuggcaaauucuggaauacaacgauugcuguguccauggccaacaucuuccgcggcagcuaccuggccggggcuggacucgccuuuucccugaugaagucucugggcgggggaagacggggcaccggggcgcaaggagaaacacucggcgagaaguggaaacgccagcuuaaucagcugagcaaguccgaguucaacaccuauaaaagaucuggcaucauggagguugaccggagcgaagccaaggaggggcugaaaagaggagagacaaccaagcacgcugucucccgcggcacggccaagcuccggugguuuguggaaagaaaucuggugaaaccggaggggaaggucauugaucuuggauguggccgcgggggauggucuuacuauugcgcuggccugaaaaagguuacagaagugaaaggcuacaccaaagggggacccggccacgaggaaccuauccccauggccaccuacggguggaaccucgugaaacugcauagcggaaaggacgucuucuuuauuccucccgagaagugugauacacugcucugcgacaucggcgaguccagcccuaauccgaccauugaagaggggcggacacuuagagugcugaaaaugguugaacccuggcugcgcggaaaccaguucuguaucaagauucucaauccuuauaugcccucuguggucgagacgcuggagcaaaugcagcggaaacacggcggcaugcuugugagaaacccucugucccgcaauagcacccaugaaauguacuggguuucuugcgggacaggaaacaucguguccgcggucaauaugaccagccggaugcuccugaacagauuuacaauggcccaccgcaagcccaccuaugagcgggauguggaccugggcgcugggacgagacacguggccgucgaaccggagguugcuaaccucgauaucauuggacagcgcaucgaaaauauuaaacaugagcacaagucuaccuggcauuacgacgaggauaacccuuauaagacaugggccuaccacggcuccuaugaagugaaacccagcggguccgcuagcucuauggugaauggagucgugaagcugcuuaccaaacccugggacguuaucccuauggugacacagauugccaugaccgauacaacccccuucggccaacagagagucuuuaaggagaaaguggacacgcggacaccuaaggcgaagcgcggcaccgcccagaucauggaaguuaccgcuaaauggcuguggggguuccucagcagaaacaagaaaccgcggaucuguacaagagaggaauuuacgcggaaggugcgcuccaaugccgcuauuggagccgucuucguggacgagaaccaauggaacucugccaaagaggcgguugaagaugagagauuuugggaccuggugcaucgggaacgcgagcuucacaagcagggcaagugcgcuaccugcgucuacaacaugauggggaaaagagaaaagaaacugggagaguucggcaaggccaaagggagccgggccaucugguacauguggcucggcgcucgcuuccuggaguuugaagcccugggauucaugaaugaggaucacugguuuuccagagaaaacucucucagcggcguggagggggagggacugcauaaacuuggcuauauucugcgggacaucuccaaaauucccgggggaaauauguacgcugaugacacagccggcugggauacccgcaucacagaagacgaucuccagaacgaggcgaagaucaccgacauuauggaaccugagcacgcccugcuugcuaagucuaucuucaaacugacauaucagaauaaggucgugagaguucaacggcccgccaaaaacgggaccgugauggaugucauuagccgcagagaccagcggggcuccggacaggugggcacguacgggcucaauaccuuuacaaacauggaagcucagcugauccgccaaauggagagcgagggaauuuucucuccuuccgaacuggagacccccaaccucgccagacgggugcuggauuggcuugaaaagcauggcguugagagacugaaacgcauggcgaucagcggggacgacuguguggucaagccgaucgaugaccgguuugccacagcucucaccgcccugaaugauaugggaaaggugagaaaagacauuccucagugggaacccucuaagggcuggaacgauuggcagcagguuccuuucugcucccaccacuuucaucaacuuaucaugaaagacgggcgcgagauugugguccccugucggaaucaggaugagcuggugggcagagcucgcgucagccagggagccggcuggucccuccgggaaacggcuugccuggggaagucuuaugcccagauguggcaacugauguacuuccacagacgcgaccuccggcuggcggccaacgcuaucuguagcgccgugccuguugauugggugcccacauccagaaccacauggagcauucaugcccaccaucaguggaugaccacggaggacaugcuuucugucuggaaucgcguguggaucgaagagaacccguggauggaagauaaaacccacauuuccagcuggggagacguuccuuaucugggcaagcgggaggaccaguggugcgggucucucaucggacugacagcuagagccaccugggcgacaaauauccaaguggcuauuaaccagguccggagacuuaucggcaaugagaacuaccuggauuacaugaccagcaugaagcgcuuuaaaaaugaauccgaccccgagggggcccucugguga

SEQ ID NO: 18894 - RNA, 9879 nt, Artificial Sequence
  derived and/or modified CDS sequence (opt5) from DENV-1__FJ432732__SS-prME
agcgugaccaugcugcucaugcugaugcccacggcccuugcuuuccaccugacgaccagaggcggggaaccucauaugaucgucuccaagcaggaacgggggaaaucucuccuguuuaagaccagcgccggcguuaacaugugcacccuuaucgcgauggaccugggggaacucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucuguugcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugucauugggaccucuaucacccagaagggaaucauuuucauccuccugaugcuugugacaccuagcauggcgaugagaugcguuggcauugggucccgggauuuuguggagggacugagcggcgccacgugggucgacguggugcucgagcacgggucuugugucaccacaauggcuaaggauaaacccacccuggacaucgaacugcucaagacagagguuaccaacccugccgugcugcgcaaacuuugcauugaagcuaagaucuccaauacgacaaccgauagcagauguccgacccaaggagaggccacacugguggaagaacaagacgcgaacuucgucugccggcgcaccuuuguggauagaggcuggggcaauggguguggacucuucggcaaagggucucugauuacaugcgccaaguuuaagugcguuacgaaacuugagggaaagaucgugcaguacgaaaaccugaaauauuccgucaucgugaccguucacacaggcgaccagcaucaaguggggaaugagagcaccgaacacggaacaaccgcuacgauuacaccccaagccccuaccaccgagauccagcucacagacuacggcgcucugacccuggauuguucuccccggacgggccucgacuucaacgaaaugguccugcuuacaaugaaggagaaauccuggcuggugcauaagcagugguuucucgaucugccucuucccuggaccagcggggccuccacaucucaagagaccuggaaucgccaggaccugcucgucaccuucaaaacagcccacgcuaagaagcaggaagugguugugcugggaagccaagagggcgcgaugcacacggcccugaccggggcuacagaaauucagaccuccggaacaaccacgaucuuugccggccaucucaaaugcagacugaagauggauaaacuuacacugaaggggaugagcuaugucauguguaccggcucuuucaaacucgagaaggaaguggccgagacccagcacggaacaguucuggugcagauuaaguacgagggcaccgacgcuccgugcaaaaucccuuucuccacacaagaugaaaagggggucacgcagaacggacggcugaucaccgccaaucccauugugacagacaaagagaagccugugaacaucgaagcggagccgcccuuuggcgagagcuauauuaccaucggggcuggagaaaaagcccuuaagcucucuugguucaagaaaggcagcuccauugggaagauguuugaggccacagcuagaggcgcccgccggauggcuauccugggagauaccgccugggacuucggcucuaucgggggaguuuuuacgagcgucggcaaacuggugcaucagauuuucgggaccgcguacggagugcucuuuuccggcgucagcuggacaaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacguggacagaacaauauaaguuucaggccgacuccccuaaacggcugucugcugccauuggcaaggcgugggaggagggggugugcggcaucagaagcgccacccgccucgaaaacaucauguggaaacagauuuccaacgagcugaaucauauccuucuggaaaacgacaugaaguucaccguuguggucggagauguggcuggcauuuuugcccaggggaaaaagaugauccggccgcaacccauggaguacaaauauucuuggaaaagcuggggaaaggcuaagauuaucggcgccgacgugcagaauacaaccuucaucauugaugggccuaacacgcccgaauguccugacgaucagagagccuggaauaucugggaggucgaggacuacggauuuggcauuuucacaaccaacaucuggcucaagcugcgcgauuccuauacacagguuugcgaccaccggcugaugagcgcugcgauuaaagauucuaaggccgugcacgcugacaugggcuacuggaucgaauccgagaaaaaugaaaccuggaaacuugccagagccagcuucaucgaggugaagacauguauuuggcccaaaucucauacccucugguccaacgggguccuggaaagcgagaugaucauuccgaagaucuauggaggcccuauuucucaacacaauuaccgccccggguacuuuacgcagaccgcuggaccuuggcaucugggcaaacucgagcuggauuucgaccuuugcgaagggacaaccgugguuguggaugagcacugcggaaaccggggccccagccugagaacaaccacggucacaggcaagaucauccacgaaugguguugccgguccuguacccucccuccccugcgcuuuagaggggaggacggaugcugguauggcauggagauucggccggugaaagaaaaggaggaaaaucugguuaagagcauggugucugccggguccggagaggucgacagcuucucccuuggccuccuguguaucucuauuaugaucgaagaggugaugagaagccgcuggucccggaaaaugcugaugacagggacccucgcggucuuuuuccugcuuauuaugggacagcugaccuggaacgaucucaucagacugugcauuauggugggcgcuaaugccucugaccgcaugggcauggggacaacguaccuggcccuuauggcuaccuuuaagaugagaccuauguucgccgucggacugcucuuucggcgccugacaagcagagaggugcuccugcuuaccaucggccugucccucguggcgucugucgaacugcccaacagccuggaggaacuuggggauggacuggcuaugggcaucaugauucucaaacugcucacagacuuccaaucccaucagcugugggccacccuucugagccucacguuuaucaagacaaccuucucucugcacuaugccuggaaaaccauggcuaugguucuguccauugugagccuuuuuccccugugucucucuacaaccucccagaagacaacguggcugccugugcuccuggggagccuuggaugcaagccgcugaccauguuccugaucgccgagaauaaaauuuggggccggcgcucuuggccccucaacgaaggcaucauggcugucgggaucguguccauucugcuuagcucccugcucaagaacgauguuccucuggccggaccccucaucgcgggcgggaugcugauugccuguuacgugaucagcggaucuagcgcugaccuuucccuggagaaagccgcugaggucucuugggaagaggaagccgagcauagcggcgccucccacaauauucugguggaaguucaggaugacgggacaaugaagaucaaagaugaggagagagacgauacccucacaauccugcuuaaggcuacccugcucgcggugucuggagucuauccucugagcauucccgccacacucuucgugugguacuuuuggcagaagaagaagcagcgguccggcguccugugggacaccccuucucccccggaaguggagcgcgcuguucuugaugacggcaucuauagaauuaugcagcgggggcugcugggacgcagccaggugggcgucgggguguuccaagaaaacguuuuucauacaauguggcacgugaccagaggagccguccucauguaccagggcaaacggcuggagccuuccugggccagcgugaagaaagaccuuaucucuuacgggggaggcuggagacugcagggcuccuggaauacaggggaggaagugcagguuauugcugucgagcccggaaagaacccuaaaaaugugcaaaccgcccccggcacauucaagacgccggaaggggaggugggagcgaucgcucucgauuuuaagccuggcaccagcgggucucccauugucaaccgcgaaggaaaaaucgugggccuguauggcaaugggguugugacaaccuccggaaccuacgucagcgccaucgcccaggcuaaggccucccaggagggcccucuccccgagauugaagacgagguguuccggaaaagaaaccugacaaucauggaucuucaccccgggucuggaaagacgcgccgguaucugccugcgauuguuagagaagcuaucaaacgcaagcugcggacccucauucuggccccgacaagaguggucgccagcgagauggcugaagcccuuaagggcaugcccauccgcuaccaaaccacagcugugaaauccgagcauaccgggaaggagaucguugaccugaugugccacgccacguuuacaaugcggcuccugagcccugugagaguccccaauuauaacaugauuaucauggaugaagcgcauuucaccgacccuucuuccauugccgcucggggcuacaucagcacccgcgugggaaugggcgaggccgcugccauuuuuaugacagccacacccccugggucuguggaggcuuucccgcagagcaaugcggucauccaggaugaggaaagagacauccccgagcgguccuggaacucuggauaugaguggauuacagauuuuccuggcaaaaccguuugguucgugcccagcaucaaguccgggaaugacauugccaacugucugcgcaaaaauggaaagagagugauccagcucucucggaagacguucgauacagaauaccagaaaaccaagaacaacgacugggacuacgucgugacaaccgauauuagcgagaugggcgcuaauuuuagagccgaccgcguuaucgauccucggagaugccuuaaacccgugauucugaaggacgggccggaacgcgucauccuggccggcccuaugcccgugacgguugcuuccgccgcgcagcggagaggacgcaucggccggaaccacaauaaagagggggaucaguauauuuacaugggacagccccucaacaaugacgaggaucaugcucacuggaccgaagccaagaugcugcuugacaacaucaauacaccugagggcauuauccccgcccuguucgaaccugagagagaaaagagcgcugccauugauggggaguaucgccucagaggagaggcgcggaaaaccuuuguggaacugaugcgcagaggcgaccugccggucuggcucucuuacaagguggccuccgagggguuccaauauagcgaucggcgcuggugcuuugacggcgaaagaaacaaucagguccuugaggaaaacauggauguggagaucuggacaaaagagggagaacggaagaaacugagaccccgcuggcuggacgcucggaccuacuccgacccucucgcccugagagaguucaaggaauuugcugccggccgccggucuguuagcggggaucuuauccuggagauuggaaaacucccccagcaccugacacagagagcucaaaaugcccuggacaaccucgugaugcuucauaauuccgaacagggcgggcgggcguaucgccacgccauggaggagcugccugauaccaucgaaacgcugaugcuccuggcucuuauugccgugcugacaggaggcgucacccucuucuuucugucuggcagagggcugggaaagaccagcaucggccuccuuuguguuauggcuuccagcgugcugcuguggauggccucuguggagccccauuggauugccgcuuccaucauccucgaguucuuucugaugguccuucugauuccggagccugaccggcagcgcacaccccaggauaaccaacucgcguacgugguuaucgggcugcuguucaugauucucaccguggccgcuaaugagaugggacuucuggaaacaacgaagaaagaccugggcaucgggcacgucgccguggagaaccaccaucacgccgcuaugcucgaugucgaccugcauccugccagcgcguggacccuuuacgccguggcuacaaccauuaucacacccaugaugagacacaccauugaaaacacgaccgccaauaucucucugacagcuaucgccaaccaggcggccauucucaugggacuggauaagggcuggccuaucuccaaaauggacauuggcguuccccugcucgcucuugggugcuauagccaggugaauccgcugacccugacagccgcuguccucaugcugguggcccauuacgcuaucauuggaccuggccuucaagccaaggcgacccgggaggcccagaaacgcacggcugccgggaucaugaagaaccccacaguugauggaaucguggcuauugaccuggaucccgucguguaugacgccaaguuugaaaaacagcucggccagaucaugcugcugauucucuguaccucucaaauccuucugaugagaacaaccugggcccugugcgagagcauuacccucgcgacagggccucugacgacccuuugggagggauccccgggcaaguucuggaauacaaccaucgcugugucuauggccaacaucuuccggggcagcuaccuggcuggggccggacucgccuuuucccugaugaaaagccugggcgggggacgcagaggcacaggggcucagggagaaacccucggcgagaaguggaaacggcagcuuaaucagcuguccaagucugaguucaacacguauaagagaagcggcauuauggagguugaccgcuccgaagccaaagaggggcugaagcggggagagacaaccaaacacgcggucucuagaggcaccgccaagcuccgcugguuuguggaacggaaucuggugaaacccgaggggaaggucaucgaucuuggauguggcagagggggauggagcuacuauugcgcuggccugaagaaaguuacagaagugaagggcuacaccaaagggggaccuggccacgaggaacccauuccuauggccacauacggguggaaccucgugaagcugcauuccggaaaagacgucuucuuuauucccccugagaagugugauacgcugcucugcgacauuggcgagucuagcccgaaucccaccaucgaagaggggcgcacacuucgggugcugaaaaugguugaaccuuggcugagaggaaaccaauucuguauuaagauccucaaucccuauaugccuuccguggucgagacccuggagcagaugcagcgcaagcacggcggcaugcuugugcggaacccccugagcagaaauucuacacaugaaauguacuggguuuccugcgggaccggaaacaucgugagcgcugucaauaugacgucucgcaugcuccugaaccgguuuaccauggcccacagaaaaccgacauaugagcgcgauguggaccugggcgcggggaccagacacguggccgucgaaccugagguugcuaaccucgauauuaucggacagcggauugaaaauaucaagcaugagcacaaauccacauggcauuacgacgaggauaaccccuauaagaccugggccuaccacggcagcuaugaagugaaacccucuggguccgcuagcuccauggugaauggagucgugaagcugcuuacaaagccuugggacguuauucccauggugacccaaaucgccaugacggauacaaccccuuucggccagcagcgcgucuuuaaagagaagguggacaccagaacaccgaaagcuaagcggggcacggcccaaaucauggaaguuaccgcgaaauggcuguggggguuccucagcagaaacaagaagccccggauuuguacacgcgaggaauuuaccagaaaagugcggucuaaugccgcuaucggagccgucuucguggacgagaaccaguggaauagcgcuaaggaggccguugaagaugagcgcuuuugggaccuggugcauagagaacgggagcuucacaaacagggcaagugcgccacaugcgucuacaacaugauggggaaacgcgaaaagaagcugggagaguucggcaaagcgaagggguccagagcuauuugguacauguggcucggcgcccgguuccuggaguuugaagcccugggauucaugaaugaggaucacugguuuucucgcgaaaacagccucuccggcguggagggggagggacugcauaaacuuggcuauauccugagagacauuucuaagaucccugggggaaauauguacgcugaugacaccgccggcugggauacacggaucaccgaagacgaucuccagaacgaggcucgcauuacggacaucauggaacccgagcacgcccugcuugcgaaaagcauuuucaagcugaccuaucaaaauaaagucgugagaguucagcggccugccaagaacgggacagugauggaugucaucucccgcagagaccagcggggcucuggacaggugggcaccuacgggcucaauacauuuaccaacauggaagcucaacugauuagacagauggagagcgagggaaucuucucccccagcgaacuggagacgccgaaccucgccgaacgcgugcuggauuggcuugagaaguauggcguugaacggcugaaaagaauggcuaucucuggggacgacuguguggucaagccuauugaugaccgcuuugccacagcgcucaccgcccugaaugauaugggaaaagugcggaaggacaucccccagugggagccuuccaaaggcuggaacgauuggcagcaaguucccuucugcagccaucacuuucaccagcuuauuaugaaggacgggagagagaucguggucccuugucgcaaucaggaugaacuggugggccgggcuagagucucucagggagccggcuggucccuccgcgagacagcuugccugggaaagagcuacgcccaaauguggcagcugauguauuuccaucggagagaccuccgccuggcugccaacgcgauuuguuccgccgugcccguugauuggaucccgaccucucggacgaccuggagcauucacgcucaucaccaguggaugacaaccgaagacaugcuuuccguguggaauagagucuggaucgaggaaaacccuuggauggaggauaaaacacauaucagcucuuggggagacgugcccuaccugggcaagcgggaggaccaauggugcgggucccucauuggacugaccgccagagccacaugggcuaccaauauccagguugccauuaaccaggugcgccggcuuaucggcaaugaaaacuaccuggauuauaugacgagcaugaaaagauuuaagaaugagucugaccccgaaggggcgcucugguga

SEQ ID NO: 18895 - RNA, 9879 nt, Artificial Sequence
  derived and/or modified CDS sequence (opt5) from DENV-1__FJ432733__SS-prME
agcgugaccaugcugcucaugcugaugcccaccgcccuugcuuuccaccugacgacccggggcggggaaccucauaugaucgugacaaagcaggaacggggaaagucccuccuguuuaagaccucugccggcguuaacaugugcacacuuauugccauggaccugggggagcucugugaagauaccaugacauacaagugcccccgcaucaccgagguggaacccgacgauguggacuguuggugcaaugcuacggauaccugggucacauauggaaccuguagccagacaggcgagcaccggcgggacaagcgcuccguggcccuggccccucauguugggcugggacucgagaccagaacggaaacauggaugucuagcgagggcgcuuggaaacagauucagcggguggaaaccugggcccugcgccaccccggcuucacagucaucgcucuuuuucuggcccaugugauugggaccuccaucacccagaagggaaucauuuucauccuccugaugcuuguuacaccuucuauggcgaugagaugcgugggcauugggagccgggauuuugucgagggacuguccggcgccacguggguggacgugguccucgagcacgggagcuguguuaccacaauggcuaaggauaaacccacccuggacaucgaacugcucaagacagaggugaccaacccugccgugcugcgcaaacuuugcauugaagcuaagaucucuaauacgacaaccgauuccagauguccgacccaaggagaggccacacugauggaagaacaagacgcgaacuucgucugccggcgcaccuuuguggauagaggcuggggcaauggguguggacucuucggcaaagggagccugauuacaugcgccaaguuuaagugcguuacgaaacuugagggaaagaucgugcaguacgaaaaccugaaauauucugucaucgugaccguucacacaggcgaccagcaucaaguggggaaugaguccaccgaacacggaacaauugcuaccaucacgccccaggccccuaccagcgagauucagcucacagacuacggcgcucugacccuggauuguucuccccggacaggccucgacuucaacgaaaugguccugcuuaccaugaaggagaaauccuggcuggugcauaagcagugguuucucgaucugccucuucccuggacgagcggggccuccacaucucaagagaccuggaaucgccaggaccugcucgucacauucaaaaccgcccacgcuaagaagcaggaagugguugugcugggaagccaagagggcgcgaugcacaccgcccugacaggggcuacggaaauccagaccuccggaacaaccacaauuuuugccggccaucucaaaugcagacugaagauggauaaacuuacccugaaggggaugagcuaugucauguguacgggcucuuucaaacucgagaaggaaguggccgagacacagcacggaaccguucuggugcagaucaaguacgagggcaccgacgcuccgugcaaaaucccuuucuccacacaagaugaaaagggggucacccagaacggacggcugauuacagccaaucccaucgugacggacaaagagaagccugugaacauugaagcggagccgcccuuuggcgagagcuauaucguuauuggggcuggagaaaaagcccuuaagcucucuugguucaagaaaggcagcuccaucgggaagauguuugaggccaccgcuagaggcgcccgccggauggcuauccugggagauacagccugggacuucggcucuauugggggagucuuuaccagcgugggcaaacuggugcaucagaucuucgggacagcguacggaguccucuuuuccggcgugagcuggaccaugaagauugggaucggcguucugcuuacguggcugggacucaauucuagauccaccagccugucuaugacauguauugccgugggccuggucacccuuuaccucggggugaugguucaggcugauuccggaugcgugaucaacuggaaaggccgcgaacugaagugugggagcggaauuuucgucacaaaugaggugcacaccuggacagaacaauauaaguuucaggccgacuccccuaaacggcugucugcugccaucggcaaggcgugggaggaggggguuugcggcaucagaagcgccacccgccucgaaaacauuauguggaaacagaucuccaacgagcugaaucauauucuucuggaaaacgacaugaaguucacgguggucgugggagauguggucggcauccucgcucaggggaaaaagaugauucggccgcaacccauggagcacaaauacucuuggaaaagcuggggaaaggccaagaucaucggcgcugacguucagaauacaaccuuuauuaucgaugggccuaacacccccgaauguccugacgaucagagagccuggaauauuugggagguggaggacuauggauucggcaucuuuacaaccaacauuuggcugaagcugcgcgauucccacacacaggugugcgaccaucggcuuaugagcgccgcuaucaaagauucuaaggcgguccacgccgacaugggcuacuggaucgaauccgagaaaaaugaaacauggaagcucgcuagagccagcuucauugaggugaagaccuguaucuggcccaaaucucauacacugugguccaacgggguucuggaaagcgagaugauuaucccgaagauuuauggaggcccuaucucucaacacaauuaccgccccggguauuucacccagacagccggaccuuggcaccucggcaaacuggagcuugauuuugaccugugcgaagggaccacgguggucguggaugagcauugcggaaaccggggccccagccucagaaccacaaccguuacaggcaagaucauucacgaaugguguugccgguccuguacccugccuccccugcgcuucaaaggggaggacggaugcugguacggcauggagaucagaccggugaaggaaaaggaggaaaaucuugucaaaagcauggugucugcuggguccggagagguugacagcuuuucccucggccugcuguguauuucuaucaugauugaagaggugaugcggagcagauggucccgcaagaugcucaugacggggacacuggccgucuuccuucugcucaucaugggacagcugaccuggaacgaucugauucggcuuugcaucauggugggcgcgaaugcuucugacagaaugggcauggggacaaccuaccuggcccucauggccaccuuuaaaaugcgcccuauguucgcugugggacugcucuuuagacggcugacaagccgcgagguccuucugcucacgaucggccugucccugguugccucuguggaacuucccaacagccuggaggaacucggggauggacuggcgaugggcauuaugauccucaagcugcuuaccgacuuccaaucccaucagcugugggcuacacuccugagccugaccuuuauuaaaacaacccuuucucugcacuaugccuggaagacgauggccauggugcucuccaucgucagccuguucccccucugucugucuacaaccucccagaagaccacauggcuuccugugcugcuggggagccucggaugcaaaccgcuggcuaugcuucugauugccgagaauaagaucuggggcagaaaaucuuggccccucaacgaaggcaucauggcuguugggguggucuccauucugcucagcucccugcuuaagaacgaugugccucuggccggaccccugaucgcgggcgggaugcucauugccuguuacguuaucagcggaucuagcgcugaccugucccuugagaaagccgcugaggugucuugggaagaggaagccgagcauagcggcgccucccacaauauucuggucgaagugcaggaugacgggaccaugaagaucaaagaugaggagcgggacgauacacucacgauccugcucaaggcuacccugcuugcggucucuggaguguauccucugagcauucccgccacacuguuuguuugguacuucuggcaaaagaaaaagcagcgcuccggcgugcucugggacaccccuucucccccggaagucgagagagcugugcuggaugacggcaucuaucggauuaugcagcgcgggcuucugggaagaagccagguuggcgugggggucuuucaagaaaacguguuccacacaauguggcaugugacccggggagccguucucauguaccagggcaaacgccuggagccuuccugggccagcgucaagaaagaccucaucucuuaugggggaggcuggagacugcagggcuccuggaauacgggggaggaaguccaggugauugcugucgagcccggaaagaacccuaagaaugugcaaaccgcccccggcacauucaaaaccccggaaggggagguuggagcgaucgcucuugauuuuaagccuggcacaagcgggucucccauugugaaccgggaaggaaaaaucgucggccuguacggcaauggggugguuaccacauccggaacguacgugagcgccaucgcccaggcuaaggccucccaggagggcccucugcccgagauugaagacgaggucuucagaaaacgcaaccucaccaucauggaucugcaccccgggucuggaaagacacggagauaucuuccugcgauugugcgcgaagcuaucaagcggaaacugagaacccucauucuggccccgacccgcguuguggccagcgagauggcugaagcccugaagggcaugcccauccgguaccaaacaacggcugucaaauccgagcauaccgggaaggagaucguggaccucaugugccacgccacauuuaccaugagacuucugagcccugugcgcguccccaauuauaacaugauuaucauggaugaagcgcauuucacagacccuucuuccauugccgcucggggcuacaucagcaccagaguuggaaugggcgaggccgcugccauuuuuaugacggccacacccccugggucuguggaggcuuucccgcagagcaaugcggugauccaggaugaggaacgggacauccccgagcgcuccuggaacucuggauaugaguggauuaccgauuuuccuggcaaaaccgucugguucgugcccagcaucaaguccgggaaugacauugccaacugucugagaaagaauggaaaacggguuauccagcucucucgcaagacauuugauaccgaauaccagaagacgaagaacaacgacugggacuauguggucaccacggauauuagcgagaugggcgcuaauuucagagccgaccgggugaucgauccuagacgcugccugaaacccguuauucuuaaggacgggccggaacgggugauccuggccggcccuaugcccgucacaguggcuuccgccgcgcagagacgcggacggaucggcagaaaccacaauaaggagggggaucaguacauuuacaugggacagccccucaacaaugacgaggaucacgcucauuggaccgaagccaaaaugcugcuggacaacaucaauacaccugagggcauuauccccgcccucuuugaaccugagcgcgaaaagagcgcugccauugauggggaguaucggcuuagaggagaggcgcgcaaaaccuucgucgaacugaugagacggggcgaccugccgguguggcucucuuacaagguugccuccgagggguuccaauauagcgaucgcagauggugcuuugacggcgaacggaacaaucaggugcuggaggaaaacauggauguggagaucuggacgaaagagggagaacgcaagaaacuuagaccccgguggcuggacgcuagaaccuacuccgacccucucgcccugcgcgaguucaaggaauuugcugccggccggagaucugucagcggggaucugauccucgagauuggaaaacuuccccagcaccugacacagcgcgcucaaaaugcccuggacaaccucguuaugcugcauaauuccgaacagggcgggcgggcguauagacacgccauggaggagcuuccugauaccaucgaaacacugaugcuccuggcucugauugccgugcucaccggaggcgugacacuuuucuuucugucuggccgggggcugggaaaaaccagcaucggccuccugugugucauggcuuccagcgugcuucuguggauggccucuguugagccccacuggauugccgcuuccaucauccucgaguucuuucugauggugcugcucauuccggagccugaccgccagagaacgccccaggauaaccaacuugcguacgucgugaucgggcugcuguucaugauucucacagucgccgcuaaugagaugggacugcuugaaaccaccaagaaagaccugggcaucgggcauguggccguugagaaccaccaucacgccacaaugcucgauguggaccugcauccugcuagcgccuggacccuguaugcggucgccacaacgauuaucacccccaugaugcggcacacaauugaaaacaccacagcuaauaucucucucaccgccaucgcuaaccaggccgcgauucuuaugggacuggauaagggcuggccuaucuccaaaauggacauuggcgugccccugcucgcccuggggugcuacagccagguuaauccgcuuacgcugaccgcugccgugcucaugcuggucgcucacuacgccaucauuggaccuggccugcaagcuaaggccacacgcgaggcgcagaagagaaccgccgcugggaucaugaaaaaccccacaguggauggaaucguggccauugaccucgaucccguugucuaugacgcuaaguuugaaaaacagcuuggccagaucaugcugcugauucucuguaccucucaaauccugcuuaugcggacgacaugggcccugugcgagagcauuacccucgccacagggccucugaccacccugugggagggauccccgggcaaguucuggaauacaacgaucgcggugucuauggcuaacaucuuucgcggcagcuaccucgccggggcuggacuugccuucucccugaugaaaagccugggcgggggaagacggggcaccggggcccagggagaaacacucggcgagaaguggaagcgccagcugaaucagcuuuccaaaucugaauuuaacauuuauaagagaagcggcaucauggagguggaccgguccgaagcuaaagaggggcugaagagaggagagaccacacgccaugccgucucucggggcaccgcgaaacucagaugguucguugaacgcaaucuggugaagcccgaggggaaggugauugaucugggauguggcagagggggauggagcuacuauugcgccggccucaaaaaggucacggaagugaaaggcuacacaaaagggggaccuggccacgaggaacccaucccuauggcuaccuauggguggaaccuuguuaaacugcauuccggaaaggacguguucuuuacacccccugagaaaugugauacacugcucugcgacauuggcgagucuagcccgaaucccaccaucgaagaggggagaacacugcgcguccuuaagaugguggaaccuuggcugcggggaaaccaauucuguauuaagauccucaaucccuacaugccuuccguuguggagacgcuggagcagaugcagagaaaacacggcggcaugcugguccgcaacccccucagcagaaauucuacccacgaaauguacuggguguccugcgggacaggaaacaucgugagcgccgucaauaugaccucuagaaugcugcuuaaccgcuuuacaauggcucaucggaagccgaccuaugagagagauguugaccugggcgccgggacgcgccacguggcgguggaaccugaggucgccaaccucgauauuaucggacagagaauugaaaauaucaaacaugagcacaaguccaccuggcauuacgacgaggauaaccccuauaaaacaugggcuuaccacggcagcuaugaagugaagcccucuggguccgccagcuccaugguuaauggaguggucaagcugcuuaccaaaccuugggacgugauucccaugguuacacaaaucgcuaugaccgauacaaccccuuucggccagcagcggguguuuaaggagaaagucgacacgcgcacaccgaaggccaaaagaggcaccgcucaaaucauggaagugaccgcccgguggcuguggggguuccucagcagaaacaagaagccccggauuuguacacgcgaggaauuuacgagaaaaguucggucuaaugcggccaucggagcuguguucgucgacgagaaccaguggaauagcgccaaggaggcuguggaagaugagcgcuuuugggaccugguccagaaagaaagagagcugcacaagcagggcaaaugcgcgaccugcguguacaacaugauggggaagcgggaaaagaaacucggagaguucggcaaggccaaagggucccgcgcgauuugguauauguggcugggcgcuagauuucuugaguucgaagcccugggauuuaugaaugaggaucauugguucucucgggaaaacagccucuccggcguugagggggagggacugcacaaacuuggcuacauccugcgcgacauuucuaaaaucccugggggaaauauguacgccgaugacacagcuggcugggauaccagaaucacagaagacgaucuccaaaacgaggcccggauuaccgacaucauggaacccgagcaugcucugcuggccacaagcauuuucaagcucaccuaucagaauaaagugguccgcgugcagagaccugcgaagaacgggacggugauggauguuaucucccggcgcgaccagagaggcucuggacaagugggcaccuacgggcugaauacauuuaccaacauggaagcccagcuuauucggcagauggagagcgagggaaucuuccugcccuccgaacucgagacacagaaccuggcugaaagaguccuugauuggcuggagaaguauggcguggaacgccucaaacggauggccaucagcggggacgacuguguugugaagccgauugaugacagauuugcuaccgcccugacggcgcugaaugauaugggaaaaguccgcaaggacaucccucaaugggagcccucuaaaggcuggaacgauuggcaacaggugccuuucugcucccaccacuuucaucagcucauuaugaaggacgggcgggagaucgucgugcccuguagaaaucaagaugaacugguuggccgcgcccgggugagccagggagcuggcuggucucuuagagagacagccugccuggggaaguccuacgcucagauguggcaacucauguauuuccaccgccgggaccugagacuugccgcuaacgccauuuguagcgcggucccuguggauuggguucccaccucccgcacaaccuggucuauccaugcccaccaucaguggaugacgaccgaagacaugcugagcguguggaaucgggucuggauugaggaaaacccguggauggaggauaaaacacacguguccagcuggggagacgugccuuaccucggcaagagagaggaccaguggugcgggucucugaucggacugaccgcucgggccacaugggccuccaauauccagguugcuauuaaccaagucagacgccucaucggcaaugaaaacuaucuggauuacaugaccagcaugaaacgguuuaagaaugagggggaccccgaaggcgcccuuugguga

SEQ ID NO: 18896 - RNA, 9879 nt, Artificial Sequence
  derived and/or modified CDS sequence (opt5) from DENV-1__FJ410196__SS-prME
agcgugaccaugcugcucaugcugaugcccaccgcccuugcuuuccaccugacgaccagaggaggggaaccucauaugaucgucuccaagcaggaacgggggaaaucucuccuguuuaagaccagcgccggcguuaacaugugcacccuuaucgcgauggaccugggggaacucugugaagauaccaugaccuacaaaugccccagaaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaggacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaggcuccuacaaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaaaauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccaggccgcgggaccuuggcaucucggcaaacuggagcuugauuuugaccugugcgaagggacgaccgugguuguggaugagcacugcggaaaccggggccccagccucagaacaaccacagucaccggcaagaucauccacgaaugguguugccgguccuguacgcugccuccccugcgcuucagaggggaggacggaugcugguauggcauggagauucggccggugaaagaaaaggaggaaaaucuuguuaagagcauggugucugcuggguccggagaggucgacagcuuuucccucggccugcuguguaucucuauuaugaucgaagaggugaugagaagccgcuggucccggagaaugcucaugacagggacccuggccguuuucuuucuucugauuaugggacagcucacauggaacgaucugauccgccugugcauuauggugggcgccaaugcuucugacagaaugggcauggggaccaccuaccuugcccugauggcgacauucaaaaugcggccuauguuugcugucggacuccuguuccgcagacucacgagccgggaggugcugcuucugaccaucggccucucccugguggccucugucgaacugcccaacagccuugaggaacugggggauggacucgccaugggcaucaugauucugaagcuccugacagacuuucaaucccaucagcuuugggcuacccugcucagccugacauucaucaaaaccacguuuucucugcacuaugccuggaagacaauggcuaugguucuuuccauugugagccuguucccccucugucugucuaccaccucccagaaaacaaccuggcucccugugcugcuugggagccugggaugcaagccgcugacaauguuucucaucgccgagaauaagauuuggggccgcagaucuuggccccugaacgaaggcaucauggcggucgggaucguguccauucuucugagcucccuccugaaaaacgauguuccucucgccggaccccugaucgcuggcgggaugcuuauugccuguuacgugaucagcggaucuagcgcugaccugucccuggagaaggccgccgaggucucuugggaagaggaagcugagcauagcggcgcgucccacaauauucucguggaaguucaggaugacgggacgaugaaaaucaaggaugaggagcgggacgauacccugacaauccuucugaaagccacccuccuggcugugucuggagucuauccucucagcauucccgccacacuguucgugugguacuucuggcaaaagaaaaagcagcgcuccggcguccuuugggacaccccuucucccccggaaguggagagagccguucuggaugacggcaucuaucggauuaugcagcgcgggcugcucggaagaagccaggugggcgucgggguguuucaagaaaacguuuuccauacgauguggcacgugacccggggagcuguccugauguaccagggcaagagacuugagccuuccugggccagcgugaaaaaggaccugaucucuuacgggggaggcuggcgccuccagggcuccuggaauacaggggaggaagugcagguuauugcggucgagcccggcaagaacccuaagaaugugcaaaccgcucccggcacauuuaaaaccccggaaggggaggugggagccaucgcccuggauuucaagccuggcacaagcgggucucccauugucaaccgggaaggaaagaucgugggccucuauggcaaugggguugugacgaccuccggaacauacgucagcgcuaucgcccaggcgaaggcuucccaggagggcccucugcccgagauugaagacgagguguuuagaaagcgcaaccuuaccaucauggaucugcaccccgggucuggaaaaacccggagauaucugccugccauuguucgcgaagccaucaagcggaaacucagaacacugauucuugcuccgacgcgcguggucgccagcgagauggcugaagcccugaagggcaugcccauccgguaccaaaccacagcggugaaguccgagcauaccgggaaagagaucguugaccucaugugccacgccacauucaccaugagacugcugagcccugugcggguccccaauuauaacaugauuaucauggaugaagcucauuuuacggacccuuucucuauugccgcucgcggcuacaucuccacaagagugggaaugggcgaggccgccgcuauuuuuaugaccgcgacacccccugggagcguggaagccuucccgcagucuaaugcugucauccaggaugaggaacgggacauccccgagcgcagcuggaacuccggauaugaguggauuacagauuuuccuggcaagaccguuugguucgugcccucuaucaaaagcgggaaugacauugccaacugucucagaaagaauggaaaacgggugauccagcuuuccagaaagacauucgauaccgaauaccaaaagacgaaaaacaacgacugggacuacgucgugacaaccgauauuucugagaugggcgccaauuuucgcgcugaccggguuaucgauccuagacgcugccugaagcccgugauucugaaagacgggccggaacgggucauccucgccggcccuaugcccgugacaguugcgagcgcugcccagagacgcggacggaucggcagaaaccacaauaaggagggggaucaguauauuuacaugggacagccccugaacaaugacgaggaucaugcccacuggaccgaagcuaaaaugcuucuggacaacaucaauacgccugagggcauuauccccgcccucuucgaaccugagcgcgaaaaguccgcggccauugauggggaguauagacugcggggagaggcucgcaagaccuuuguggaacugaugagacggggcgaccucccggucuggcuuagcuacaaaguggccucugagggguuccaauauuccgaucgcagauggugcuuugacggcgaacggaacaaucagguccuggaggaaaacauggauguggagaucuggacaaaggagggagaacgcaagaaacugcgcccccgguggcucgacgcuagaaccuacagcgacccucuggcccuucgcgaguucaaagaauuugcugccggccggagauccguuucuagcgaucugauccucgagauugggaagcugccccagcaccugacacagcgggcgcaaaaugcccucgacaaccuugugaugcugcauaauuccgaacagggaggccgcgcuuauagacacgccauggaggagcugccugauaccaucgaaacacucaugcugcuugcucugauugccgugcucaccgggggagucacgcuguucuuucugucuggccggggccucgggaaaacaagcaucggacuucuguguguuauggccuccagcgugcugcucuggauggcuucuguggagccccauuggauugcggccuccaucauccuggaguucuuucuuaugguccugcucauuccggagccugaccgccagagaacaccccaggauaaccaacuggcuuacgugguuaucggccuccuguucaugauucuuaccguggccgccaaugagauggggcugcuggaaacaaccaagaaggaccucggaaucggccacgucgcuguggagaaccaccaucacgccgcgaugcuggaugucgaccuucauccugccagcgcuuggacacuguacgccguggcuacgaccauuaucacacccaugaugcggcacaccauugaaaacacaaccgccaauaucucucucacggcgaucgccaaccaggcugccauucugauggggcuggauaaaggauggccuaucuccaagauggacauuggcguuccccuccuugcucugggcugcuauagccaggugaauccgcugacccucacagccgcuguccugaugcuuguggcccauuacgcgaucauugggccuggacugcaagccaaagcuacccgcgaggcccagaagagaacagcugccggcaucaugaaaaaccccaccguugaugggaucguggccauugaccucgaucccgucguguaugacgcgaaguuugaaaagcagcugggacagaucaugcugcucauucuuuguacgucucaaauccugcugaugcggacaaccugggcucucugcgagagcauuacacuggccaccggcccucuuaccacacugugggagggguccccgggaaaauucuggaauacgaccaucgcugugucuauggccaacaucuuccgcggcagcuaccucgccggcgcugggcuggccuuuucccugaugaaaagccucggaggcgggagacggggaacaggcgcgcagggggaaacccuuggagagaaauggaagagacagcugaaucagcuguccaaaucugaguucaacacauauaagcgcagcggcauuauggagguugaccgguccgaagccaaggagggccucaaaagaggggagaccacgaagcacgcugucucucgcggaacagccaaacugcggugguuuguggaaagaaaucuugugaagcccgagggcaaagucaucgaucugggguguggacgcggcggguggagcuacuauugcgcuggacucaagaagguuaccgaagugaaaggcuacaccaagggcgggccuggacacgaggaacccauuccuauggccacauacggcuggaaccuggugaaacugcauuccgggaaggacgucuucuuuauucccccugagaaaugugauacccuccuuugcgacauuggagagucuagcccgaaucccacaaucgaagagggccggacgcugagagugcugaagaugguugaaccuuggcuccgcgggaaccaauucuguauuaaaauccugaaucccuauaugccuuccguggucgagacccuugagcagaugcagcggaagcacggaggcaugcuggugagaaacccccucagccgcaauucuacacaugaaauguacuggguuuccugcggcaccgggaacaucgugagcgcggucaauaugacaucucggaugcugcugaacagauuuaccauggcccaccgcaagccgacguaugagagagauguggaccucggagcuggcacccggcacguggccgucgaaccugagguugcuaaccuggauauuaucgggcagcgcauugaaaauaucaaacaugagcacaaguccacauggcauuacgacgaggauaaccccuauaaaaccugggccuaccacggaagcuaugaagugaagcccucuggcuccgcuagcuccauggugaauggggucgugaaacuucugacaaagccuugggacguuauucccauggugacccaaaucgccaugacagauaccacgccuuucggacagcagagagucuuuaaggagaaaguggacacacggaccccgaaggcgaaaagaggcaccgcccaaaucauggaaguuacagcuaaguggcucuggggcuuccugagccggaacaaaaagccccgcauuuguacgagagaggaauuuacccggaaggugcgcucuaaugccgcuaucggggccgucuucguggacgagaaccaguggaauagcgccaaagaggcgguugaagaugagagauuuugggaccuugugcaucgggaacgcgagcugcacaagcagggaaaaugcgcuacaugcgucuacaacaugaugggcaagagagagaaaaagcucggggaguucggaaaggccaaaggcucccgggccauuugguacauguggcugggggcucgcuuccuggaguuugaagcccucggcuucaugaaugaggaucacugguuuucuagagaaaacagccuguccggaguggagggcgaggggcuucauaagcugggauauauccuccggggcauuucuaaaaucccugggggaaauauguacgcugacgauaccgccggcugggacacacgcaucaccgaagaugaccugcagaacgaggcgagaauuacagauaucauggaacccgagcacgcccuucuggcuaagagcauuuucaaacucaccuaucaaaauaaggucgugcggguucagcgcccugccaaaaacgggacggugauggacgucaucuccagacgggaucagagaggcucuggacaggugggcaccuacgggcugaauacauuuaccaacauggaagcucaacugauucgccagauggagagcgagggaaucuucucccccagcgaacucgagacaccgaaccuggccgaacgggugcuugacuggcuggagaaguauggcguugaaagacucaagcgcauggcgaucucuggggaugacuguguggucaaaccuauugacgaucgguuugccaccgcucugacggcccuuaaugacaugggaaaggugagaaaagauaucccccagugggagccuuccaagggcuggaacgacuggcagcaaguucccuucugcagccaucacuuucaccagcugauuaugaaagaugggcgcgagaucguggucccuugucggaaucaggacgaacucgugggcagagcucgcgucucucagggagccggcuggucccugcgggagacagcuugccugggaaagagcuacgcccaaauguggcagcucauguauuuccauagacgcgaucugcggcuugcggccaacgcuauuuguuccgccgugcccguugacuggaucccgaccucuagaacaaccuggagcauucacgcccaucaccaguggaugacgaccgaagauaugcuguccguguggaaucgggucuggaucgaggaaaacccuuggauggaggacaagacacauaucagcucuuggggagaugugcccuaccucggcaaaagagaggaccaauggugcgggucccugauuggacuuaccgcucgcgccacaugggcgaccaauauccagguugcuauuaaccaggugcggagacugaucggcaaugaaaacuaccucgacuauaugacaagcaugaagcgcuuuaaaaaugagucugaucccgaaggggcccugugguga

SEQ ID NO: 18897 - RNA, 9879 nt, Artificial Sequence
  derived and/or modified CDS sequence (opt5) from DENV-1__FJ432734__SS-prME
agcgugaccaugcugcucaugcugaugcccaccgcccuugcuuuccaccugacgaccagaggaggggaaccucauaugaucgucuccaagcaggaacggggaaaaucucuccuguuuaagaccagcgccggcguuaacaugugcacccuuauugccauggaccugggggaacucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucuguugcccuggcuccucauguggggcugggacucgagacaagaaccgaaacguggaugagcuccgagggcgccuggaaacagauucagcggguugaaacaugggugcugcgccaccccggcuucaccgucaucgcucuuuuucuggcccaugcgauugggacaucuaucacccagaagggaaucauuuucauccuccugaugcuugugaccccuagcauggccaugagaugcguuggcauugggucccgggauuuuguggagggacugagcggcgcuacaugggucgacguggugcucgagcacgggucuugugucacgaccauggccaaggauaaacccacacuggacaucgaacugcucaagaccgagguuacaaacccugcugugcugcgcaaacuuugcauugaagccaagaucuccaauaccacgacagauagcagauguccgacccaaggagaggcgacccugguggaagaacaggacgccaacuucgucugccggcgcacauuuguggauagaggcuggggcaauggguguggacucuucggcaaagggucucugauuaccugcgcuaaguuuaagugcguuacaaaacuugagggaaagaucgugcaguacgaaaaccugaaauauuccgucaucgugacgguucacaccggcgaccagcaucaaguggggaaugagagcacagaacacggaaccacagccaccauuacgccccaggcuccuaccacagagauccagcucaccgacuacggcgcccugacacuggauuguucuccccggaccggccucgacuucaacgaaaugguccugcuuacgaugaaggagaaauccuggcuggugcauaagcagugguuucucgaucugccucuucccuggacaagcggggccuccaccucucaagagacauggaaucgccaggaccugcucgucaccuucaaaaccgcucacgcgaagaagcaggaagugguugugcugggaagccaagagggcgccaugcacacagcucugacgggggccaccgaaauucagacauccggaaccacaaccaucuuugccggccaucucaaaugcagacugaagauggauaaacuuacgcugaaggggaugagcuaugucauguguacaggcucuuucaaacucgagaaggaaguggcugagacccagcacggaaccguucuggugcagauuaaguacgagggcacagacgccccgugcaaaaucccuuucuccacccaagaugaaaagggggucacacagaacggacggcugaucacggcgaaucccauugugaccgacaaagagaagccugugaacaucgaagcugagccgcccuuuggcgagagcuauauuguuaucggggccggagaaaaagcccuuaagcucucuugguucaagaaaggcagcuccauugggaagauguuugaggcuacagccagaggcgcucgccggauggccauccugggagauaccgcgugggacuucggcucuaucgggggagucuuuacaagcgugggcaaacuggugcaucagauuuucgggaccgccuacggaguccucuuuuccggcgugagcuggacgaugaagaucgggauuggcguucugcuuaccuggcugggacucaauucuagauccacaagccugucuaugaccuguaucgcugugggccuggucacacuuuaccucggggugaugguucaggccgauuccggaugcgugauuaacuggaaaggccgcgaacugaagugugggagcggaaucuucgucaccaaugaggugcacacauggaccgaacaauauaaguuucaggcugacuccccuaaacggcugucugccgcgauuggcaaggccugggaggaggggguuugcggcaucagaagcgcuacgcgccucgaaaacaucauguggaaacagauuuccaacgagcugaaucauauccuucuggaaaacgacaugaagcucacaguggucgugggagauguggccggcauucuggggcagggcaagaagaugauccggccgcaacccauggaguacaaauauucuuggaaaagcuggggcaaggcuaagauuaucggggccgacgcccagaauaccaccuucaucauugauggaccuaacacacccgaauguccugacgaucagagagcuuggaauaucugggaggucgaggacuacggcuuuggcauguucaccacgaacauuuggcugaaacuucgcgauuccuauacacagguuugcgaccaccggcucaugagcgcggccaucaaagauucuaaggcugugcacgccgacaugggguacuggauugaauccgagaaaaaugaaaccuggaagcuggccagagcuagcuuuaucgaggugaagacauguaucuggcccaaaucucauacccugugguccaacggaguccucgaaagcgagaugauuaucccgaagauuuauggcgggccuaucucucaacacaauuaccgccccggauacuucacacagaccgccggcccuuggcaucuggggaaacuugagcuggauuucgaccucugcgaaggaacgaccgugguuguggaugagcacugcggcaaccggggccccagccugagaacaaccacagucaccgggaagauuauccacgaaugguguugccgguccuguacgcugccuccccuucgcuuuagaggagaggacggcugcugguaugggauggagauccggccggugaaagaaaaggaggaaaaucucguuaagagcauggugucugcgggauccggcgaggucgacagcuucucccuggggcugcucuguauuucuaucaugauugaagaggugaugagaagccgcuggucccggaaaaugcugaugacaggaacccuugcugucuuuuuccugcucaucaugggccagcugacauggaacgaucugauuagacuuugcaucauggugggcgccaaugccucugaccgcauggggaugggaaccaccuaccuggcucucauggccacauuuaagaugagaccuauguucgcggucggccugcucuuucggcgccugacgagcagagaggugcuucugcucaccauugggcugucccugguggcuucugucgaacuucccaacagccuggaggaacucggagauggccuggccauggggaucaugauccucaaacugcuuacagacuuccaaucccaucagcugugggccacccuccugagccugacauuuauuaagaccacguucucucuucacuaugcuuggaaaacaauggccaugguucuguccaucgugagccucuuuccccugugucucucuaccaccucccagaagacaaccuggcugccugugcuucugggaagccugggcugcaagccgcucacaauguuccugauugcugagaauaaaaucuggggccggaagucuuggccccuuaacgaagggauuauggccgucggaaucguguccauccugcucagcucccugcucaaaaacgauguuccucuggcgggcccccuuauugccgggggaaugcugaucgcuuguuacgugauuagcggcucuagcgccgaccugucccucgagaaggcugccgaggucucuugggaagaggaagccgagcauagcggggcuucccacaauauccugguggaaguucaggaugacggaacgaugaaaauuaaggaugaggagcgcgacgauacccuuacaauccugcucaaagcgacccugcucgccgugucuggcgucuauccucugagcauccccgcuacacuuuuugugugguacuucuggcaaaagaagaaacagagauccggcguccugugggacaccccuucucccccggaaguggagcgggccguucuggaugacgggauuuaucgcaucaugcagagaggacuccugggccggagccaggugggggucggaguguuccaagaaaacguuuuucauacgauguggcacgugacccgcggcgccguccuuauguaccaggggaagagacuggagccuuccugggcuagcgugaaaaaggaccucauuucuuacggaggcggcuggcggcugagaggguccuggaauacaggagaggaagugcagguuaucgccgucgagcccggcaaaaacccuaagaaugugcagaccgcgcccgggacauucaagaccccggaaggagaggugggcgcuauugcccucgauuuuaaaccugggacaagcggaucucccaucgucaaccgcgaaggcaagauugugggccuguaugggaauggaguugugacgaccuccggcacauacgucagcgccaucgcucaagccaaagcgucccaggaggggccucuucccgagaucgaagacgagguguuccggaagagaaaccugaccauuauggaucugcaccccggaucuggcaaaacccgccgguaucucccugcuaucguuagagaagccauuaagcgcaagcugcggacacuuauccuggccccgacgagaguggucgcuagcgagauggccgaagcucucaaagggaugcccauucgcuaccagaccacagccgugaaguccgagcauaccggcaaagagaucguugaccugaugugccacgcgacauuuaccaugcggcugcucagcccugugagaguccccaauuauaacaugaucauuauggaugaagcccauuucacggacccuucuuccaucgcugcccggggauacauuagcacacgcgugggcaugggggaggcugccgccaucuuuaugaccgcuacacccccuggaucuguggaagcguucccgcaaagcaaugccgucauucaggaugaggaaagagacauccccgagcgguccuggaacucuggcuaugaguggaucacagauuuuccugggaagaccguuugguucgugcccagcauuaaauccggaaaugacaucgcuaacugucuucgcaagaauggcaagagagugauucagcugucucggaaaacauuugauaccgaauaccagaagacgaaaaacaacgacugggacuacgucgugacaaccgauaucagcgagaugggggccaauuucagagccgaccgcguuauugauccucggagaugccugaagcccgugauccucaaagacggcccggaacgcgucauucuggcuggaccuaugcccgugacaguugccuccgcggcucaacggagaggccgcaucgggcggaaccacaauaaggagggagaucaguauaucuacaugggccagccccuuaacaaugacgaggaucaugcccacuggaccgaagccaagaugcugcucgacaacauuaauacgccugaggggaucauucccgcucuguucgaaccugagagagaaaagagcgccgcgguggauggagaguaucgccugagaggcgaggcccggaagaccuuugucgagcucaugcgcagaggggaccuuccgguguggcugucuuacaaagucgcuuccgagggcuuccaguauagcgaucggcgcuggugcuuugacggagaaagaaacaaucaagugcuggaggaaaacauggauguugagaucuggacaaaggagggcgaacggaaaaagcucagaccccgcuggcuggacgcccggaccuacuccgacccucuugcucugagagaguucaaagaauuugccgcugggcgccggucugugagcggagaucucauucuggagaucggcaagcugccccagcaccucacacagagagcccagaaugcgcuugacaaccuggugaugcugcauaauuccgaacaagggggacgggccuaucgccacgcuauggaggagcucccugauaccaucgaaacacugaugcuucuggcccucauugcuguccugaccggcggcguuacgcuguucuuucucucugggagaggacuuggcaagacaagcaucgggcugcugugugugauggccuccagcgugcuccuguggauggccucugucgagccccauuggauugcugcguccaucauucuugaguucuuucugauggugcuccugaucccggagccugaccggcagcgcacaccccaggauaaccagcuggccuacguugugaucggacuccuuuucaugauucugaccgucgcugccaaugagaugggccugcucgaaacaaccaaaaaggaccuggggaucggacacguggccgucgagaaccaccaucacgcugccaugcuugauguggaccugcauccugcgagcgccuggacacucuacgcuguugccacgaccauuaucacacccaugaugagacacaccauugaaaacacaaccgcuaauaucucucugacggccauugcgaaccaagccgcuauccugaugggccucgauaaaggcuggccuaucuccaagauggacauuggggugccccuucuggcccugggaugcuauagccaggucaauccgcucacccugacagcugccgugcuuaugcugguugcucauuacgccaucauuggcccugggcuccaggcgaaagccacccgggaggcucaaaagcgcacagccgcuggaaucaugaagaaccccaccguggauggcauugucgccaucgaccuggaucccgugguguaugacgccaaauuugaaaagcagcuggggcagaucaugcuccuuauucuguguacgucucagauccugcucaugagaacaaccugggcgcugugcgagagcauuacacuugcuaccggaccucugaccacacucugggagggcuccccgggcaaauucuggaauacgaccaucgccguuucuauggcuaacauuuuucgggggagcuaccuggccggagccggccuggcuuucucccucaugaaaagccuugggggaggccgcagagggacaggagcccaaggcgaaacccugggcgagaaauggaagcggcagcugaaucagcucuccaagucugaguucaacacauauaaaagaagcgggaucauggaggucgaccgcuccgaagcgaaggagggacugaaacggggcgagaccacgaagcacgccgugucuagagggacagcuaaacuucgcugguuuguggaacggaaucuggucaagcccgagggaaagguuaucgaucucggcugugggagaggaggcuggagcuacuauugcgccggccugaaaaaggugaccgaagugaaaggguacaccaagggaggcccugggcacgaggaacccauuccuauggcuacauacggauggaaccuggucaaacuccauuccggcaaggacguguucuuuauucccccugagaaaugugauacccuucugugcgacaucggggagucuagcccgaaucccacaaucgaagagggacgcacgcugcggguucucaagaugguggaaccuuggcugagaggcaaccaguucuguauuaagauccuuaaucccuauaugccuuccgucguggagacccuggagcaaaugcagcgcaaacacggcgggaugcucguucggaacccccugagcagaaauucuacacaugaaauguacuggguguccugcggaaccggcaacauugucagcgccgugaauaugacaucucgcaugcugcucaaccgguuuaccauggcgcacagaaagccgacguaugagcgcgauguggaccuggggaccggaacaagacacgucgccguugaaccugagguggcuaaccuugauaucaucggccagcggauugaaaauaucaaacaugagcacaaguccaccuggcauuacgacgaggauaaccccuauaaaacaugggccuaccacgggagcuaugaagugaagcccucuggauccgcuagcuccauggucaauggcgugguuaagcugcucaccaaaccuugggacgugauucccauggucacacagaucgccaugaccgauacgacaccuuucggccaacagcgcguguuuaaggagaaaguugacaccagaaccccgaaggcuaaacgggggacagcccagauuauggaagugacggcgagauggcuguggggauuccuuagccggaacaagaagccccgcaucuguaccagagaggaauuuacacggaaaguccgcucuaaugccgcuaucggcgccguguucguugacgagaaccaauggaauagcgcuaaggaggccguggaagaugagagauuuugggaccugguccaucgggaacgcgagcuccacaaacaggggaagugcgcgaccugcguguacaacaugaugggaaaaagagaaaagaagcugggcgaguucgggaaagcgaagggcucccgggcuauuugguacauguggcugggagcccgcuuucucgaguucgaagcccugggcuucaugaaugaggaucacugguuuucuagagaaaacagccuuuccggggucgagggagagggccugcauaaacucggguauauccugcgggacauuucuaagaucccuggaggcaauauguacgcugaugacacagccgggugggauacccgcauuacagaagacgaucuucagaacgaggcuaaaaucaccgacaucauggaacccgagcacgcccugcucgcgaaggccauuuucaaacugacguaucagaauaaggugguuagagugcaacggccugcuaagaacggcaccgucauggaugugaucagccgcagagaccagcggggauccggccagguggggacauacggacugaauaccuuuacaaacauggaagcccagcucauuagacaaauggagucugagggcaucuucagccccuccgaacuggagaccccgaaccuugcugaacgcgcccuggauuggcucgagaaauaugggguugaacggcugaagagaauggcgauuagcggagacgacuguguggucaaaccuaucgaugaccgcuuugccacggcucuuacagcccugaaugauaugggcaaggugcggaaagacaucccccagugggagccuucuaagggguggaacgauuggcagcagguucccuucugcucccaucacuuucaccaacucauuaugaaggacggcagagagaucguggucccuugucgcaaucaggaugaacuggugggacgggcuagagucagccagggcgccggguggucucugcgcgagaccgcuugccucggaaaauccuacgcccagauguggcaacugauguauuuccaucggagagaccuucgccuggcggccaacgcuauuuguagcgccgugcccguugauugggugccgacaucccggaccacguggucuauccacgcccaucaccaguggaugaccacagaagacaugcucagcgucuggaauagaguguggauugaggaaaacccuuggauggaggauaagacccauaucuccagcugggaggacguucccuaccugggcaaacgggaagaccaguggugcgggucucuuauuggacugacagcuagagccaccugggcgacaaauauccaaguggcuaucaaccagguccgccggcucauuggcaaugagaacuaccuggauuauaugaccuccaugaagagauuuaaaaaugaaacggaccccgagggggcccugugguga

SEQ ID NO: 18898 - RNA, 9879 nt, Artificial Sequence
  derived and/or modified CDS sequence (opt5) from DENV-1__FJ432735__SS-prME
agcgugaccaugcugcucaugcugaugcccaccgcccuugcuuuccaccugacgaccagaggcggggaaccucauaugaucgucuccaagcaggaacggggaaaaucucuccuguuuaagacaagcgccggcguuaauaugugcacccuuauugcgauggaccugggggaguucugugaagauacaaugaccuacaaaugcccgagaaucacagaagcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaauuuauggaggcccuaucagccagcacaauuaccgccccggguacuuuacacaaaccgcgggaccuuggcaucugggcaagcucgagcuggauuucgaccuuugcgaagggacgaccgugguuguggaugagcacugcggaaaccggggccccucccugagaacaaccacagucaccggcaaaauuauccacgaaugguguugccggagcuguacgcucccuccccugcgcuuuaagggggaggacggaugcugguauggcauggagaucagaccggugaaggaaaaagaggaaaaucugguuaagucuaugguguccgcugggagcggagaggucgacuccuucucucuuggccuccuguguauuagcaucaugauugaagaggugaugcgguccagauggucucgcaaaaugcugaugacagggacccucgccgucuuuuuccugcuuaucaugggacagcugacauggaacgaucucauucggcugugcaucauggugggcgccaaugcuagcgacagaaugggcauggggaccaccuaccuggcccuuauggcgacauuuaagaugcgcccuauguucgcugucggacugcucuuuagacggcugacgucccgcgaggugcuccugcuuaccauuggccugucucucguggccagcgucgaacugcccaacucccuggaggaacuuggggauggacuggccaugggcaucaugauccucaaacugcucacagacuuccagagccaucaacugugggcuacccuucugucucucacauuuauuaagaccacguucucccugcacuaugccuggaagacaauggcuaugguucugagcaucgugucucuuuuuccccugugucucuccaccaccagccagaaaacaaccuggcugccugugcuccuggggucucuuggaugcaagccgcugacaauguuccugauugccgagaauaaaaucuggggcagaaaguccuggccccucaacgaaggcauuauggcggucgggaucgugagcauccugcuuuccagccugcucaaaaacgauguuccucuggccggaccccucauugcuggcgggaugcugaucgccuguuacgugauuucuggaagcuccgcugaccuuucucuggagaaggccgccgaggucagcugggaagaggaagcugagcauuccggcgcgucucacaauauccugguggaaguucaggaugacgggacgaugaaaauuaaggaugaggagcgggacgauacccucacaauccugcuuaaggccacccugcucgcugugagcggagucuauccucuguccauccccgccacacucuucgugugguacuuuuggcagaaaaagaaacaacgcucuggcguccugugggacaccccuuccccucccgaaguggagagagccguucuugaugacggcauuuaucggaucaugcagcgcgggcugcugggaagaucccaggugggcgucgggguguuccaggaaaacguuuuucauacgauguggcacgugacccggggagcuguccucauguaccaaggcaagcgccuggagcccagcugggccucugugaaaaaggaccuuauuuccuacgggggaggcuggagacugcagggcagcuggaauacaggggaggaagugcagguuaucgcggucgagcccggaaagaacccuaaaaaugugcagaccgcucccggcacauucaagaccucugaaggggaggugggagccauugcccucgauuuuaaaccgggcacauccgggagcccuaucgucaaccgggaaggaaagauugugggccuguauggcaaugggguugugacgaccuccggaacauacgucucugcuaucgcccaagcgaaagcuagccaggagggcccccucccugagaucgaagacgagguguucagaaagcgcaaccugaccauuauggaucuucaccccggguccggaaagacccggagauaucugcccgccaucguucgcgaagccauuaaacggaagcugagaacacucauccuggcuccuacgcgcguggucgccagcgagauggcugaagcccuuaaaggcaugccgauucgguaccagaccacagcggugaagucugagcauaccgggaaagagaucguugaccugaugugccacgccacauuuaccaugagacuccugucccccgugcgcgucccuaauuauaacaugaucauuauggaugaagcucauuucacggaccccagcucuaucgccgcucggggcuacauuagcacaagagugggaaugggcgaggccgccgcuaucuuuaugaccgcgaccccucccggguccguggaagccuucccucaaucuaaugcugucauucaggaugaggaacgggacaucccggagcgcagcuggaacuccggauaugaguggaucacagauuuucccggcaagaccguuugguucgugccuucuauuaagagcgggaaugacaucgccaacugucugcgcaagaauggaaagcgggugauucagcucucccgcaaaacauucgauaccgaauaccagaagacgaaaaacaacgacugggacuacgucgugacaaccgauaucagcgagaugggcgccaauuuuagagcugaccggguuauugaucccagacgcugccuuaagccugugauccugaaggacgggcccgaacgggucauucuggccggcccgaugccugugacaguugcgucugcugcccaaagacgcggacggaucggcagaaaccacaauaaagagggggaucaguauaucuacaugggacagccccucaacaaugacgaggaucaugcccacuggaccgaagcuaagaugcugcuugacaacauuaauacgcccgagggcaucauuccugcccuguucgaacccgagcgcgaaaaauccgcggccaucgauggggaguaucggcucagaggagaggcucgcaagaccuuuguggaacugaugagacggggcgaccugccugucuggcucagcuacaaaguggccuccgagggguuccaguauucugaucgcagauggugcuuugacggcgaacggaacaaucaaguccuugaggaaaacauggauguggagauuuggacaaaggagggagaacgcaaaaagcugagaccgcgguggcuggacgcuagaaccuacagcgacccccucgcccugcgcgaguucaaggaauuugcugccggccggagauccguuucuggggaucuuauccuggagaucggaaaacucccucagcaccugacacagaaggcgcagaaugcccuggacaaccucgugaugcuucauaauagcgaacaaggcgggcgcgcuuaucggcacgccauggaggagcugcccgauaccauugaaacacugaugcuccuggcucuuaucgccgugcugaccggaggcgucacgcuguucuuucuguccggcagagggcugggaaaaacaagcauuggccuccuuuguguuauggccucuuccgugcugcuguggauggcuagcguggagccucauuggaucgcggccucuauuauccucgaguucuuucugaugguccuucugauccccgagccggaccggcagcgcaccccucaggauaaccagcucgcuuacgugguuauugggcugcuguucaugauccucaccguggccgccaaugagaugggacuucuggaaacaaccaagaaagaccugggcauugggcacgucgcuguggagaaccaccaucacgccgcgaugcucgaugucgaccugcaucccgccuccgcuuggacacuuuacgccguggcuacgaccaucauuacaccuaugaugagacacaccaucgaaaacacaaccgccaauauuagccugacggcgaucgccaaccaagcugccauccucaugggacuggauaagggcuggcccauuucuaagauggacaucggcguuccucugcucgcucuugggugcuauagccaggugaauccccugacccugacagccgcuguccucaugcugguggcccauuacgcgauuaucggaccgggccuucaggccaaagcuacccgggaggcccaaaagcgcacagcugccgggauuaugaaaaacccuaccguugauggaaucguggccaucgaccuggaucccgucguguaugacgcgaaguuugaaaaacagcucggccagauuaugcugcugauccucuguacgucccagauucuucugaugagaacaaccugggcucugugcgagucuaucacacucgccaccgggccccugaccacacuuugggagggaagcccuggcaaguucuggaauacgaccauugcuguguccauggccaacaucuuccggggcagcuaccuggccggggcuggacucgccuuuucccugaugaagucucugggcgggggacgcagaggcacaggggcgcaaggagaaacccucggcgagaaauggaagcggcagcuuaaucagcugagcaaauccgaguucaacacauauaagcgcucuggcaucauggagguugacagaagcgaagccaaagaggggcugaagcggggagagaccacgaagcacgcugucuccagaggcacagccaaacuccgcugguuuguggaacggaaucuggugaagccggaggggaaagucauugaucuuggauguggcagagggggauggucuuacuauugcgcuggccugaagaaaguuaccgaagugaagggcuacaccaaagggggacccggccacgaggaaccuauccccauggccacauacggguggaaccucgugaagcugcauagcggaaaggacgucuucuuuauuccucccgagaaaugugauacccugcucugcgacaucggcgaguccagcccuaauccgacaauugaagaggggcgcacgcuucgggugcugaagaugguugaacccuggcugagaggaaaccaguucuguaucaaaauucucaauccuuauaugcccucuguggucgagacccuggagcaaaugcagcgcaagcacggcggcaugcuugugcggaacccucuguccagaaauagcacacaugaaauguacuggguuucuugcgggaccggaaacaucguguccgcggucaauaugacaagccgcaugcuccugaaccgguuuaccauggcccacagaaaacccacguaugagcgcgauguggaccugggcgcugggacccggcacguggccgucgaaccggagguugcuaaccucgauaucauuggacagagaaucgaaaauauuaagcaugagcacaagucuacauggcauuacgacgaggauaacccuuauaaaaccugggccuaccacggcuccuaugaagugaagcccagcggguccgcuagcucuauggugaauggagucgugaaacugcuuacaaagcccugggacguuaucccuauggugacccagauugccaugacagauaccacgcccuucggccaacagcgcgucuuuaaagagaagguggacacaagaaccccuaaggcgaaacggggcaccgcccagaucauggaaguuacagcuaaguggcuguggggguuccucagccgcaacaaaaagccgagaaucuguacgcgggaggaauuuaccagaaaagugcgguccaaugccgcuauuggagccgucuucguggacgagaaccaauggaacucugccaaggaggcgguugaagaugagcgcuuuugggaccuggugcauagagaacgggagcuucacaagcagggcaaaugcgcuacaugcgucuacaacaugauggggaagcgcgagaaaaagcugggagaguucggcaaagccaaggggagcagagccaucugguacauguggcucggcgcucgguuccuggaguuugaagcccugggauucaugaaugaggaucacugguuuucccgcgaaaacucucucagcggcguggagggggagggacugcauaaacuuggcuauauucugagagacaucuccaagauucccgggggaaauauguacgcugaugacaccgccggcugggauacacggaucaccgaagacgaucuccagaacgaggcgaagaucacagacauuauggaaccugagcacgcccugcuugcuaaaucuaucuucaagcugaccuaucagaauaaagucgugcgcguucaaagacccgccaagaacgggacggugauggaugucauuagccggcgcgaccagagaggcuccggacaggugggcaccuacgggcucaauacauuuaccaacauggaagcucagcugauccggcaaauggagagcgagggaauuuucucuccuuccgaacuggagacacccaaccucgccggccgcgugcuggauuggcuugaaaaacaugggguugagagacugaagcggauggcgaucagcggagacgacuguguggucaagccgaucgaugacagauuugccaccgcucucacggcccugaaugauaugggcaaagugcgcaaggacauuccucagugggaacccucuaaaggguggaacgauuggcagcagguuccuuucugcucccaccacuuucaucaacuuaucaugaaggacggccgggagauugugguccccuguagaaaucaggaugagcuggugggacgcgcucgggucagccagggcgccggguggucccucagagaaacagcuugccugggaaaaucuuaugcccagauguggcaacugauguacuuccaccgccgggaccucagacuggcggccaacgcuaucuguagcgccgugccuguugauugggugcccaccucccgcacaaccuggagcauucaugcccaccaucaguggaugacgaccgaggacaugcuuucugucuggaaucggguguggaucgaagagaacccguggauggaagauaagacacacauuuccagcuggggcgacguuccuuaucuggggaagagagaggaccaguggugcggaucucucaucggccugaccgcucgcgccacaugggcgaccaauauccaaguggcuauuaaccagguccggagacuuaucgggaaugagaacuaccuggauuacaugacaagcaugaaacgguuuaagaaugaauccgaccccgagggcgcccucugguga

SEQ ID NO: 18899 - RNA, 9879 nt, Artificial Sequence
  derived and/or modified CDS sequence (opt5) from DENV-1__FJ432736__SS-prME
agcgugacaaugcugcugaugcugaugcccacagcccuugcuuuccaccugacgaccagaggaggggaaccucauaugaucgucuccaagcaggaacggggaaaaucucuccuguuuaagacaagcgccggcguuaacaugugcacccuuauugcgauggaccugggggaacucugugaagauacaaugaccuacaaaugcccccgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacugauucaucagaucuucgggaccgcuuacggagugcucuuuuccggcgugagcuggacgaugaagauugggaucggcguccugcuuaccuggcugggacucaauucuagauccacaagccugucuaugaccuguauugccgugggccugguuacacuuuaccucggggugaugguccaggcugauuccggaugcgugaucaacuggaaaggccgcgaacugaagugugggagcggaauuuucguuaccaaugaggugcacacauggaccgaacaauauaaguuucaggccgacuccccuaaacggcugucugcggccaucggcaaggcuugggaggagggggucugcggcaucagaagcgccacgcgccucgaaaacauuauguggaaacagaucuccaacgagcugaaucauauucuucuggaaaacgacaugaagcucacagugguugugggagaugucgcuggcauccuggggcagggcaagaaaaugauucggccgcaacccauggaguacaaauauucuuggaaaagcuggggcaaggccaagaucaucggggccgacgcucagaauaccaccuucauuaucgauggaccuaacacacccgaauguccugacgaucagagagcguggaauauuugggagguggaggacuacggcuuuggcaucuucaccacgaacauuuggcugaaacuucgcgauuccuauacacaggugugcgaccaccggcucaugagcgccgcuaucaaagauucuaaggccguccacgccgacaugggguacuggaucgaauccgagaaaaaugaaaccuggaagcuggcuagagccagcuuuauugagguuaagacauguaucuggcccaaaucucauacccugugguccaacggagugcucgaaagcgagaugauuaucccgaagauuuauggcgggccuaucucucaacacaauuaccgccccggauaccugacacagaccgcgggcccuuggcaucuugggaaacuggagcucgauuucgaccugugcgaaggaacgaccguggucguggaugagcacugcggcaaccggggccccagccugagaacaaccacaguuaccgggaagaucauucacgaaugguguugccgguccuguacgcuuccuccccuccgcuucagaggagaggacggcugcugguaugggauggagauccggccggugaaagaaaaggaggaaaaucuggucaagagcauggugucugcuggaccuggcgagguugacuccuuuagccuggggcuccuguguauuuccaucaugauugaagaggugaugagaucucgcuggagccggaaaaugcuuaugacaggaacccuggccgucuucuuucuccugaucaugggccagcugacauggaacgaucuuauuagacugugcaucauggugggcgccaaugcuuucgaccgcauggggaugggaaccaccuaccucgcccugauggcgacauuuaagaugagacccauguucgcuguuggccuccuguuucggcgccuuacguccagagaggugcugcuccugaccaucgggcugucucuugucgccagcguggaacugcccaacucccucgaggaacugggagauggccucgccauggggauuaugauccugaaacuucugacagacuuccaaucucaucagcucugggcuacccugcugagccuuacauuuauuaagaccacguucucccugcacuaugccuggaaaacaauggcuauggugcucagcaucgucucucuguuuccucucugucuguccaccaccagccagaagacaaccuggcuuccgguucugcugggaucucucggcugcaagccccugacaauguuccuuauugccgagaauaaaaucuggggccggaaguccuggccucugaacgaagggaucauggcggugggaauugugagcauccuccugucuucccuccugaaaaacgaugucccccuugccggcccucugauugcugggggaaugcugaucgccuguuacgugauuagcggcuccagcgcugaccucucucuggagaaggccgccgagguuagcugggaagaggaagcugagcauuccggggcgucucacaauauccuuguggaaguccaggaugacggaacgaugaaaaucaaggaugaggagcgcgacgauacccugacaauucuccugaaagccacccuccuggcugugagcggcguuuauccccuuuccaucccugccacacuguuugugugguacuucuggcaaaagaagaaacagagaucuggcguccugugggacacccccagcccgccugaaguggagcgggccguccucgaugacgggauuuaucgcaucaugcagagaggacugcuuggccggucccagguggggguuggaguguuccaagaaaacgucuuucauacgauguggcacgugacccgcggcgcuguucugauguaccaggggaagagacucgagcccucuugggccagcgugaaaaaggaccugauuuccuacggaggcggcuggcggcucagagggagcuggaauacaggagaggaaguccaggugaucgcgguggagccuggcaaaaaccccaagaauguucagaccgcuccggggacauucaagaccccugaaggagaggucggcgccauugcccuggauuuuaaacccgggacaucuggauccccuaucgugaaccgcgaaggcaagaucgugggccuuuaugggaauggagucgugacgaccagcggcauuuacguuucugcuaucgcccaagcgaaggcuucccaggaggggccccugcccgagauugaagacgagguguuccggaagagaaaccugacaaucauggaucuccacccuggaagcggcaaaacccgccgguaucugccggccauugucagagaagccaucaagcgcaaacuucggacccugauccucgcucccacaagagugguugccuccgagauggcugaagcccugaaagggaugccuauucgcuaccagacgaccgcggugaagucugagcauacaggcaaagagaucgucgaccugaugugccacgccaccuuuacaaugcggcuccuuagccccgugagaguuccuaauuauaacaugauuaucauggaugaagcucauuucaccgaccccuccagcauugccgcucggggauacaucucuacgcgcgugggcaugggggaggccgccgcuaucuuuaugacagcgaccccuccgggauccgucgaagccuucccccaaagcaaugcugugauucaggaugaggaaagagacaucccugagcggucuuggaacagcggccacgaguggauuaccgauuuucccgggaagacagugugguucgucccuuccaucaaaucuggaaaugacauugccaacugucugcgcaagaauggcaagagaguuauccagcugagccggaaaaccuuugauacagaauaucagaagaccaaaaacaacgacugggacuacguggugacgacagauauuuccgagaugggggccaauuucagagcugaccgcgucaucgauccccggagaugccucaagccggugauccugaaagacggcccugaacgcguuauucuugccggacccaugcccgugaccgucgcgucugcugcccaacggagaggccgcaucgggcggaaccauaauaaggagggagaucaguacauuuauaugggccagccucugaacaaugacgaggaucacgcccacuggacagaagcuaagaugcuccuggacaacaucaauacccccgaggggauuaucccugcccuguucgaaccggagagagaaaagagcgcggccguggauggagaguaccgccucagaggcgaggcucggaagacguuuguugagcuuaugcgcagaggggaccugcccguguggcuguccuauaaagucgccagcgagggcuuccaguacucugaucggcgcuggugcuuugacggagaaagaaacaaucaagugcucgaggaaaacauggaugucgagaucuggaccaaggagggcgaacggaaaaagcugagaccucgcuggcuugacgcucggacauauuccgacccccuggcccucagagaguucaaagaauuugcugccgggcgccggagcguguccggagaucugauucuggagaucggcaagcucccucagcaucuuacccagagagcgcagaaugcccuggacaaccugguuaugcuccacaauucugaacaagggggacgggcuuaccgccaugccauggaggagcugcccgauacaauugaaacccuuaugcugcucgcucugaucgccgugcugacaggcggcgugacccucuucuuucuuagcgggagaggacugggcaagacguccauugggcugcucugugucauggccucuagcguucugcuuuggauggcuuccguggagccgcacuggaucgcggccagcaucauucuggaguucuuucucauggugcugcugaucccugagcccgaccggcagcgcacaccucaggauaaccagcucgcuuaugucgugauuggacuucuguucaugauccugaccguugccgccaaugagaugggccuccuggaaaccaccaagaaggaccuugggauuggacacguggcugucgagaaccaucaccaugccgcgaugcuggauguggaccuccaccccgccucugcuuggacccuguacgccgucgcuacaacgaucauuaccccuaugaugagacauacaaucgaaaacaccacagccaauaucucccugaccgcgauugccaaccaagcugccauccucaugggccuugauaaaggcuggcccauuagcaagauggacaucggggugccgcugcuggcucucggaugcuacucucagguuaauccucugacgcuuaccgccgcugugcugaugcucgucgcccacuaugcgauuaucggccccgggcugcaggccaaagcuacacgggaggcccaaaagcgcaccgcugccggaaucaugaagaaccccacaguggauggcauuguugccaucgaccuggauccuguggucuacgacgcgaaauuugaaaagcagcucgggcagauuaugcuucugauccuguguaccucccagauucuccugaugagaacgacaugggcucuuugcgagagcaucacccuggccacaggaccgcucaccacccugugggagggcucucccggcaaauucuggaauacaacgaucgcugugagcauggccaacauuuuucggggguccuaucuggccggagcuggccucgccuucucucuuaugaaaagccucgggggaggccgcagagggaccggagcgcaaggcgaaacacugggcgagaaauggaagcggcagcucaaucagcuguccaagagcgaguucaacaccuacaaaagauccgggaucauggagguggaccgcucugaagccaaggagggacuuaaacggggcgagacaaccaagcacgcuguuagcagagggacggccaaacugcgcugguuugucgaacggaaucucgugaagccugagggaaaggugauugaucugggcugugggagaggaggcugguccuauuacugcgcuggccugaaaaaggucacagaaguuaaaggguauaccaagggaggccccgggcaugaggaaccuauccccauggccaccuacggauggaaccucgugaaacuucacucuggcaaggacguguucuuuauuccuccggagaaaugugauacacugcugugcgacaucggggagagcucccccaauccuaccauugaagagggacgcacacuccggguccugaagaugguggaacccuggcuuagaggcaaccaguucuguaucaagauccugaauccuuacaugcccucuguuguggagacgcucgagcaaaugcagcgcaaacauggcgggaugcugguccggaacccgcugagcagaaauuccacccacgaaauguauugggugagcugcggaacaggcaacauuguuucugcggugaauaugaccucccgcaugcuccugaaccgguuuacaauggcccacagaaagccuaccuacgagcgcgaugucgaccuugggacgggaaccagacauguggcuguggaacccgaggucgccaaccuggauaucauuggccagcggaucgaaaauauuaaacacgagcauaagagcacauggcacuaugacgaggauaaccccuacaaaaccugggcuuaucaugggucuuacgaaguuaagccuuccggaagcgccucuuccauggugaauggcguggucaagcuccugacaaaacccugggacgugaucccuaugguuacccagaucgcuaugacagauaccacgccguucggccaacagcgcguguuuaaggagaaagucgacacaagaacccccaaggccaaacgggggaccgcgcagauuauggaagugacagccagauggcuuuggggauuccugagccggaacaagaagccucgcaucuguacgagagaggaauuuacccggaaaguucgcuccaaugcugccauuggcgcuguguucgucgacgagaaccaauggaauagcgccaaggaggccguggaagaugagagauuuugggaccucguucaccgggaacgcgagcugcacaaacaggggaagugcgcgacaugcguguauaacaugaugggaaaaagagaaaagaagcugggcgaguucgggaaagcuaagggcucucgggccaucugguacauguggcucggagcccgcuuucuggaguucgaagcucuuggcuucaugaaugaggaucauugguuuagcagagaaaacucccugucuggggucgagggagagggccuccacaaacugggguacauucuucgggacaucagcaagauccccggaggcaauauguaugccgaugacaccgcugggugggauacacgcauuaccgaagacgaucugcagaacgaggccaaaaucacagacauuauggaaccugagcaugcgcuccuggccaaggcuaucuucaaacugaccuaccagaauaagguggucagagugcaacggcccgccaagaacggcacgguuauggaugugauuucccgcagagaccagcggggaucuggccaggucgggaccuauggacucaauacauuuaccaacauggaagcucagcugaucagacaaauggagagcgagggcaucuucuccccgucugaacuugagacaccuaaccuggccgaacgcgcgcucgauuggcuggagaaauacgggguggaacggcuuaagagaauggccauuagcggagacgacugugugguuaaacccaucgaugaccgcuuugcuaccgcccugacggcucucaaugauaugggcaaggugcggaaagacauuccucagugggagcccuccaagggguggaacgauuggcagcaggucccuuucugcagccaccacuuucaucaacugaucaugaaggacggcagagagauugugguucccugucgcaaucaggaugaacuggugggacgggccagagucucucagggcgcuggguggucccuccgcgagacagccugccugggaaaaagcuaugcgcagauguggcaacuuauguacuuccaccggagagaccugcgccucgccgcuaacgccaucuguucugccgugccggucgauugggugccuaccucccggacaaccuggagcauucaugcucaccaucaguggaugacgaccgaagacaugcuguccguuuggaauagaguguggaucgaggaaaaccccuggauggaggauaagacacacaucucuagcugggaggacguccccuaucuuggcaaacgggaagaccaguggugcgggucccugauuggacucaccgccagagcgacaugggcuaccaauauccaaguggccauuaaccagguucgccggcugaucggcaaugagaacuaccuggauuacaugacaagcaugaagagauuuaaaaaugaaucugacccugagggggcccucugguga

SEQ ID NO: 18900 - RNA, 9879 nt, Artificial Sequence
  derived and/or modified CDS sequence (opt5) from DENV-1__FJ410198__SS-prME
agcgugaccaugcugcucaugcugaugcccacagcgcuugcuuuccaccugacgaccagaggcggggagccucauaugaucgucuccaagcaggaacggggaaaaucucuccuguuuaagacaagcgccggcguuaacaugugcacccuuaucgcgauggaccugggggagcucugugaagauacaaugaccuacaaaugcccccgcaucacagagaccgaacccgacgauguggacuguuggugcaaugcuacggauaccugggugacauauggaaccuguucccagacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaggaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaagucgcugagacccagcacggaacagugcugguucagauuaaguacgagggcaccgacgccccgugcaaaaucccuuucuccacacaagaugaaaagggggugacgcagaacggacggcugaucaccgcgaaucccauugucacagacaaagagaagccugugaacaucgaagcugagccgcccuuuggcgagagcuauauugugaucggggccggagaaaaagcccuuaagcucucuugguucaagaaaggcagcuccauugggaagauguuugaggcuaccgccagaggcgcucgccggauggccauccugggagauacagcgugggacuucggcucuaucgggggaguuuuuaccagcgucggcaaacuggugcaucagauuuucgggacggccuacggagugcucuuuuccggcgucagcuggaccaugaagaucgggauuggcgugcugcuuacauggcugggacucaauucuagauccaccagccugucuaugacauguaucgcuguuggccuggugacccuuuaccucggggucauggugcaggccgauuccggaugcguuauuaacuggaaaggccgcgaacugaagugugggagcggaaucuucgugacaaaugagguccacaccuggacggaacaauauaaguuucaggcugacuccccuaaacggcugucugccgcgauuggcaaggccugggaggagggggugugcggcaucagaagcgcuacacgccucgaaaacaucauguggaaacagauuuccaacgagcugaaucauauccuucuggaaaacgacaugaaguucaccguuguggucggagauguggccggcauucucgcucaggggaaaaagaugauccggccgcaacccauggaguacaaauauucuuggaaaagcuggggaaaggccaagauuaucggcgccgacgugcagaauaccacauuuaucauugaugggccuaacacccccgaauguccugacgaucagagagcuuggaauaucugggaggucgaggacuacggauucggcauuuuuacgacaaacaucuggcugaagcugcgcgauuccuauacccagguuugcgaccaccggcuuaugagcgcggccauuaaagauucuaaggcugugcacgccgacaugggcuacuggaucgaauccgagaaaaaugaaacauggaagcucgccagagcuagcuucaucgaggugaagaccuguauuuggcccaaaucucauacacugugguccaacgggguccuggaaagcgagaugaucauuccgaagaucuauggaggcccuauuucucaacacaauuaccgccccggguacuucacccagacggccggaccuuggcaucucggcaaacuggagcuugauuuugaccugugcgaagggaccacagugguuguggaugagcacugcggaaaccggggccccagccucagaaccacaaccgucacgggcaagaucauccacgaaugguguugccgguccuguacacugccuccccugcgcuucagaggggaggacggaugcugguauggcauggagauucggccggugaaagaaaaggaggaaaaucuuguuaagagcauggugucugcgggguccggagaggucgacagcuuuucccucggccugcuguguaucucuauuaugaucgaagaggugaugagaagccgcuggucccggaaaaugcucaugaccgggacacuggcuguuuucuuucuucugauuaugggacagcucaccuggaacgaucugaucagacugugcauuauggugggcgccaaugccucugaccgcaugggcauggggaccacauaccuugcucugauggccacguucaagaugagaccuauguuugcggucggacuccuguuccggcgccucaccagcagagaggugcugcuucugacaaucggccucucccugguggcuucugucgaacugcccaacagccuugaggaacugggggauggacucgccaugggcaucaugauucugaaacuccugaccgacuuucaaucccaucagcuuugggccacacugcucagccugaccuucaucaagacgacauuuucucugcacuaugcuuggaaaaccauggccaugguucuuuccauugugagccuguucccccucugucugucuaccacaucccagaagaccacauggcucccugugcugcuugggagccugggaugcaagccgcugacgauguuucucaucgcugagaauaaaauuuggggccggcgcucuuggccccugaacgaaggcaucauggccgucgggaucguguccauucuucugagcucccuccugaagaacgauguuccucucgcgggaccccugaucgccggcgggaugcuuauugcuuguuacgugaucagcggaucuagcgccgaccugucccuggagaaagcugccgaggucucuugggaagaggaagccgagcauagcggcgcuucccacaauauucucguggaaguucaggaugacgggaccaugaagaucaaagaugaggagagagacgauacacugaccauccuucugaaggcgacacuccuggccgugucuggagucuauccucucagcauucccgcuacccuguucgugugguacuucuggcagaagaagaagcagcgguccggcguccuuugggacacgccuucucccccggaagugggccgcgccguucuggaugacgggaucuauagaauuaugcagcggggacugcucggccgcagccaggugggggucggaguguuucaagagaacguuuuccauaccauguggcacgugacaagaggcgccguccugauguaccaggggaaacggcuugaaccuuccugggcuagcgugaagaaagaccugaucucuuacggaggcggcuggagacuccagggguccuggaauaccggagaggaggugcagguuauugccgucgaacccggcaagaacccuaaaaaugugcaaacagcgcccgggaccuuuaagacaccggagggagaagugggcgcuaucgcccuggauuucaagccugggacgagcggaucucccauugucaaccgcgagggcaaaaucgugggccucuaugggaauggaguugugaccacauccggcaccuacgucagcgccaucgcucaggccaaggcgucccaggaagggccucugcccgagauugaggacgaaguguuucggaaaagaaaccuuaccaucauggaucugcaccccggaucuggcaagacacgccgguaucugccugcuauuguuagagaggccaucaaacgcaagcuccggacgcugauucuugccccgaccagaguggucgcuagcgaaauggccgaggcucugaaggggaugcccauccgcuaccaaacaaccgccgugaaauccgaacauacaggcaaggagaucguugaccucaugugccacgcgaccuucacgaugcggcugcugagcccugugagaguccccaauuauaacaugauuaucauggaugaggcccauuuuacagacccuucuuccauugcugcccggggauacaucagcacccgcgugggcaugggggaagcugccgccauuuucaugaccgcuacacccccuggaucuguggaggcguuuccgcagagcaaugccgucauccaggaugaagagagagacauccccgaacgguccuggaacucuggcuaugaguggauuaccgauuucccugggaaaacaguuugguuugugcccagcaucaaguccggaaaugacauugcuaacugucuccgcaaaaauggcaagagagugauccagcuuucucggaagaccuucgauacggaguaccagaaaaccaagaacaacgacugggacuacgucgugaccacagauauuagcgaaaugggggccaauuucagagccgaccgcguuaucgauccucggagaugccugaaacccgugauucugaaggacggcccggagcgcgucauccucgcuggaccuaugcccgugaccguugccuccgcggcucagcggagaggccgcaucgggcggaaccacaauaaagaaggagaucaguauauuuacaugggccagccccugaacaaugacgaggaucaugcccacuggacggaggccaagaugcuucuggacaacaucaauaccccugaagggauuauccccgcucucuuugagccugaaagagaaaagagcgccgcgauugauggagaauaucgccugagaggcgaggcccggaaaacauucguggagcugaugcgcagaggggaccucccggucuggcuuucuuacaagguggcuuccgaaggcuuucaauauagcgaucggcgcuggugcuucgacggagagagaaacaaucagguccuggaagagaacauggauguggaaaucuggaccaaagagggcgagcggaagaaacugagaccccgcuggcucgacgcccggacauacuccgacccucuggcucuuagagaauuuaaggaguucgccgcugggcgccggucuguuagcggagaucugauccucgaaauuggcaaacugccccagcaccugacccagagagcccaaaaugcgcucgacaaccuugugaugcugcauaauuccgagcaagggggacgggccuaucgccacgcuauggaggaacugccugauacaaucgagacccucaugcugcuugcccugauugcugugcucacgggcggcgucacacuguuuuuccugucugggagaggacucggcaagaccagcaucgggcuucuguguguuauggccuccagcgugcugcucuggauggccucuguggaaccccauuggauugcugcguccaucauccuggaguuuuuccuuaugguccugcucauuccggaaccugaccggcagcgcacaccccaggauaaccaacuggccuacgugguuaucggacugcucuuuaugauucuuacaguggcugccaaugagaugggccugcuggagaccacaaagaaagaccucgggaucggacacgucgccguggaaaaccaccaucacgcuacgaugcuggaugucgaccuucauccugccagcgcguggacccuguacgccguggcuacaaccauuaucacacccaugaugagacacaccauugagaacacgaccgccaauaucucucucacagcuaucgccaaccaggcggccauucugaugggccuggauaagggcuggccuaucuccaaaauggacauugggguuccccuccuugcucugggaugcuauagccaggugaauccgcugacccucacagccgcuguccugaugcuuguggcccauuacgcuaucauuggcccugggcugcaagccaaggcgacccgggaagcccagaaacgcacggcugccggaaucaugaagaaccccacaguugauggcaucguggcuauugaccucgaucccgucguguaugacgccaaguucgagaaacagcuggggcagaucaugcugcucauucuuuguaccucucaaauccugcugaugagaacaaccugggcccucugcgaaagcauuacccuggcgacaggaccucuuacgacccugugggagggcuccccgggcaaguuuuggaauacaaccaucgcugugucuauggccaacaucuuccgggggagcuaccucgcuggagccggccuggccuucucccugaugaaaagccucgggggaggccgcagagggacaggagcucagggcgagacccuuggcgaaaaguggaaacggcagcugaaucagcuguccaagucugaguuuaacacguauaagagaagcgggauuauggaaguugaccgcuccgaggccaaagaaggacucaagcggggcgagacaaccaaacacgcggucucuagagggaccgccaagcugcgcugguucguggagcggaaucuugugaaacccgaaggaaaggucaucgaucugggcugugggagaggaggcuggagcuacuauugcgcuggccucaagaaaguuacagaggugaagggguacaccaaaggaggcccugggcacgaggagcccauuccuauggccacauacggauggaaccuggugaagcugcauuccggcaaagacgucuuuuucauucccccugaaaagugugauacgcuccuuugcgacauuggggagucuagcccgaaucccaccaucgaggaaggacgcacacugcgggugcugaaaaugguugagccuuggcucagaggcaaccaauuuuguauuaagauccugaaucccuauaugccuuccguggucgaaacccuugagcagaugcagcgcaagcacggcgggaugcuggugcggaacccccucagcagaaauucuacacaugagauguacuggguuuccugcggaaccggcaacaucgugagcgcugucaauaugacgucucgcaugcugcugaaccgguucaccauggcccacagaaaaccgacauaugaacgcgauguggaccucggggcgggaaccagacacguggccgucgagccugaaguugcuaaccuggauauuaucggccagcggauugagaauaucaagcaugaacacaaauccacauggcauuacgacgaggauaaccccuauaagaccugggccuaccacgggagcuaugaggugaaacccucuggauccgcuagcuccauggugaauggcgucgugaaacuucugacaaagccuugggacguuauucccauggugacccaaaucgccaugacggauacaaccccuuuuggccagcagcgcgucuucaaagaaaagguggacaccagaacaccgaaagcuaagcgggggacggcccaaaucauggagguuaccgcgaaauggcucuggggauuucugagcagaaacaagaagccccggauuuguacacgcgaagaguucaccagaaaagugcggucuaaugccgcuaucggcgccgucuuuguggacgaaaaccaguggaauagcgcuaaggaggccguugaggaugaacgcuucugggaccuugugcauagagagcgggaacugcacaaacaggggaagugcgccacaugcgucuacaacaugaugggaaaacgcgagaagaagcucggcgaauuugggaaagcgaagggcuccagagcuauuugguacauguggcugggagcccgguuccuggaguucgaggcccucggcuuuaugaaugaagaucacugguucucucgcgagaacagccuguccgggguggaaggagagggccuucauaaacugggguauauccucagagacauuucuaauaucccuggaggcaacauguacgcugaugacaccgccgggugggauacacggaucaccgaggacgaucugcagaaugaagcucgcauuacggacaucauggagcccgaacacgcccuucuggccaagagcauuuuuaaacucaccuaucaaaacaaggucgugagaguucagcggccugccaaaaauggcacagugauggaugucaucucccgcagagaccagcggggaucuggccagguggggaccuacggacugaacacauucaccaacauggaggcucaacugauuagacagauggaaagcgagggcaucuuuucccccagcgagcucgaaacgccgaaucuggccgagcgcgugcuugauuggcuggaaaaguaugggguugagcggcucaagagaauggcuaucucuggagacgacuguguggucaaaccuauugaugaccgcuucgccacagcgcugaccgcccuuaacgauaugggcaaggugcggaaagacaucccccagugggaaccuuccaagggguggaaugauuggcagcaaguucccuuuugcagccaucacuuccaccagcugauuaugaaagacggcagagagaucguggucccuugucgcaaccaggaugagcucgugggacgggcuagagucucucagggcgccggguggucccugcgcgaaacagcuugccugggaaagagcuacgcccaaauguggcagcucauguauuuucaucggagagaccugcgccuugcugccaaugcgauuuguuccgccgugcccguugauuggaucccgaccucucggacgaccuggagcauucacgcucaucaccaguggaugacaaccgaggacaugcuguccguguggaacagagucuggaucgaagagaauccuuggauggaagauaagacacauaucagcucuuggggcgacgugcccuaccucgggaaacgggaggaccaauggugcggaucccugauuggccuuaccgccagagccacaugggcuaccaacauccagguugccauuaaucaggugcgccggcugaucgggaacgagaauuaccucgauuauaugacgagcaugaagagauucaaaaacgaaucugaccccgagggcgcgcugugguga

SEQ ID NO: 18901 - RNA, 9879 nt, Artificial Sequence
  derived and/or modified CDS sequence (opt5) from DENV-1__FJ410199__SS-prME
uccgugaccaugcugcugaugcugaugcccaccgcccuugcuuuccaccugacgaccagaggcggggaaccucauaugaucgucuccaagcaggaacggggaaaaucucuccuguuuaagacaagcgccggcguuaacaugugcacccuuauugcgauggaccugggggaguucugugaagauacaaugaccuacaaaugcccgcgcaucacagaagcugaacccgacgauguggacuguuggugcaaugccaccgauacgugggugaccuauggaacauguucccaaaccggcgagcacagacgggacaagcgcucugucgcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaggacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaaagcuggcuuguccauaagcagugguuccuggaucucccucugcccuggacauccggggcuucuaccagccaagagacauggaaucgcaaagaccuucuggugaccuuuaagaccgcgcacgccaagaaacaggaagucgugguucucggaucccaggagggcgcuaugcacacagcccugacgggggccaccgaaauccaaacaagcggaaccacaaccauuuucgcuggccaucugaagugcagacucaaaauggauaagcugacgcuuaaagggaugucuuaugugauguguacaggcuccuucaagcuggagaaggaagucgccgagacccagcacggaaccgugcucguucagaucaaauacgagggcacagacgcgccgugcaagauuccuuuuagcacccaggaugaaaaaggggugacacaaaacggacggcugaucacggcuaaucccaucgucaccgacaaggagaaaccugugaacauugaagccgagccgcccuucggcgagucuuauaucgugauuggggccggagaaaaggcucugaaacuuagcugguuuaaaaagggcuccucuaucgggaaaauguucgaggccacagcuagaggcgcccgccggauggcgauucucggagauaccgccugggacuuuggcagcaucgggggaguuuucacauccgucggcaagcuggugcaucagaucuuugggaccgcuuacggagugcuguucagcggcgucucuuggacgaugaaaauugggaucggcgugcuccugaccuggcuuggacucaauuccagaagcacaucucucuccaugaccuguauugccguuggccuggugacacuguaccuuggggucauggugcaggcugauagcggaugcguuaucaacuggaagggccgcgaacucaaguguggguccggaauuuuugugaccaaugagguccacacauggaccgaacaguauaaauuccaagccgacucuccuaagcggcugagcgcggccaucggcaaggcuugggaggagggggugugcggcauuagauccgccacgcgccuggaaaacaucauguggaagcagaucucuaacgagcucaaucauauucugcuugaaaacgacaugaaauuuacaguuguggucggagauguggcuggcauccuggcccaggggaagaaaaugauucggccgcagcccauggaguacaaguauagcuggaaguccuggggaaaagccaagaucauuggcgcugacgugcaaaauaccaccuucaucaucgaugggccuaacacacccgaauguccugacgaucagagagcguggaauauuugggaggucgaggacuacggauuuggcaucuucaccacgaacauuuggcucaaacugcgcgauagcuauacacagguuugcgaccaccggcugaugucugccgcuaucaaggauuccaaagccgugcacgccgacaugggcuacuggauugaaagcgagaagaaugaaaccuggaaacuugcuagagccucuuucaucgaggugaaaacauguaucuggcccaagucccauacccucuggagcaacgggguccuggaaucugagaugauuaucccgaaaaauuauggaggcccuauuagccagcacaacuaccgccccggguacuuuacacaaaccgcgggaccuuggcaucugggcaagcucgagcuggauuucgaccuuugcgaagggacgaccgugguuguggaugagcacugcggaaaucggggccccucccugagaacaaccacagucaccggcaaaaucauucacgaaugguguugccggagcuguacgcucccuccccugcgcuuuaagggggaggacggaugcugguauggcauggagaucagaccggugaaggaaaaagaggaaaaccugguuaagucuaugguguccgcugggagcggagaggucgacuccuucucucuuggccuccuguguaucagcauuaugaucgaagaggugaugcgguccagauggucucgcaaaaugcugaugacagggacccucgccguucuguuucuucugauuaugggacagcucacauggagcgaucugauccggcugugcauuauggugggcgccaaugcuuccgacagaaugggcauggggaccaccuaccuugcccugauggcgacauucaagaugcgcccuauguuugcugucggacuccuguucagacggcucacgucucgcgaggugcugcuucugaccaucggccucagccugguggccuccgucgaacugcccaacagccuugaggaacugggggauggacucgccaugggcauuaugauccugaaacuccugacagacuuucagucucaucaacuuugggcuacccugcucucccugacauucaucaagaccacguuuagccugcacuaugccuggaagacaauggcuaugguucuuucuauugugucccuguucccccucugucugagcaccaccucucagaaaacaaccuggcucccugugcugcuugggucccugggaugcaagccgcugacaauguuucucaucgccgagaauaaaauuuggggcagaaagagcuggccccugaacgaaggcaucauggcggucgggauuguguccauccuucugagcucucuccugaaaaacgauguuccucucgccggaccccugaucgcuggcgggaugcuuauugccuguuacgugaucagcggauccucugcugaccugagccuggagaaggccgccgaggucuccugggaagaggaagcugagcauucuggcgcgagccacaauauucucguggaaguucaggaugacgggacgaugaaaaucaaggaugaggagcgggacgauacccugacaauucuucugaaggccacccuccuggcuguguccggagucuauccucucucuauccccgccacacuguucgugugguacuucuggcagaaaaagaaacaacgcagcggcguccuuugggacaccccuagcccucccgaaguggagagagccguucuggaugacggcaucuaucggauuaugcagcgcgggcugcucggaagaagccaggugggcgucgggguguuucaggaaaacguuuuccauacgauguggcacgugacccggggagcuguccugauguaccaaggcaagcgccuugagcccucuugggccuccgugaaaaaggaccugaucagcuacgggggaggcuggagacuccagggcucuuggaauacaggggaggaagugcagguuauugcggucgagcccggaaagaacccuaaaaaugugcagaccgcucccggcacauuuaagaccuccgaaggggaggugggagccaucgcccuggauuucaaaccgggcacaagcggguccccuauugucaaccgggaaggaaagaucgugggccucuauggcaaugggguugugacgaccucuggaacauacgucagcgcuauugcccaagcgaaggcuucccaggagggcccccugccugagaucgaagacgagguguuuagaaagcgcaaccuuaccaucauggaucugcaccccgggagcggaaagacccggaaauaucugcccgccauuguuagagaagccaucaagcgcaaacuccggacacugauucuugcuccuacgagaguggucgccucugagauggcugaagcccugaagggcaugccgauccgcuaccagaccacagcggugaaauccgagcauaccgggaaggagauuguugaccucaugugccacgccacauucaccaugcggcugcugagccccgugagagucccuaauuauaacaugaucaucauggaugaagcucauuuuacggaccccucuagcauugccgcucgcggcuacaucuccacacgggugggaaugggcgaggccgccgcuauuuucaugaccgcgaccccucccgggucuguggaagccuuuccucaaagcaaugcugucauccaggaugaggaaagagacauuccggagcgguccuggaacucuggauaugaguggaucacagauuuccccggcaagaccguuugguuugugccuagcaucaaauccgggaaugacauugccaacugucuccgcaagaauggaaaaagagugauccagcuuagccggaagacauucgauaccgaauaccagaaaacgaagaacaacgacugggacuacgucgugacaaccgauauuucugagaugggcgccaauuuccgcgcugacagaguuaucgauccccggagaugccugaagccugugauucugaaagacgggcccgaacgcgucauccucgccggcccgaugccugugacaguugcguccgcugcccaacggagaggacgcauuggccggaaccacaauaaggagggggaucaguauaucuacaugggacagccccugaacaaugacgaggaucaugcccacuggaccgaagcuaaaaugcuucuggacaacaucaauacgcccgagggcauuaucccugcccucuuugaacccgagagagaaaagagcgcggccauugauggggaguaucgccugcggggagaggcuagaaaaaccuucguggaacugaugcgcagaggcgaccucccugucuggcuuuccuacaagguggccucugagggguuucaguauagcgaucggcgcuggugcuucgacggcgaaagaaacaaucaaguccuggaggaaaacauggauguggagaucuggacaaaagagggagaacggaagaagcugcgcccgagauggcucgacgcucggaccuacuccgacccccuggcccuuagagaguuuaaagaguucgcugccggccgccggucuguuagcggggaucugauucucgagaucggaaagcugccucagcaccugacacagagagcgcagaaugcccucgacaaccuugugaugcugcauaauuccgaacaaggcgggcgcgcuuaucggcacgccauggaggagcugcccgauaccaucgaaacacucaugcugcuugcucugauugccgugcucaccggaggcgucacgcuguuuuuccugagcggcagagggcucggaaaaacaucuaucggccuucuguguguuauggccuccagcgugcugcucuggauggcuucuguggagccucauuggauugcggccuccaucauucuggaauuuuuccuuaugguccugcucauccccgagccggaccggcagcgcaccccucaggauaaccagcuggcuuacgugguuaucgggcugcucuuuaugauucuuaccguggccgccaaugagaugggacugcuggaaacaaccaagaaagaccucggcaucgggcacgucgcuguggagaaccaccaucacgccgcgaugcuggaugucgaccuucaucccgccagcgcuuggacacuguacgccguggcuacgaccauuaucacaccuaugaugagacacaccauugaaaacacaaccgccaauaucucucucacggcgauugccaaccaagcugccauccugaugggacuggauaagggcuggcccaucagcaagauggacauuggcguuccucuccuugcucuggggugcuauucccaggugaauccccugacccucacagccgcuguccugaugcuuguggcccauuacgcgaucauuggaccgggccugcaggccaaagcuacccgggaggcccaaaagcgcacagcugccgggaucaugaaaaacccuaccguugauggaauuguggccaucgaccucgaucccgucguguaugacgcgaaguucgaaaaacagcugggccagaucaugcugcucauucuuuguacgucucagauccugcugaugagaacaaccugggcucucugcgagagcauuacacuggccaccgggccccuuaccacacugugggagggauccccuggcaaguuuuggaauacgaccaucgcugugagcauggccaacauuuuccggggcuccuaccucgccggggcuggacuggccuucucucugaugaagucccucggcgggggacgcagaggcacaggggcgcaaggagaaacccuuggcgagaaauggaagcggcagcugaaucagcuguccaaaucugaauuuaacacauauaagcgcagcggcaucauggagguugacagauccgaagccaaagaggggcucaagcggggagagaccacgaagcacgcugucucuagaggcacagccaaacugcgcugguucguggaacggaaucuugugaagccggaggggaaagucaucgaucugggauguggcagagggggauggagcuacuauugcgcuggccucaagaaaguuaccgaagugaagggcuacaccaaagggggacccggccacgaggaaccuauucccauggccacauacggguggaaccuggugaagcugcauuccggaaaggacgucuuuuucaucccucccgagaaaugugauacccuccuuugcgacauuggcgagagcucuccuaauccgacaaucgaagaggggcgcacgcugcgggugcugaagaugguugaacccuggcucagaggaaaccaguuuuguauuaaaauccugaauccuuauaugcccuccguggucgagacccuugagcaaaugcagcgcaagcacggcggcaugcuggugcggaacccucucagcagaaauucuacacaugaaauguacuggguuuccugcgggaccggaaacauugugagcgcggucaauaugacaucucgcaugcugcugaaccgguucaccauggcccacagaaaacccacguaugagcgcgauguggaccucggcgcugggacccggcacguggccgucgaaccggagguugcuaaccuggauaucaucggacagagaauugaaaauaucaagcaugagcacaaguccacauggcauuacgacgaggauaacccuuauaaaaccugggccuaccacggcagcuaugaagugaagcccuccgggagcgcuucuagcauggugaauggagucgugaaacuucugacaaagcccugggacguuauuccuauggugacccagaucgccaugacagauaccacgcccuuuggccaacagcgcgucuucaaagagaagguggacacaagaaccccuaaggcgaaacggggcaccgcccagauuauggaaguuacagcuaaguggcucuggggguuucugucccgcaacaaaaagccgagaaucuguacgcgggaggaguucaccagaaaagugcggucuaaugccgcuaucggagccgucuuuguggacgagaaccaauggaauagcgccaaggaggcgguugaagaugagcgcuucugggaccuugugcauagagaacgggagcugcacaagcagggcaaaugcgcuacaugcgucuacaacaugauggggaagcgcgagaaaaagcucggagaguuuggcaaagccaagggguccagagccauuugguacauguggcugggcgcucgguuccuggaguucgaagcccucggauuuaugaaugaggaucacugguucucucgcgaaaacagccuguccggcguggagggggagggacuucauaaacugggcuauauccucagagacauuucuaagauccccgggggaaauauguacgcugaugacaccgccggcugggauacacggauuaccgaagacgaucugcagaacgaggcgaagaucacagacaucauggaaccugagcacgcccuucuggcuaaaagcauuuuuaagcucaccuaucagaauaaagucgugcgcguucaaagacccgccaagaacgggacggugauggaugucaucucccggcgcgaccagagaggcagcggacaggugggcaccuacgggcugaauacauucaccaacauggaagcucagcugauucggcaaauggagucugagggaaucuuuuccccuagcgaacucgagacacccaaccuggccggccgcgugcuugauuggcuggaaaaacaugggguugagagacucaagcggauggcgauuucuggagacgacuguguggucaagccgaucgaugacagauucgccaccgcucugacggcccuuaaugauaugggcaaagugcgcaaggacaucccucagugggaacccuccaaaggguggaacgauuggcagcagguuccuuuuugcagccaccacuuccaucaacugauuaugaaggacggccgggagaucgugguccccuguagaaaucaggaugagcucgugggacgcgcucgggucucccagggcgccggguggucucugagagaaacagcuugccugggaaaaagcuaugcccagauguggcaacucauguacuuucaccgccgggaccugagacuugcggccaacgcuauuuguuccgccgugccuguugauugggugcccaccagccgcacaaccuggucuauccaugcccaccaucaguggaugacgaccgaggacaugcuguccgucuggaaucggguguggauugaagagaacccguggauggaagauaagacacacaucagcucuuggggcgacguuccuuaucucgggaagagagaggaccaguggugcggaagccugauuggccuuaccgcucgcgccacaugggcgaccaauauccaaguggcuaucaaccagguccggagacugauugggaaugagaacuaccucgauuacaugacauccaugaaacgguucaagaaugaaucugaccccgagggcgcccugugguga

SEQ ID NO: 18902 - RNA, 9879 nt, Artificial Sequence
  derived and/or modified CDS sequence (opt5) from DENV-1__FJ432739__SS-prME
agcgugaccaugcugcugaugcugaugcccacagcccuugcuuuccaccugacgaccagaggcggggaaccucauaugaucgucuccaagcaggaacggggaaaaucucuccuguuuaagacaagcgccggcguuaacaugugcacccuuauugccauggaccugggggaguucugugaagauacaaugaccuacaaaugccccagaaucacagaggcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuaccgugaucgcccuguuccuugcgcaugccauugggacaucuaucacccagaagggaaucauuuuuauccugcucaugcuggucaccccuagcauggcuaugagaugcgugggcauugggucccgggauuucguugagggacuuagcggcgccacauggguggacgucgugcuggagcacgggucuugugugacgaccauggcuaaggauaaacccacacucgacaucgaacugcugaagaccgaggucacaaacccugccguucuccgcaaacugugcauugaagcgaagaucuccaauaccacgacagauagcagauguccgacccaaggagaggccacccuuguggaagaacaagacgcuaacuuugugugccggcgcacauucgucgauagaggcuggggcaauggguguggacuguuuggcaaagggucucucauuaccugcgccaaguucaagugcgugacaaaacuggagggaaagacgguucaguacgaaaaccuuaaauauuccgugaucgucaccgugcacacaggcgaccagcaucaaguugggaaugagagcaccgaacacggaacaaccgcuacgaucacaccccaggccccuucuacagagauucagcugaccgacuacggcgcccucacacuggauuguagcccccggaccggccuggacuuuaacgaaauggugcuccugacgaugaaggagaaggcuuggcuuguccauaagcagugguuccuggaucucccucugcccuggacaagcggggcguccaccucucaagagacauggaaucgcaaagaccuucuggugaccuuuaagaccgcccacgcuaagaaacaggaagucgugguucucggaagccaggagggcgccaugcacacagcccugacgggggcuaccgaaauccaaacauccggaaccacaaccauuuucgccggccaucugaagugcagacucaaaauggauaagcugacgcuuaaagggaugagcuaugugauguguacaggcucuuucaagcuggagaaggaagucgcggagacccagcacggaaccgugcucguucagaucaaauacgagggcacagacgcuccgugcaagauuccuuuuuccacccaggaugaaaaaggggugacacaaaacggacggcugaucacggccaaucccaucgucaccgacaaggagaaaccugugaacauugaagccgagccgcccuucggcgagagcuauaucgugauuggggcuggagaaaaggcccugaaacuuucuugguuuaaaaagggcagcuccaucgggaaaauguucgaggcuacagccagaggcgcgcgccggauggccauucucggagauaccgcuugggacuuuggcucuaucgggggaguuuucacaagcgucggcaagcuggugcaucagaucuuugggaccgccuacggagugcuguucuccggcgucagcuggacgaugaaaauugggaucggcgugcuccugaccuggcuuggacucaauucuagauccacaagccucucuaugaccuguauugcuguuggccuggugacacuguaccuuggggucauggugcaggccgauuccggaugcguuaucaacuggaagggccgcgaacucaagugugggagcggaauuuuugugaccaaugagguccacacauggaccgaacaguauaaauuccaagcggacuccccuaagcggcugucugccgcuaucggcaaagccugggaggagggggugugcggcauuagaagcgcuacgcgccuggaaaacaucauguggaagcagaucuccaacgagcucaaucauauucugcuugaaaacgacaugaaauuuacaguuguggucggagauguggccggcauccuggcccaggggaagaaaaugauucggccgcagcccauggaguacaaguauucuuggaaaagcuggggaaaggcuaagaucauuggcgcggacgugcaaaaugccaccuucaucaucgaugggccuaacacccccgaauguccugacgaucagagagcuuggaauauuugggaggucgaggacuacggauuuggcaucuucacaaccaacauuuggcucaaacugcgcgauuccuauacgcagguuugcgaccaccggcugaugagcgccgccaucaaggauucuaaagcugugcacgccgacaugggcuacuggauugaauccgagaagaaugaaacauggaaacuugcgagagcuagcuucaucgaggugaaaaccuguaucuggcccaagucucauacacucugguccaacgggguccuggaaagcgagaugauuaucccgaaaauuuauggaggcccuaucucucagcacaauuaccgccccggguacuuuacccaaacagccggaccuuggcaucugggcaagcucgagcuggauuucgaccuuugcgaagggaccacggugguuguggaugagcacugcggaaaccggggccccagccugagaaccacaaccgucacaggcaaaauuauccacgaaugguguugccgguccuguacccucccuccccugcgcuuuaagggggaggacggaugcugguauggcauggagaucagaccggugaaggaaaaagaggaaaaucugguuaagagcauggugucugccggguccggagaggucgacagcuucucccuuggccuccuguguauuucuaucaugauugaagaggugaugcggagcagauggucccgcaaaaugcugaugacggggauccucgcugucuuuuuccugcuuauuaugggacagcugacauggaacgaucucauccggcugugcauuauggugggcgccaaugcgucugacagaaugggcauggggaccacauaccuggcucuuauggccaccuuuaagaugcgcccuauguucgccgucggacugcucuuuagacggcugaccagccgcgaggugcuccugcuuacaaucggccugucccucguggcuucugucgaacugcccaacagccuggaggaacuuggggauggacuggccaugggcaucaugauucucaaacugcucacggacuuccagucccaucaacugugggcuacccuucugagccucacauuuaucaagaccacauucucucugcacuaugccuggaagaccauggcgaugguucuguccauugugagccuuuuuccccugugucucucuacgacaucccagaaaaccaccuggcugccugugcuccuggggagccuuggaugcaagccgcugacaauguuccugaucgccgagaauaaaauuuggggcagaaagucuuggccccucaacgaaggcaucauggcugucgggaucguguccauucugcuuagcucccugcucaaaaacgauguuccucuggccggaccccucaucgcuggcgggaugcugauugccuguuacgugaucagcggaucuagcgccgaccuuucccuggagaaggcugcggaggucucuugggaagaggaagccgagcauagcggcgcuucccacaauauucugguggaaguucaggaugacgggaccaugaaaaucaaggaugaggagcgggacgauacacucacgauccugcuuaaggccacccugcucgccgugucuggagucuauccucugagcauucccgcuacacucuucgugugguacuuuuggcagaaaaagaaacaacgcuccggcguccugugggacaccccuucucccccggaaguggagagagccguucuugaugacggcaucuaucggauuaugcagcgcgggcugcugggaagaagccaggugggcgucgggguguuccaggaaaacguuuuucauacaauguggcacgugacccggggagcgguccucauguaccaaggcaagcgccuggagccuuccugggcuagcgugaaaaaggaccuuaucucuuacgggggaggcuggagacugcagggcuccuggaauacgggggaggaagugcagguuauugccgucgagcccggaaagaacccuaaaaaugugcagaccgcccccggcacauucaagaccagcgaaggggaggugggagcuaucgcccucgauuuuaaaccgggcacaucuggguccccuauugucaaccgggaaggaaagaucgugggccuguauggcaaugggguugugaccacaagcggaacguacgucuccgcgaucgcucaagccaaagccucucaggagggcccccucccugagauugaagacgagguguucagaaagcgcaaccugaccaucauggaucuucaccccgggagcggaaagacacggagauaucugcccgcuauuguucgcgaagccaucaaacggaagcugagaacccucauucuggcuccuacccgcguggucgccuccgagauggcggaagcccuuaaaggcaugccgauccgguaccagacaacggcugugaaguccgagcauaccgggaaagagaucguugaccugaugugccacgccacauuuaccaugagacuccugucucccgugcgcgucccuaauuauaacaugauuaucauggaugaagcucauuucacagaccccuccagcauugccgcccggggcuacaucucuaccagagugggaaugggcgaggcugcggccauuuuuaugacggcuacaccucccgggagcguggaagccuucccucaauccaaugccgucauccaggaugaggaacgggacaucccggagcgcucuuggaacagcggauaugaguggauuaccgauuuucccggcaagaccguuugguucgugccuuccaucaagucugggaaugacauugcuaacugucugcgcaagaauggaaagcgggugauccagcucagccgcaaaacauucgauaccgaauaccagaagaccaagaauaacgacugggacuacgucgugaccacggauauuuccgagaugggcgccaauuuuagagcggaccggguuaucgaucccagacgcugccuuaagccugugauucugaaggacgggcccgaacgggucauccuggcuggcccgaugccugugacaguugccagcgccgcucaaagacgcggacggaucggcagaaaccacaauaaagagggggaucaguauauuuacaugggacagccccucaacaaugacgaggaucaugcccacuggaccgaagcgaagaugcugcuugacaacaucaauacacccgagggcauuaucccugcccuguucgaacccgagcgcgaaaaaucugcugccauugauggggaguaucggcucagaggagaggcucgcaagaccuuuguggaacugaugagacggggcgaccugccugucuggcucuccuacaaaguggccagcgagggguuccaguauuccgaucgcagauggugcuuugacggcgaacggaacaaucaaguccuugaggaaaacauggauguggagaucuggacgaaggagggagaacgcaaaaagcugagaccgcgguggcuggacgcuagaaccuacucugacccccucgcccugcgcgaguucaaggaauuugcggccggccggagaagcguuuccggggaucuuauccuggagauuggaaaacucccucagcaccugacacagcgcgcucagaaugcccuggacaaccucgugaugcuucauaauucugaacaaggcgggcgggcuuauagacacgccauggaggagcugcccgauaccaucgaaacacugaugcuccuggcccuuauugcugugcugaccggaggcgucacacucuucuuucugagcggccgggggcugggaaagaccuccaucggccuccuuuguguuauggcgagcucugugcugcuguggauggccuccguggagccucauuggauugcugccagcaucauccucgaguucuuucugaugguccuucugauucccgagccggaccgccagagaacgccucaggauaaccagcucgccuacgugguuaucgggcugcuguucaugauucucacaguggcugccaaugagaugggacuucuggaaaccaccaaaaaggaccugggcaucgggcacgucgcgguggagaaccaccaucacgccgcuaugcucgaugucgaccugcaucccgccucugcuuggacacuuuacgccguggcgaccacaauuaucacgccuaugaugcggcacaccauugaaaacacaaccgccaauaucucccugacagcuaucgccaaccaagcugccauucucaugggacuggauaaaggcuggcccaucagcaagauggacauuggcguuccucugcucgcucuugggugcuauucucaggugaauccccugacccugacggccgcgguccucaugcugguggcccauuacgcuaucauuggaccgggccuucaggccaaggcuacccgcgaggcccagaagagaacagccgcggggaucaugaagaacccuaccguugauggaaucguggcuauugaccuggaucccgucguguaugacacaaaauuugaaaagcagcucggccagaucaugcugcugauucucuguaccagccagauccuucugaugcggacgacaugggcccugugcgaguccauuacccucgcuacagggccccugaccacccuuugggagggaucuccuggcaaauucuggaauacaacgaucgccgugagcauggccaacaucuuccgcggcuccuaccuggcuggggccggacucgcguuuagccugaugaagucccugggcgggggaagacggggcaccggggcccaaggagaaacacucggcgagaaguggaaacgccagcuuaaucagcugucuaagagcgaguucaacaccuauaaaagauccggcauuauggagguugaccggucugaagcuaaggaggggcugaaaagaggagagacaaccaagcacgccgucagccgcggcacggcuaagcuccggugguuuguggaaagaaaucuggugaaaccggaggggaaggucaucgaucuuggauguggccgcgggggaugguccuacuauugcgccggccugaaaaagguuacagaagugaaaggcuacaccaaagggggacccggccacgaggaaccuauucccauggcgaccuacggguggaaccucgugaaacugcauucuggaaaggacgucuucuuuaucccucccgagaagugugauacacugcucugcgacauuggcgagagcuccccuaauccgaccaucgaagaggggcggacacuuagagugcugaaaaugguugaacccuggcugcgcggaaaccaguucuguauuaagauccucaauccuuauaugcccagcguggucgagacgcuggagcaaaugcagcggaaacacggcggcaugcuugugagaaacccucugucucgcaauuccacccaugaaauguacuggguuagcugcgggacaggaaacaucgugucugccgucaauaugaccucccggaugcuccugaacagauuuacaauggcucaccgcaagcccaccuaugagcgggauguggaccugggcgccgggacgagacacguggcugucgaaccggagguugccaaccucgauauuaucggacagcgcauugaaaauaucaaacaugagcacaagagcaccuggcauuacgacgaggauaacccuuauaagacaugggcuuaccacggcucuuaugaagugaaacccuccgggagcgccuccagcauggugaauggagucgugaagcugcuuaccaaacccugggacguuauuccuauggugacacagaucgcgaugaccgauacaacccccuucggccaacagagagucuuuaaggagaaaguggacacgcggacaccuaaggccaagcgcggcaccgcucagaucauggaaguuaccgccaaauggcuguggggguuccucucuagaaacaagaaaccgcggauuuguacaagagaggaauuuacgcggaaggugcgcagcaaugcugccaucggagccgucuucguggacgagaaccaauggaacuccgcgaaagaggcuguugaagaugagagauuuugggaccuggugcaucgggaacgcgagcuucacaagcagggcaagugcgcgaccugcgucuacaacaugauggggaaaagagaaaagaaacugggagaguucggcaaggccaaagggucucgggcuauuugguacauguggcucggcgcccgcuuccuggaguuugaagcucugggauucaugaaugaggaucacugguuuagcagagaaaacucccucucuggcguggagggggagggacugcauaaacuuggcuauauccugcgggacauuagcaaaauccccgggggaaauauguacgccgaugacacagcgggcugggauacccgcaucacagaagacgaucuccagaacgaggccaagauuaccgacaucauggaaccugagcacgcucugcuugccaaguccauuuucaaacugacauaucagaauaaggucgugagaguucaacggcccgcuaaaaacgggaccgugauggaugucaucucucgcagagaccagcggggcagcggacaggugggcacguacgggcucaauaccuuuacaaacauggaagcccagcugauucgccaaauggaguccgagggaaucuucagcccuucugaacuggagacccccaaccucgcgggcagagugcuggauuggcuugaaaagcaugggguugagcggcugaaaagaauggccaucuccggagacgacuguguggucaagccgauugaugaccgcuuugcuacagcccucaccgcucugaaugauaugggcaaggugcggaaagacaucccucagugggaacccagcaagggguggaacgauuggcagcagguuccuuucugcucucaccacuuucaucaacuuauuaugaaagacggcagagagaucgugguccccugucgcaaucaggaugagcuggugggacgggccagagucucccagggcgcuggguggagccuccgcgaaacggccugccugggaaaguccuaugcgcagauguggcaacugauguacuuccaccggagagaccuccgccuggccgcuaacgccauuuguucugccgugccuguugauugggugcccacaagccggaccacaugguccauccaugcucaccaucaguggaugaccacggaggacaugcuuagcgucuggaauagaguguggauugaagagaacccguggauggaagauaaaacccacaucucuuccuggggcgacguuccuuaucuggggaagcgcgaggaccaguggugcggaagccucaucggccugacagcccgggcgaccugggcuacaaauauucaaguggccaucaaccaggucagacggcuuauugggaaugagaacuaccuggauuacaugaccucuaugaagagauuuaaaaaugaaaucgaccccgagggcgcccucugguga

SEQ ID NO: 18903 - RNA, 9879 nt, Artificial Sequence
  derived and/or modified CDS sequence (opt5) from DENV-1__FJ410201__SS-prME
agcgugaccaugcugcucaugcugaugcccaccgcccuugcuuuccaccugacgaccagaggaggggaaccucauaugaucguguccaagcaggaacggggaaaaucucuccuguuuaagaccagcgccggcguuaacaugugcacccuuauugcgauggaccugggggaacucugugaagauacaaugaccuacaaaugcccccgcaucacagaggcugaacccgacgauguggacuguuggugcaaugccaccgauacgugggugaccuauggaacauguucccagaccggcgagcacagacgggacaagcgcucuguggcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacuggugcaucagauuuucgggaccgcuuacggagugcucuuuuccggcgucagcuggacgaugaagaucgggauuggcgugcugcuuaccuggcugggacucaauucuagauccacaagccugucuaugaccuguaucgccguuggccuggugacacuuuaccucggggucauggugcaggcugauuccggaugcguuauuaacuggaaaggccgcgaacugaagugugggagcggaaucuucgugaccaaugagguccacacauggaccgaacaauauaaguuucaggccgacuccccuaaacggcugucugcggccauuggcaaggcuugggaggagggggugugcggcaucagaagcgccacgcgccucgaaaacaucauguggaaacagauuuccaacgagcugaaucauauccuucuggaaaacgacaugaagcucacaguuguggucggagauguggcuggcauucuggggcagggcaagaaaaugauccggccgcaacccauggaguacaaauauucuuggaaaagcuggggcaaggccaagauuaucggggccgacgcucagaauaccaccuucaucauugauggaccuaacacacccgaauguccugacgaucagagagcguggaauaucugggagguggaggacuacggcuuuggcauuuucaccacgaacaucuggcugaaacuucgcgauuccuauacacaggucugcgaccaccggcucaugagcgccgcuauuaaagauucuaaggccguucacgccgacaugggguacuggaucgaauccgagaaaaaugaaaccuggaagcuggcuagagccagcuuuaucgaggugaagacauguauuuggcccaaaucucauacccugugguccaacggagugcucgaaagcgagaugaucauuccgaagaucuauggcgggccuauuucucaacacaauuaccgccccggauacuucacacagaccgcgggcccuuggcaucuggggaaacuugagcuggauuucgaccucugcgaaggaacgaccgucgugguugaugagcacugcggcaaccggggccccagccugagaacaaccacagugaccgggaagaucauccacgaaugguguugccgguccuguacgcugccuccccuucgcuuuagaggagaggacggcugcugguaugggauggagauucggccggucaaagaaaaggaggaaaaucucgucaagagcaugguuucugcuggauccggcgagguggacagcuucucccuggggcugcucuguaucucuauuaugaucgaagaggucaugagaagccgcuggucccggaaaaugcugaugacaggaacccuugccguguuuuuccugcucauuaugggccagcugacauggaacgaucugaucagacuuugcauuaugguuggcgccaaugcuucugaccgcauggggaugggaaccaccuaccuggcccucauggcgacauuuaagaugagaccuauguucgcugugggccugcucuuucggcgccugacgagcagagagguccuucugcucaccaucgggcugucccugguggccucuguggaacuucccaacagccuggaggaacucggagauggccuggccauggggaucaugauucucaaacugcuuacagacuuccaaucccaucagcugugggcuacccuccugagccugacauuuaucaagaccacguucucucuucacuaugccuggaaaacaauggcuaugguccuguccauuguuagccucuuuccccugugucucucuaccaccucccagaagacaaccuggcugccugugcuucugggaagccugggcugcaagccgcucacaauguuccugaucgccgagaauaaaauuuggggccggaagucuuggccccuuaacgaagggaucauggcggugggaaucgucuccauucugcucagcucccugcucaaaaacgaugugccucuggccggcccccuuaucgcugggggaaugcugauugccuguuacguuaucagcggcucuagcgcugaccugucccucgagaaggccgccgaggugucuugggaagaggaagcugagcauagcggggcgucccacaauauucuggucgaagugcaggaugacggaacgaugaaaaucaaggaugaggagcgcgacgauacccuuacaauccugcucaaagccacccugcucgcuguuucuggcguguauccucugagcauucccgccacacuuuuugucugguacuucuggcaaaagaagaaacagagauccggcgugcugugggacaccccuucucccccggaagucgagcgggccgugcuggaugacgggaucuaucgcauuaugcagagaggacuccugggccggagccagguuggggugggagucuuccaagaaaacguguuucauacgauguggcacguuacccgcggcgcugugcuuauguaccaggggaagagacuggagccuuccugggccagcgucaaaaaggaccucaucucuuacggaggcggcuggcggcugagaggguccuggaauacaggagaggaaguccaggugauugcgguugagcccggcaaaaacccuaagaauguccagaccgcucccgggacauucaagaccccggaaggagaggugggcgccaucgcccucgauuuuaaaccugggacaagcggaucucccauugugaaccgcgaaggcaagaucgucggccuguaugggaauggagugguuacgaccuccggcacauacgugagcgcuaucgcccaagcgaaggcuucccaggaggggccucuucccgagauugaagacgaggucuuccggaagagaaaccugaccaucauggaucugcaccccggaucuggcaaaacccgccgguaucucccugccauugugagagaagccaucaagcgcaagcugcggacacuuauucuggcuccgacgagaguuguggccagcgagauggcugaagcccucaaagggaugcccauccgcuaccagaccacagcggucaaguccgagcauaccggcaaagagaucguggaccugaugugccacgccacauuuaccaugcggcugcucagcccuguuagagugcccaauuauaacaugauuaucauggaugaagcucauuucacggacccuucuuccauugccgcucggggauacaucagcacacgcgucggcaugggggaggccgccgcuauuuuuaugaccgcgacacccccuggaucuguggaagccuucccgcaaagcaaugcugugauccaggaugaggaaagagacauccccgagcgguccuggaacucuggcuaugaguggauuacagauuuuccugggaagaccgucugguucguucccagcaucaaauccggaaaugacauugccaacugucuucgcaagaauggcaagagagugauccagcugucucggaaaacauuugauaccgaauaccagaagacgaaaaacaacgacugggacuacguggucacaaccgauauuagcgagaugggggccaauuucagagcugaccgcgugaucgauccucggagaugccugaagcccguuauucucaaagacggcccggaacgcgugauccuggccggaccuaugcccgucacaguggcguccgcugcccaacggagaggccgcaucgggcggaaccacaauaaggagggagaucaguauauuuacaugggccagccccuuaacaaugacgaggaucaugcccacuggaccgaagcuaagaugcugcucgacaacaucaauacgccugaggggauuauccccgcccuguucgaaccugagagagaaaagagcgcggccguugauggagaguaucgccugagaggcgaggcucggaagaccuuuguggagcucaugcgcagaggggaccuuccggucuggcugucuuacaaaguggccuccgagggcuuccaguauagcgaucggcgcuggugcuuugacggagaaagaaacaaucaaguccuggaggaaaacauggauguggagauuuggacaaaggagggcgaacggaaaaagcucagaccccgcuggcuggacgcucggaccuacuccgacccucuugcccugagagaguucaaagaauuugcugccgggcgccggucuguuagcggagaucucauccuggagaucggcaagcugccccagcaccucacacagagagcgcagaaugcccuugacaaccuggugaugcugcauaauuccgaacaagggggacgggcuuaucgccacgccauggaggagcucccugauaccauugaaacacugaugcuucuggcucucaucgccgugcugaccggcggcgucacgcuguucuuucucucugggagaggacuuggcaagacaagcauugggcugcuguguguuauggccuccagcgugcuccuguggauggcuucuguggagccccauuggaucgcggccuccauuauccuugaguucuuucugaugguccuccugaucccggagccugaccggcagcgcacaccccaggauaaccagcuggcuuacgugguuauuggacuccuuuucaugauccugaccguggccgccaaugagaugggccugcucgaaacaaccaaaaaggaccuggggauuggacacgucgcuguggagaaccaccaucacgccgcgaugcuugaugucgaccugcauccugccagcgcuuggacacucuacgccguggcuacgaccaucauuacacccaugaugagacacaccaucgaaaacacaaccgccaauauuucucugacggcgaucgccaaccaagcugccauccugaugggccucgauaaaggcuggccuauuuccaagauggacaucgggguuccccuucuggcucugggaugcuauagccaggugaauccgcucacccugacagccgcuguccuuaugcugguggcccauuacgcgauuaucggcccugggcuccaggccaaagcuacccgggaggcccaaaagcgcacagcugccggaauuaugaagaaccccaccguugauggcaucguggccaucgaccuggaucccgucguguaugacgcgaaauuugaaaagcagcuggggcagauuaugcuccuuauccuguguacgucucagauucugcucaugagaacaaccugggcucugugcgagagcaucacacuugccaccggaccucugaccacacucugggagggcuccccgggcaaauucuggaauacgaccauugcugugucuauggccaacaucuuucgggggagcuaccuggccggagcuggccuggccuucucccucaugaaaagccuugggggaggccgcagagggacaggagcgcaaggcgaaacccugggcgagaaauggaagcggcagcugaaucagcucuccaagucugaguucaacacauauaaaagaagcgggaucauggagguugaccgcuccgaagccaaggagggacugaaacggggcgagaccacgaagcacgcugucucuagagggacagccaaacuucgcugguuuguggaacggaaucuggugaagcccgagggaaaggucauugaucucggcugugggagaggaggcuggagcuacuauugcgcuggccugaaaaagguuaccgaagugaaaggguacaccaagggaggcccugggcacgaggaacccaucccuauggccacauacggauggaaccuggugaaacuccauuccggcaaggacgucuucuuuauucccccugagaaaugugauacccuucugugcgacaucggggagucuagcccgaaucccacaauugaagagggacgcacgcugcgggugcucaagaugguugaaccuuggcugagaggcaaccaguucuguaucaagauucuuaaucccuauaugccuuccguggucgagacccuggagcaaaugcagcgcaaacacggcgggaugcucgugcggaacccccugagcagaaauucuacacaugaaauguacuggguuuccugcggaaccggcaacaucgugagcgcggucaauaugacaucucgcaugcugcucaaccgguuuaccauggcccacagaaagccgacguaugagcgcgauguggaccuggggaccggaacaagacacguggcugucgaaccugagguugccaaccuugauaucauuggccagcggaucgaaaauauuaaacaugagcacaaguccaccuggcauuacgacgaggauaaccccuauaaaacaugggcuuaccacgggagcuaugaagugaagcccucuggauccgccagcuccauggugaauggcgucgugaagcugcucaccaaaccuugggacguuauccccauggugacacagauugcuaugaccgauacgacaccuuucggccaacagcgcgucuuuaaggagaaaguggacaccagaaccccgaaggccaaacgggggacagcgcagaucauggaaguuacggccagauggcuguggggauuccuuagccggaacaagaagccccgcaucuguaccagagaggaauuuacacggaaagugcgcucuaaugcugccauuggcgcugucuucguggacgagaaccaauggaauagcgccaaggaggccguugaagaugagagauuuugggaccuggugcaucgggaacgcgagcuccacaaacaggggaagugcgcgaccugcgucuacaacaugaugggaaaaagagaaaagaagcugggcgaguucgggaaagcuaagggcucccgggccaucugguacauguggcugggagcccgcuuucucgaguucgaagcucugggcuucaugaaugaggaucacugguuuucuagagaaaacagccuuuccgggguggagggagagggccugcauaaacucggguauauucugcgggacaucucuaagauuccuggaggcaauauguacgccgaugacacagcugggugggauacccgcaucacagaagacgaucuucagaacgaggccaaaaucaccgacauuauggaacccgagcacgcgcugcucgccaaggcuaucuucaaacugacguaucagaauaaggucgugagaguucaacggccugccaagaacggcaccgugauggaugucauuagccgcagagaccagcggggauccggccagguggggacauacggacugaauaccuuuacaaacauggaagcucagcucaucagacaaauggagucugagggcauuuucagccccuccgaacuggagaccccgaaccuugccgaacgcgcgcuggauuggcucgagaaauaugggguggaacggcugaagagaauggccaucagcggagacgacuguguugugaaaccuaucgaugaccgcuuugcuacggcccuuacagcucugaaugauaugggcaagguccggaaagacauuccccagugggagccuucuaagggguggaacgauuggcaacaggugcccuucugcucccaucacuuucaccaacucaucaugaaggacggcagagagauuguugugccuugucgcaaucaggaugaacuggucggacgggccagagugagccagggcgcuggguggucucugcgcgagaccgccugccucggaaaauccuacgcgcagauguggcaacugauguauuuccaucggagagaccuucgccuggccgcuaacgccaucuguagcgccguccccguggauuggguuccgacaucccggaccacguggucuauucacgcucaucaccaguggaugaccacagaagacaugcucagcguguggaauagagucuggaucgaggaaaacccuuggauggaggauaagacccauauuuccagcugggaggacgugcccuaccugggcaaacgggaagaccaguggugcgggucucuuaucggacugacagccagagcgaccugggcuacaaauauccaaguugccauuaaccaggugcgccggcucaucggcaaugagaacuaccugaauuauaugaccuccaugaagagauuuaaaaacgaaagcgaucccgagggggcccugugguga

SEQ ID NO: 18904 - RNA, 9879 nt, Artificial Sequence
  derived and/or modified CDS sequence (opt5) from DENV-1__FJ410203__SS-prME
agcgugaccaugcugcucaugcugaugcccaccgcccuugcuuuccaccugacgaccagaggaggggaaccucauaugaucguguccaagcaggaacggggaaaaucucuccuguuuaagaccagcgccggcguuaauaugugcacccuuauugcgauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacugauucaucagaucuucgggaccgcuuacggagugcucuuuuccggcgugagcuggacgaugaagauugggaucggcguccugcuuaccuggcugggacucaauucuagauccacaagccugucuaugaccuguauugccgugggccugguuacacuuuaccucggggugaugguccaggcugauuccggaugcgugaucaacuggaaaggccgcgaacugaagugugggagcggaauuuucguuaccaaugaggugcacacauggaccgaacaauauaaguuucaggccgacuccccuaaacggcugucugcggccaucggcaaggcuugggaggagggggucugcggcaucagaagcgccacgcgccucgaaaacauuauguggaaacagaucuccaacgagcugaaucauauucuucuggaaaacgacaugaagcucacagugguugugggagaugucgcuggcauccuggggcagggcaagaagaugauucggccgcaacccauggaguacaaauauucuuggaaaagcuggggcaaggccaagaucaucggggccgacgcucagaauaccaccuucauuaucgauggaccuaacacacccgaauguccugacgaucagagagcguggaauauuugggagguggaggacuacggcuuuggcaucuucaccacgaacauuuggcugaaacuucgcgauuccuauacacaggugugcgaccaccggcucaugagcgccgcuaucaaagauucuaaggccguccacgccgacaugggguacuggaucgaauccgagaaaaaugaaaccuggaagcuggcuagagccagcuuuauugagguuaagacauguaucuggcccaaaucucauacccugugguccaacggagugcucgaaagcgagaugauuaucccgaagauuuauggcgggccuaucucucaacacaauuaccgccccggauacuucacacagaccgcgggcccuuggcaucuggggaaacuugagcuggauuucgaccucugcgaaggaacgaccguggucguggaugagcacugcggcaaccggggccccagccugagaacaaccacaguuaccgggaagaucauucacgaaugguguugccgguccuguacgcugccuccccuucgcuuuagaggagaggacggcugcugguaugggauggagauccggccggugaaagaaaaggaggaaaaucucgucaagagcauggugucugcuggauccggcgagguugacagcuucucccuggggcugcucuguauuucuaucaugauugaagaggugaugagaagccgcuggucccggaaaaugcugaugacaggaacccuugccgucuuuuuccugcucaucaugggccagcugacauggaacgaucugauuagacuuugcaucauggugggcgccaaugcuuuugaccgcauggggaugggaaccaccuaccuggcccucauggcgacauucaagaugagaccuauguuugcuguuggccuccuguuccggcgccugacgucuagagaggugcuucugcucaccaucgggcugagccuggucgccuccguggaacuucccaacucucuggaggaacucggagauggccuggccauggggauuaugauccucaaacugcuuacagacuuucaaagccaucagcugugggcuacccuccugucccugacauucauuaagaccacguuuagccuucacuaugccuggaaaacaauggcuauggugcugucuaucgucucccucuucccccugugucucagcaccaccucucagaagacaaccuggcugccuguucuucugggaucccugggcugcaagccgcucacaauguuucugauugccgagaauaaaaucuggggccggaaguccuggccccuuaacgaagggaucauggcggugggaauugugucuauccugcucuccagccugcucaaaaacgaugucccucuggccggcccccuuauugcugggggaaugcugaucgccuguuacgugauuuccggcagcucugcugaccugagccucgagaaggccgccgagguuuccugggaagaggaagcugagcauucuggggcgagccacaauauccugguggaaguccaggaugacggaacgaugaaaaucaaggaugaggagcgcgacgauacccuuacaauucugcucaaagccacccugcucgcuguguccggcguuuauccucugucuauccccgccacacuuuucgugugguacuucuggcaaaagaagaaacagagaagcggcguccugugggacaccccuagcccucccgaaguggagcgggccguccuggaugacgggauuuaucgcaucaugcagagaggacuccugggccggucucagguggggguuggaguguuucaagaaaacgucuuccauacgauguggcacgugacccgcggcgcuguucuuauguaccaggggaagagacuggagcccagcugggccuccgugaaaaaggaccucauuagcuacggaggcggcuggcggcugagagggucuuggaauacaggagaggaaguccaggugaucgcgguggagcccggcaaaaacccuaagaauguucagaccgcucccgggacauuuaagaccccggaaggagaggucggcgccauugcccucgauuucaaaccugggacauccggaagccccaucgugaaccgcgaaggcaagaucgugggccuguaugggaauggagucgugacgaccucuggcacauacguuuccgcuauugcccaagcgaaagcuagccaggaggggccucuucccgagaucgaagacgagguguuucggaagagaaaccugaccauuauggaucugcaccccggauccggcaaaacccgccgguaucucccugccaucgucagagaagccauuaagcgcaagcugcggacacuuauccuggcuccgacgagagugguugccucugagauggcugaagcccucaaagggaugcccauccgcuaccagaccacagcggucaagagcgagcauaccggcaaagagauugucgaccugaugugccacgccacauucaccaugcggcugcucuccccugugagaguucccaauuauaacaugaucauuauggaugaagcucauuuuacggacccuagcucuaucgccgcucggggauacauuuccacacgcgugggcaugggggaggccgccgcuaucuucaugaccgcgacacccccuggaagcgucgaagccuuuccgcaaucuaaugcugugauccaggaugaggaaagagacauucccgagcggagcuggaacuccggccacgaguggaucacagauuucccugggaagaccgugugguuuguccccucuauuaaaagcggaaaugacaucgccaacugucuucgcaagaauggcaagagaguuauucagcugucccggaaaacauucgauaccgaauaucagaagacgaaaaacaacgacugggacuacguggugacaaccgauaucucugagaugggggccaauuucagagcugaccgcgucauugauccucggagaugccugaagcccgugauccucaaagacggcccggaacgcguuauccuggccggaccuaugcccgugacagucgcgagcgcugcccaacggagaggccgcauugggcggaaccauaauaaggagggagaucaguacaucuauaugggccagccccuuaacaaugacgaggaucacgcccacuggaccgaagcuaagaugcugcucgacaacauuaauacgccugaggggaucauucccgcccuguuugaaccugagagagaaaaauccgcggccguggauggagaguaccgccugagaggcgaggcucggaagaccuucguugaacucaugcgcagaggggaccuuccgguguggcugagcuauaaagucgccucugagggcuuucaguacuccgaucggcgcuggugcuucgacggagaaagaaacaaucaagugcuggaggaaaacauggaugucgagaucuggacaaaggagggcgaacggaaaaagcucagaccccgcuggcuggacgcucggaccuauagcgacccucuugcccugagagaguuuaaagaguucgcugccgggcgccgguccgugucuggagaucucauccuggagauuggcaagcugccccagcaucucacacagagagcgcagaaugcccuugacaaccugguuaugcugcacaauagcgaacaagggggacgggcuuaccgccaugccauggaggagcucccugauaccaucgaaacacugaugcuucuggcucucauugccgugcugaccggcggcgugacgcuguuuuuccucuccgggagaggacuuggcaagacaucuaucgggcugcugugugucauggccagcuccguucuccuguggauggcuagcguggagccccacuggauugcggccucuaucauccuugaauuuuuccugauggugcuccugauuccggagccugaccggcagcgcacaccccaggauaaccagcuggcuuaugucgugaucggacuccuuuuuaugauucugaccguugccgccaaugagaugggccugcucgaaacaaccaaaaaggaccuggggaucggacacguggcugucgagaaccaucaccaugccgcgaugcuugauguggaccugcacccugccuccgcuuggacacucuacgccgucgcuacgaccauuaucacacccaugaugagacauaccauugaaaacacaaccgccaauaucagccugacggcgaucgccaaccaagcugccauucugaugggccucgauaaaggcuggccuaucucuaagauggacauuggggugccccuucuggcucugggaugcuacucccagguuaauccgcucacccugacagccgcugugcuuaugcuggucgcccacuaugcgaucauuggcccugggcuccaggccaaagcuacccgggaggcccaaaagcgcacagcugccggaaucaugaagaaccccaccguggauggcaucguugccauugaccuggaucccguggucuacgacgcgaaauucgaaaagcagcuggggcagaucaugcuccuuauucuguguacgagccagauccugcucaugagaacaaccugggcucugugcgagucuauuacacuugccaccggaccucugaccacacucugggagggcagcccgggcaaauuuuggaauacgaccaucgcuguguccauggccaacaucuuccgggggucuuaucuggccggagcuggccuggccuucagccucaugaagucccuugggggaggccgcagagggacaggagcgcaaggcgaaacccugggcgagaaauggaagcggcagcugaaucagcucagcaaguccgaauuuaacacauacaaaagaucugggauuauggagguggaccgcagcgaagccaaggagggacugaaacggggcgagaccacgaagcacgcuguuuccagagggacagccaaacuucgcugguucgucgaacggaaucuggugaagcccgagggaaaggugaucgaucucggcugugggagaggaggcuggucuuauuacugcgcuggccugaaaaaggucaccgaaguuaaaggguauaccaagggaggcccugggcaugaggaacccauuccuauggccacauacggauggaaccuggugaaacuccacagcggcaaggacguguuuuucauucccccugagaaaugugauacccuucugugcgacaucggggaguccucuccgaaucccacaaucgaagagggacgcacgcugcggguccucaagaugguggaaccuuggcugagaggcaaccaguuuuguauuaagauccuuaaucccuacaugccuagcguuguggagacccuggagcaaaugcagcgcaaacauggcgggaugcucguccggaacccccuguccagaaauagcacacacgaaauguauugggugucuugcggaaccggcaacaucguuuccgcggugaauaugacaagccgcaugcugcucaaccgguucaccauggcccacagaaagccgacguacgagcgcgaugucgaccuggggaccggaacaagacauguggcuguggaaccugaggucgccaaccuugauauuaucggccagcggauugaaaauaucaaacacgagcauaagucuaccuggcacuaugacgaggauaaccccuacaaaacaugggcuuaucauggguccuacgaaguuaagcccagcggaucugccuccagcauggugaauggcguggucaagcugcucaccaaaccuugggacgugauucccaugguuacacagaucgcuaugaccgauacgacaccuuuuggccaacagcgcguguucaaggagaaagucgacaccagaaccccgaaggccaaacgggggacagcgcagaucauggaagugacggccagauggcuguggggauuucuuucccggaacaagaagccccgcauuuguaccagagaggaguucacacggaaaguucgcagcaaugcugccaucggcgcuguguuugucgacgagaaccaauggaacucugccaaggaggccguggaagaugagagauucugggaccugguucaccgggaacgcgagcuccacaaacaggggaagugcgcgaccugcguguauaacaugaugggaaaaagagaaaagaagcugggcgaguuugggaaagcuaagggcagccgggccauuugguacauguggcugggagcccgcuuccucgaguucgaagcucugggcuuuaugaaugaggaucauugguucuccagagaaaacucucuuagcggggucgagggagagggccugcacaaacucggguacauccugcgggacauuuccaagaucccuggaggcaauauguaugccgaugacacagcugggugggauacccgcaucacagaagacgaucuucagaacgaggccaaaauuaccgacaucauggaacccgagcaugcgcugcucgccaaggcuauuuuuaaacugacguaccagaauaagguggucagagugcaacggccugccaagaacggcaccguuauggaugugaucucucgcagagaccagcggggaagcggccaggucgggacauauggacugaauaccuucacaaacauggaagcucagcucauuagacaaauggaguccgagggcaucuuuucucccagcgaacuggagaccccgaaccuugccgaacgcgcgcuggauuggcucgagaaauacgggguggaacggcugaagagaauggccaucuccggagacgacugugugguuaaaccuauugaugaccgcuucgcuacggcccuuacagcucugaaugauaugggcaaggugcggaaagacaucccccagugggagccuagcaagggguggaacgauuggcagcagguccccuuuugcucucaccacuuccaucaacucauuaugaaggacggcagagagaucgugguuccuugucgcaaucaggaugaacuggugggacgggccagagucucccagggcgcuggguggagccugcgcgagaccgccugccucggaaaaucuuaugcgcagauguggcaacugauguacuuucaccggagagaccuucgccuggccgcuaacgccauuuguuccgccgugcccgucgauugggugccgacaagccggaccacgugguccauccaugcucaccaucaguggaugaccacagaagacaugcucucuguuuggaauagaguguggauugaggaaaacccuuggauggaggauaagacccacaucagcuccugggaggacguccccuaucugggcaaacgggaagaccaguggugcgggagccuuaucggacugacagccagagcgaccugggcuacaaauauucaaguggccaucaaccagguucgccggcucauuggcaaugagaacuaccuggauuacaugaccucuaugaagagauucaaaaaugaauccgaccccgagggggcccugugguga

SEQ ID NO: 18905 - RNA, 9879 nt, Artificial Sequence
  derived and/or modified CDS sequence (opt5) from DENV-1__FJ410204__SS-prME
agcgugaccaugcugcucaugcugaugcccaccgcccuugcuuuccaccugacgaccagaggaggggaaccucauaugaucguguccaagcaggaacggggaaagucucuccuguuuaagaccagcgccggcguuaauaugugcacccuuauugccauggaccugggggagcucugugaagauacaaugaccuacaaaugcccgcgcaucacagaggcugaacccgacgauguggacuguuggugcaaugccaccgauacgugggugaccuauggaacauguucccaaaccggcgagcacagacgggacaagcgcucugucgcccuggcuccucauguggggcugggacucgagacaagaaccgaaacguggaugagcuccgagggcgccuggaaacagauucagcggguugaaacaugggcucugcgccaccccggcuucaccgugaucgcccuuuuucuggcgcaugccauugggacaucuaucacccagaagggaaucauuuucauccuccugaugcuugucaccccuagcauggcuaugagaugcgugggcauugggucccgggauuuuguugagggacugagcggcgccacauggguggacgucgugcucgagcacgggucuugugugacgaccauggcuaaggauaaacccacacuggacaucgaacugcucaagaccgaggucacaaacccugccguucugcgcaaacuuugcauugaagcgaagaucuccaauaccacgacagauagcagauguccgacccaaggagaggccacccugguggaagaacaggacgcuaacuucgugugccggcgcacauuugucgauagaggcuggggcaauggguguggacucuucggcaaagggucucugauuaccugcgccaaguuuaagugcgugacaaaacuugagggaaagaucguucaguacgaaaaccugaaauauuccgugaucgucacggugcacaccggcgaccagcaucaaguugggaaugagagcacagaacacggaaccacagcuaccauuacgccccaggccccuaccacagagauccagcucaccgacuacggcgcccugacacuggauuguucuccccggaccggccucgacuucaacgaaauggugcugcuuacgaugaaggagaaauccuggcugguccauaagcagugguuucucgaucugccucuucccuggacaagcggggcuuccaccucucaagagacauggaaucgccaggaccugcucgugaccuucaaaaccgcgcacgccaagaagcaggaagucgugguucugggaagccaagagggcgcuaugcacacagcccugacgggggccaccgaaauucagacauccggaaccacaaccaucuuugcuggccaucucaaaugcagacugaagauggauaaacuuacgcugaaggggaugagcuaugugauguguacaggcucuuucaaacucgagaaggaagucgccgagacccagcacggaaccgugcugguucagauuaaguacgagggcacagacgcgccgugcaaaaucccuuucuccacccaagaugaaaagggggugacacagaacggacggcugaucacggcuaaucccauugucaccgacaaagagaagccugugaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucuaucgggggaguuuuuacaagcgucggcaaacugauucaucagaucuucgggaccgcuuacggagugcucuuuuccggcgugagcuggacgaugaagauugggaucggcguccugcuuaccuggcugggacucaauucuagauccacaagccugucuaugaccuguauugccgugggccugguuacacuuuaccucggggugaugguccaggcugauuccggaugcgugaucaacuggaaaggccgcgaacugaagugugggagcggaauuuucguuaccaaugagguguauacauggaccgaacaauacaaguuucaggccgacuccccuaaacggcugucugcggccaucggcaaggcuugggaggagggggucugcggcaucagaagcgccacgcgccucgaaaacauuauguggaaacagaucuccaacgagcugaaucacauucuucuggaaaacgacaugaagcucacagugguugugggagaugucgcuggcauccuggggcagggcaagaagaugauucggccgcaacccauggaguauaaauacucuuggaaaagcuggggcaaggccaagaucaucggggccgacgcucagaauaccaccuucauuaucgauggaccuaacacacccgaauguccugacgaucagagagcguggaauauuugggagguggaggacuauggcuuuggcaucuucaccacgaacauuuggcugaaacuucgcgauuccuacacacaggugugcgaccaucggcucaugagcgccgcuaucaaagauucuaaggccguccacgccgacaugggguauuggaucgaauccgagaaaaaugaaaccuggaagcuggcuagagccagcuuuauugagguuaagacauguaucuggcccaaaucucacacccugugguccaacggagugcucgaaagcgagaugauuaucccgaagauuuacggcgggccuaucucucaacauaauuaccgccccggauauuucacacagaccgcgggcccuuggcaccuggggaaacuugagcuggauuucgaccucugcgaaggaacgaccguggucguggaugagcauugcggcaaccggggccccagccugagaacaaccacaguuaccgggaagaucauucacgaaugguguugccgguccuguacgcugccuccccuucgcuuuagaggagaggacggcugcugguacgggauggagauccggccggugaaagaaaaggaggaaaaucucgucaagagcauggugucugcuggauccggcgagguugacagcuucucccuggggcugcucuguauuucuaucaugauugaagaggugaugagaagccgcuggucccggaaaaugcugaugacaggaacccuugccgucuuuuuccugcucaucaugggccagcugacauggaacgaucugauuagacuuugcaucauggugggcgccaaugcuuuugaccgcauggggaugggaaccaccuaucuggcccucauggcgacauucaagaugagaccuauguuugcuguuggccuccuguuccggcgccugacgucuagagaggugcuucugcucaccaucgggcugagccuggucgccuccguggaacuucccaacucucuggaggaacucggagauggccuggccauggggauuaugauccucaaacugcuuacagacuuucaaagccaccagcugugggcuacccuccugucccugacauucauuaagaccacguuuagccuucauuacgccuggaaaacaauggcuauggugcugucuaucgucucccucuucccccugugucucagcaccaccucucagaagacaaccuggcugccuguucuucugggaucccugggcugcaagccgcucacaauguuucugauugccgagaauaaaaucuggggccggaaguccuggccccuuaacgaagggaucauggcggugggaauugugucuauccugcucuccagccugcucaaaaacgaugucccucuggccggcccccuuauugcugggggaaugcugaucgccuguuaugugauuuccggcagcucugcugaccugagccucgagaaggccgccgagguuuccugggaagaggaagcugagcacucuggggcgagccauaauauccugguggaaguccaggaugacggaacgaugaaaaucaaggaugaggagcgcgacgauacccuuacaauucugcucaaagccacccugcucgcuguguccggcguuuacccucugucuauccccgccacacuuuucgugugguauuucuggcaaaagaagaaacagagaagcggcguccugugggacaccccuagcccucccgaaguggagcgggccguccuggaugacgggauuuaccgcaucaugcagagaggacuccugggccggucucagguggggguuggaguguuucaagaaaacgucuuccacacgauguggcaugugacccgcggcgcuguucuuauguaccaggggaagagacuggagcccagcugggccuccgugaaaaaggaccucauuagcuauggaggcggcuggcggcugagagggucuuggaauacaggagaggaaguccaggugaucgcgguggagcccggcaaaaacccuaagaauguucagaccgcucccgggacauuuaagaccccggaaggagaggucggcgccauugcccucgauuucaaaccugggacauccggaagccccaucgugaaccgcgaaggcaagaucgugggccuguacgggaauggagucgugacgaccucuggcacauauguuuccgcuauugcccaagcgaaagcuagccaggaggggccucuucccgagaucgaagacgagguguuucggaagagaaaccugaccauuauggaucugcaccccggauccggcaaaacccgccgguaccucccugccaucgucagagaagccauuaagcgcaagcugcggacacuuauccuggcuccgacgagagugguugccucugagauggcugaagcccucaaagggaugcccauccgcuaucagaccacagcggucaagagcgagcacaccggcaaagagauugucgaccugaugugccaugccacauucaccaugcggcugcucuccccugugagaguucccaauuacaacaugaucauuauggaugaagcucacuuuacggacccuagcucuaucgccgcucggggauauauuuccacacgcgugggcaugggggaggccgccgcuaucuucaugaccgcgacacccccuggaagcgucgaagccuuuccgcaaucuaaugcugugauccaggaugaggaaagagacauucccgagcggagcuggaacuccggccaugaguggaucacagauuucccugggaagaccgugugguuuguccccucuauuaaaagcggaaaugacaucgccaacugucuucgcaagaauggcaagagaguuauucagcugucccggaaaacauucgauaccgaauaccagaagacgaaaaacaacgacugggacuacguggugacaaccgauaucucugagaugggggccaauuucagagcugaccgcgucauugauccucggagaugccugaagcccgugauccucaaagacggcccggaacgcguuauccuggccggaccuaugcccgugacagucgcgagcgcugcccaacggagaggccgcauugggcggaaccacaauaaggagggagaucaguauaucuacaugggccagccccuuaacaaugacgaggaucaugcccacuggaccgaagcuaagaugcugcucgacaacauuaauacgccugaggggaucauucccgcccuguuugaaccugagagagaaaaauccgcggccguggauggagaguaucgccugagaggcgaggcucggaagaccuucguugaacucaugcgcagaggggaccuuccgguguggcugagcuacaaagucgccucugagggcuuucaguauuccgaucggcgcuggugcuucgacggagaaagaaacaaucaagugcuggaggaaaacauggaugucgagaucuggacaaaggagggcgaaaccaaaaagcuccggcacagauggcccgacgcucgccaguacagcgacccucuggggcuucgggaguuuaaagaguucgccgcuggaagacgcuccgugucuggcgaucugauccucgagauugggaagcugccccagcaucugacacagcgggcccaaaaugcgcucgacaaccuuguuaugcugcacaauagcgaacagggaggcagagccuaucggcaugcuauggaggagcugccugauaccaucgaaacacucaugcugcuugcccugauugcugugcucaccggcggggugacgcuguuuuuccuguccggacgcggccucgggaagacaucuaucggacuucugugugucauggccagcuccguucugcucuggauggccagcguggagccccacuggauugcugcgucuaucauccuggaauuuuuccuuauggugcugcucauuccggagccugacagacagcggacaccccaggauaaccaacuggccuacgucgugaucggccugcucuuuaugauucuuaccguugcugccaaugagauggggcugcuggaaacaaccaaaaaggaccucggaaucggccacguggccgucgagaaccaucaccaugcugccaugcuggauguggaccuucacccugcguccgccuggacacuguacgcugucgccacgaccauuaucacacccaugaugcgccauaccauugaaaacacaaccgcuaauaucagccucacggccaucgcgaaccaggccgcuauucugaugggccuggauaaaggguggccuaucucuaagauggacauuggagugccccuccuugcccugggcugcuauucccagguuaauccgcugacccucacagcugccgugcugaugcuugucgcucacuacgccaucauugggccuggacugcaagcgaaagccaccagagaggcucagaagcggacagccgcuggcaucaugaagaaccccaccguggaugggaucguugccauugaccucgaucccguggucuaugacgccaaauucgaaaagcagcugggacagaucaugcugcucauucuuuguacgagccaaauccugcugaugcgcacaaccugggcgcucugcgagucuauuacacuggcuaccggcccucuuaccacacugugggagggcagcccggggaaauuuuggaauacgaccaucgccguguccauggcuaacaucuucagaggaucuuaccucgccggcgccgggcuggcuuucagccugaugaagucccucggaggcgggcggcgcggaacaggcgcccagggcgaaacccuuggggagaaauggaagagacagcugaaucagcugagcaaguccgaauuuaacacauauaaacggucuggaauuauggagguggacagaagcgaagcgaaggagggccucaaacgcggggagaccacgaagcacgccguuucccggggaacagcuaaacugagaugguucgucgaacgcaaucuugugaagcccgagggcaaggugaucgaucugggguguggacggggcggcuggucuuacuauugcgccgggcucaaaaaggucaccgaaguuaaaggauacaccaagggcgggccuggacaugaggaacccauuccuauggcuacauacggcuggaaccuggugaaacugcacagcgggaaggacguguuuuucauucccccugagaaaugugauacccuccuuugcgacaucggagaguccucuccgaaucccacaaucgaagagggcagaacgcugcgcguccugaagaugguggaaccuuggcuccggggcaaccaauuuuguauuaagauccugaaucccuauaugccuagcguuguggagacccuugagcagaugcagagaaaacaugggggaaugcugguccgcaacccccucucccggaauagcacacacgaaauguacugggugucuugcggcaccgggaacaucguuuccgccgugaauaugacaagcagaaugcugcugaaccgcuucaccauggcgcaccggaagccgacguaugagagagaugucgaccucggaaccggcacacgccauguggccguggaaccugaggucgcuaaccuggauauuaucgggcagagaauugaaaauaucaaacacgagcauaagucuaccuggcacuacgacgaggauaaccccuauaaaacaugggccuaccauggauccuaugaaguuaagcccagcggcucugcuuccagcauggugaauggcguggucaaacuucugaccaaaccuugggacgugauucccaugguuacacaaaucgccaugaccgauacgacaccuuuugggcagcagcggguguucaaggagaaagucgacacccgcaccccgaaggcuaaaagaggaacagcccaaaucauggaagugacggcgcgguggcucuggggcuuucuguccagaaacaagaagccccggauuuguacccgcgaggaguucacaagaaaaguucggagcaaugccgcuaucggggccguguuugucgacgagaaccaguggaacucugcuaaggaggccguggaagaugagcgcuucugggaccuuguucacagagaacgggagcugcacaaacagggaaagugcgcgaccugcguguacaacaugaugggcaaacgcgaaaagaagcucggggaguuuggcaaagcgaagggaagcagagcuauuugguacauguggcugggcgcccgguuccuggaguucgaagcccucggguuuaugaaugaggaucauugguucucccgcgaaaacucucugagcggagucgagggcgaggggcuucacaaacugggauauauccucagagacauuuccaagaucccuggcgggaauauguacgcugaugacacagccggcugggauacccggaucacagaagacgaucugcagaacgaggcuaaaauuaccgacaucauggaacccgagcaugcccuucuggcgaaggccauuuuuaaacucacguaucaaaauaaggugguccgcgugcagagaccugcuaagaacggaaccguuauggaugugaucucucggcgcgaccagagaggcagcgggcaggucggaacauacggccugaauaccuucacaaacauggaagcccaacugauucggcagauggaguccgaggggaucuuuucucccagcgaacucgagaccccgaaccuggcugaaagagcccuugauuggcuggagaaauauggaguggaacgccucaagcggauggcgaucuccggcgacgacugugugguuaaaccuauugaugacagauucgccacggcucugacagcccuuaaugauauggggaaggugcgcaaagacaucccccagugggagccuagcaagggcuggaacgauuggcagcaaguccccuuuugcucucaccacuuccaucagcugauuaugaaggacggacgggagaucgugguuccuuguagaaaucaggaugaacucgugggccgcgcucgggucucccagggggccggauggagccugagagagaccgcuugccugggcaaaucuuacgcccaaauguggcagcucauguauuuucaccgccgggaccugagacuugcggccaacgcuauuuguuccgccgugcccgucgauugggugccgacaagccgcaccacgugguccauccaugcccaccaucaguggaugaccacagaagacaugcugucuguuuggaaucggguguggauugaggaaaacccuuggauggaggauaagacccacaucagcuccugggaggacguccccuaccucgggaaaagagaagaccaauggugcggaagccugaucggccuuacagcucgggccaccugggcgacaaauauucagguggcuaucaaccagguuagacgccugauugggaaugagaacuaccucgauuauaugaccucuaugaagcgguucaaaaaugaauccgaccccgagggcgcccugugguga

SEQ ID NO: 18906 - RNA, 9879 nt, Artificial Sequence
  derived and/or modified CDS sequence (opt5) from DENV-1__FJ432742__SS-prME
agcgugaccaugcugcucaugcugaugcccaccgcccuugcuuuccaccugacgacccggggcggggaaccucauaugaucgugacaaagcaggaacggggaaaaucccuccuguuuaagaccucugccggcguuaacaugugcacacuuauugcgauggaccugggggaacucugugaagauaccaugacauacaaaugcccccgcaucaccgaagcugaacccgacgauguggacuguuggugcaaugccacggauaccugggugacauauggaaccuguagccaaacaggcgagcaccggcgggacaagcgcuccgucgcccuggcuccucauguggggcugggacucgagaccagaacggaaacauggaugucuagcgagggcgccuggaaacagauucagcggguugaaaccugggcucugcgccaccccggcuucacagugaucgcccuuuuucuggcgcaugccauugggaccuccaucacccagaagggaaucauuuucauccuccugaugcuuguuacaccuucuauggcuaugagaugcgugggcauugggagccgggauuuuguugagggacuguccggcgccacguggguggacgucgugcucgagcacgggagcugugugaccacaauggcuaaggauaaacccacccuggacaucgaacugcucaagacagaggucaccaacccugccguucugcgcaaacuuugcauugaagcgaagaucucuaauacgacaaccgauuccagauguccgacccaaggagaggccacacugauggaagaacaagacgcuaacuucgugugccggcgcaccuuuguggauagaggcuggggcaauggguguggacucuucggcaaagggagccugauuacaugcgccaaguuuaagugcgucacgaaacuugagggaaagaucgugcaguacgaaaaccugaaauauucuguuaucgugaccguccacacaggcgaccagcaucaaguggggaaugaguccaccgaacacggaacaaccgcuacgauuacaccccaggccccuacaagcgagauccagcucaccgacuacggcgcccugacacuggauuguucuccccggaccggccucgacuucaacgaaaugguucugcuuacgaugaaggagaaauccuggcuggugcauaagcagugguuucucgaucugccucuucccuggacaagcggggcuuccaccucucaagagacauggaaucgccaggaccugcucgucaccuucaaaaccgcgcacgccaagaagcaggaaguggucgugcugggaagccaagagggcgcuaugcacacagcccugacgggggccaccgaaauucagacauccggaaccacaaccaucuuugcuggccaucucaaaugcagacugaagauggauaaacuuacgcugaaggggaugagcuauguuauguguacaggcucuuucaaacucgagaaggaaguggccgagacccagcacggaaccguccuggugcagauuaaguacgagggcacagacgcgccgugcaaaaucccuuucuccacccaagaugaaaaggggguuacacagaacggacggcugaucacggcuaaucccauugugaccgacaaagagaagccugucaacaucgaagccgagccgcccuuuggcgagagcuauauugugaucggggccggagaaaaagcucuuaagcucucuugguucaagaaaggcagcuccauugggaagauguuugaggccacagcuagaggcgcccgccggauggcgauccugggagauaccgccugggacuucggcucugucgggggaguuuuuacaagcgucggcaaacuggugcaucagaucuucgggaccgcuuacggagugcucuuuuccggcgucagcuggacgaugaagauugggaucggcgugcugcuuaccuggcugggacucaauucuagauccacaagccugucuaugaccuguauugccguuggccuggugacacuuuaccucggggucauggugcaggcugauuccggaugcguuaucaacuggaaaggccgcgaacugaagugugggagcggaauuuucgugaccaaugagguccacacauggaccgaacaauauaaguuucaggccgacuccccuaaacggcugucugcggccaucggcaaggcuugggaggagggggugugcggcauuagaagcgccacgcgccucgaaaacaucauguggaaacagaucuccaacgagcugaaucauauucuucuggaaaacgacaugaaguucacaguuguggucggagauguggugggcauccucgcucaggggaaaaagaugauucggccgcaacccauggagcacaaauacucuuggaaaagcuggggaaaggccaagaucauuggcgccgacguccagaauaccaccuuuaucaucgaugggccuaacacacccgaauguccugacgaucagagagcuuggaauauuugggagguugaggacuauggauucggcaucuuuaccacgaacauuuggcugaagcugcgcgauuccuacacacaggugugcgaccaccggcuuaugagcgcggccaucaaagauucuaaggcugugcaugccgacaugggcuauuggauugaauccgagaaaaaugaaaccuggaagcucgccagagcuagcuucaucgaggucaagacauguaucuggcccaaaucucacacccugugguccaacggggugcuggaaagcgagaugauuaucccgaagauuuacggaggcccuaucucucaacauaauuaucgccccggguacuucacacagaccgccggaccuuggcaccucggcaaacuggagcuugauuuugaccugugcgaagggacgaccguuguggucgaugagcacugcggaaaccggggccccagccucagaacaaccacagugaccggcaagauuauccaugaaugguguugccgguccuguacgcugccuccccugcgcuucaaaggggaggacggaugcugguacggcauggagaucagaccgguuaaggaaaaggaggaaaaucuugugaaaagcauggucucugcgggguccggagagguggacagcuuuucccucggccugcuguguauuucuaucaugauugaagagguuaugcggagcagauggucccgcaagaugcucaugacagggacccuggcuguguuccuucugcucaucaugggacagcugacauggaacgaucugauucggcuuugcaucauggucggcgccaaugccucugacagaaugggcauggggaccaccuaucuggcucucauggccacauuuaaaaugcgcccuauguucgcggugggacugcucuuuagacggcugacgagccgcgaggugcuucugcucaccauuggccugucccuggucgcuucuguugaacuucccaacagccuggaggaacucggggauggacuggccaugggcaucaugauccucaagcugcuuacagacuuccaaucccaccagcugugggccacccuccugagccugacauuuauuaaaaccacgcuuucucugcauuacgcuuggaagacaauggccauggugcucuccaucgugagccuguucccccucugucugucuaccaccucccagaagacaaccuggcuuccuguccugcuggggagccucggaugcaaaccgcugacaauguuucuuauuacggagaauaagaucuggggcagaaaaucuuggccccugaacgaaggcauuauggcuguggggguuguguccauccuccugagcucccuccugaagaacgaugucccucuugccggaccccugaucgcgggcgggaugcugauugccuguuaugugaucagcggaucuagcgcugaccucucccuggagaaagccgcugagguuucuugggaagaggaagccgagcacagcggcgccucccauaauauucuuguggaaguccaggaugacgggaccaugaagaucaaagaugaggagcgggacgauacacugaccauucuccugaaggcuacacuccuggcggugucuggagucuacccucuuagcauccccgccacccuguucgugugguauuuuuggcaaaagaaaaagcagcgcuccggcguucugugggacacgccuucucccccggaaguggagagagcuguccucgaugacggcaucuaccggauuaugcagcgcgggcugcuuggaagaagccaggugggcguugggguguuccaagaaaacgucuuccacaccauguggcacgugacacggggagccgugcugauguaucagggcaaacgccucgagccuuccugggccagcguuaagaaagaccugaucucuuacgggggaggcuggagacuccagggcuccuggaauaccggggaggaaguccaggugauugcuguggagcccggaaagaacccuaagaauguccaaacagcccccggcaccuuuaaaacaccggaaggggaggugggagcgaucgcucuggauuucaagccuggcacgagcgggucucccauuguuaaccgggaaggaaaaaucgugggccuuuacggcaauggggucgugaccacauccggaaccuauguuagcgccauugcccaggcuaaggccucccaggagggcccucugcccgagaucgaagacgagguguuuagaaaacgcaaccugaccaucauggaucuccaucccgggucuggaaagacacggagauaccugccugcgauuguccgcgaagcuaucaagcggaaacuuagaacgcugauucucgccccgacccgcgugguugccagcgagauggcugaagcccugaagggcaugcccauccgguaucaaacaaccgcugugaaauccgagcacacagggaaggagauugucgaccugaugugccaugccaccuucacgaugagacuccuuagcccugugcgcgugcccaauuacaacaugaucaucauggaugaagcgcacuuuacagacccuucuuccauugccgcucggggcuauaucagcaccagagucggaaugggcgaggccgcugccauuuucaugaccgccacacccccugggucuguugaggcuuuuccgcagagcaaugcggugauccaggaugaggaacgggacauucccgagcgcuccuggaacucuggauacgaguggaucaccgauuucccuggcaaaacagugugguuuguccccagcaucaaguccgggaaugacauugccaacugucugagaaagaauggaaaacgggugauccagcugucucgcaagaccuucgauacggaauaucagaagaccaagaacaacgacugggacuacguugugaccacagauauuagcgagaugggcgcuaauuuuagagccgaccgggucaucgauccuagacgcugccucaaacccgugauucugaaggacgggccggaacggguuauccuugccggcccuaugcccgugaccgucgcuuccgccgcgcagagacgcggacggauuggcagaaaccauaauaaggagggggaucaguacaucuauaugggacagccccugaacaaugacgaggaucacgcucacuggacggaagccaaaaugcuccuggacaacaucaauaccccugagggcauuauccccgcccuguucgaaccugagcgcgaaaagagcgcugccauugauggggaguaccggcucagaggagaggcgcgcaaaacauucguggaacuuaugagacggggcgaccugccggucuggcugucuuauaagguggccuccgagggguuucaauacagcgaucgcagauggugcuucgacggcgaacggaacaaucagguucucgaggaaaacauggauguggagaucuggaccaaagagggagaacgcaagaaacugagaccccgguggcuugacgcuagaacauauuccgacccucuggcccuccgcgaguuuaaggaguucgcugccggccggagaucugugagcggggaucugauucuggagaucggaaagcucccccagcaucuuacccagcgcgcucaaaaugcccuggacaaccuggucaugcuccacaauuccgaacagggcgggcgggcguacagacaugccauggaggagcugccugauacaaucgaaacccuuaugcugcucgcucugauugccguucugacgggaggcgugacacucuuuuuccuuucuggccgggggcugggaaaaaccagcaucggccugcucugugugauggcuuccagcguccugcuuuggauggccucuguggagccccacuggauugccgcuuccaucauucuggaauuuuuccucaugguucugcugaucccggagccugaccgccagagaacaccccaggauaaccaacucgcguauguggucaucgggcuucuguuuaugauucugacaguggccgcuaaugagaugggacuccuggaaaccacaaagaaagaccuuggcaucgggcacgucgccguggagaaccaucaccaugccacgaugcuggauguugaccuccacccugcuagcgccuggacccuguacgcgguggccacaaccauuaucacacccaugaugcggcauaccauugaaaacacgaccgcuaauaucucucugacagccauugcuaaccaggccgcgauccucaugggacuugauaagggcuggccuaucuccaaaauggacauuggcgucccccugcuggcccucgggugcuacagccaggugaauccgcugacccuuacagcugccguucugaugcucguggcucacuaugccaucauuggaccuggccugcaagcuaaggccacccgcgaggcgcagaagagaacggccgcugggaucaugaaaaaccccacagucgauggaauuguggccaucgaccuggaucccgugguuuacgacgcuaaguucgaaaaacagcucggccagaucaugcuucugauucuguguaccucucaaauccuccugaugcggacaaccugggcccuuugcgagagcauuacccuggccacagggccucucacgacccugugggagggauccccgggcaaguuuuggaauacaaccaucgcggucucuauggcuaacauuuuccgcggcagcuaucuggccggggcuggacucgccuuuucccuuaugaaaagccugggcgggggaagacggggcacaggggcccagggagaaacccugggcgagaaguggaagcgccagcucaaucagcuguccaaaucugaguucaacaucuacaagagaagcggcaucauggagguggaccgguccgaagcuaaagaggggcuuaagagaggagagacgacacgccacgccgugucucggggcaccgcgaaacugagaugguucgucgaacgcaaucucguuaagcccgaggggaaggugauugaucugggauguggcagagggggauggagcuauuacugcgccggccugaaaaaggugaccgaagucaaaggcuauacaaaagggggaccuggccaugaggaacccaucccuauggcuaccuacggguggaaccucgugaaacuucacuccggaaaggacgucuuuuucacacccccugagaaaugugauacgcugcugugcgacauuggcgagucuagcccgaaucccaccaucgaagaggggagaacacuccgcgugcugaagauggucgaaccuuggcuucggggaaaccaauuuuguauuaagauccugaaucccuacaugccuuccgugguugagacccucgagcagaugcagagaaaacauggcggcaugcuggugcgcaacccccugagcagaaauucuacacacgaaauguauugggucuccugcgggaccggaaacauugugagcgccgugaauaugacgucuagaaugcuccugaaccgcuucaccauggcucaccggaagccgacauacgagagagaugucgaccuuggcgccgggacccgccauguugcgguggaaccugagguggccaaccuggauaucaucggacagagaauugaaaauaucaaacacgagcauaaguccacauggcacuaugacgaggauaaccccuacaaaaccugggcuuaucauggcagcuacgaagucaagcccucuggguccgccagcuccauggugaauggaguugugaagcuccugacaaaaccuugggacgucauucccauggugacccaaaucgcuaugacggauacaaccccuuuuggccagcagcggguuuucaaggagaaaguggacacccgcacaccgaaggccaaaagaggcacggcucaaauuauggaagucaccgcccgguggcuuuggggguuucugagcagaaacaagaagccccggaucuguacacgcgaggaguucaccagaaaagugcggucuaaugcggccaucggagcuguuuuuguggacgagaaccaguggaauagcgccaaggaggcugucgaagaugagcgcuucugggaccucgugcagaaagaaagagagcugcacaagcagggcaaaugcgccacaugcgucuauaacaugauggggaagcgggaaaagaaacugggagaguuuggcaaggccaaagggucccgcgcgauuugguacauguggcucggcgcuagauuccuggaguuugaagcccuuggauucaugaaugaggaucacugguucucucgggaaaacagccuguccggcguggagggggagggacuccauaagcugggcuacauccuucgcgacauuucuaaaaucccugggggaaauauguaugccgaugacaccgcuggcugggauacaagaauuaccgaagacgaucugcaaaacgaggccaagaucacggacaucauggaacccgagcacgcucuccuggccaccagcauuuuuaaacugacauaccagaauaagguugugcggguccagcgcccugcgaagaacgggaccgugauggaugugaucuccagacgggaccagcgcggcucuggacaaguuggcacauaugggcucaauaccuucacgaacauggaagcccagcugauuagacagauggagagcgagggaaucuuucuucccuccgaacuggagacaccgaaccucgcugaacgggugcuggauuggcuugagaaauacggcgucgaaagacugaagcgcauggccauuagcggggacgacugugugguuaaaccuaucgaugaccgguucgcuaccgcccucacagcgcugaaugauaugggaaaggugagaaaagacaucccccagugggagccuucuaagggcuggaacgauuggcaacagguccccuuuugcucccaucacuuccaccagcugauuaugaaggacgggcgcgagaucguggucccuugucggaaucaggaugaacucgugggcagagcccgcguuagccaaggagcuggcuggucucugcgggagaccgccugccuugggaaauccuaugcucagauguggcagcugauguacuuucauagacgcgaccuccggcuggccgcuaacgccauuuguagcgcggugcccgucgauugggugccgacguccagaaccacauggucuauccacgcccaucaccaauggaugaccacagaagacaugcuuagcguuuggaaucgcguguggauugaggaaaacccuuggauggaggauaagacccaugucuccagcuggggagacgugcccuaucugggcaaacgggaggaccaguggugcgggucucucaucggacugacagcuagagccaccugggccuccaauauucagguggcuaucaaccagguucggagacugaucggcaaugaaaacuaccucgauuacaugacgagcaugaagcgcuucaaaaaugagggggaccccgaaggcgcccugugguga

SEQ ID NO: 18907 - RNA, 9879 nt, Artificial Sequence
  derived and/or modified CDS sequence (opt5) from DENV-1__FJ410205__SS-prME
agcgugaccaugcugcucaugcugaugcccacagcccuugcuuuccaccugacgaccagaggcggggaaccucauaugaucgucuccaagcaggaacgggggaaaucucuccuguuuaagacaagcgccggcguuaacaugugcacccuuauugcgauggaccugggggagcucugugaagauacaaugaccuacaaaugcccccgcaucacagagaccgaacccgacgauguggacuguuggugcaaugcuacggauaccugggugacauauggaaccuguucccaaacaggcgagcacagacgggacaagcgcucugucgcccuggccccucauguggggcugggacucgagaccagaacggaaacauggaugagcuccgagggcgcuuggaaacagauucagcggguugaaaccugggcccugcgccaccccggcuucacagugaucgcucuuuuucuggcccaugcgauugggaccucuaucacccagaagggaaucauuuucauccuccugaugcuugucacaccuagcauggccaugagaugcgugggcauugggucccgggauuuuguugagggacugagcggcgcuacguggguggacgucgugcucgagcacgggucuugugugaccacaauggccaaggauaaacccacccuggacaucgaacugcucaagacagaggucaccaacccugcuguucugcgcaaacuuugcauugaagccaagaucuccaauacgacaaccgauagcagauguccgacccaaggagaggcgacacugguggaagaacaagacgccaacuucgugugccggcgcaccuuugucgauagaggcuggggcaauggguguggacucuucggcaaagggucucugauuacaugcgcuaaguuuaagugcgugacgaaacuugagggaaagaucguucaguacgaaaaccugaaauauuccgugaucgucaccgugcacacaggcgaccagcaucaaguugggaaugagagcaccgaacacggaacaaccgccacgauuacaccccaagcuccuaccaccgagauccagcucacagacuacggcgcccugacccuggauuguucuccccggacgggccucgacuucaacgaaauggugcugcuuacaaugaaggagaaauccuggcugguccauaagcagugguuucucgaucugccucuucccuggaccagcggggccuccacaucucaagagaccuggaaucgccaggaccugcucgugaccuucaaaacagcucacgcgaagaagcaggaagucgugguucugggaagccaagagggcgccaugcacacggcucugaccggggccacagaaauucagaccuccggaacaaccacgaucuuugccggccaucucaaaugcagacugaagauggauaaacuuacacugaaggggaugagcuaugugauguguaccggcucuuucaaacucgagaaggaacuggcugagacccagcacggaacaguccuggugcagauuaaguacgagggcaccgacgccccgugcaaaaucccuuucuccacacaagaugaaaaggggguuacgcagaacggacggcuuaucaccgcgaaucccauugugacagacaaagagaagccugucaacaucgaagcugagccgcccuuuggcgagagcuauauugugaucggggccggagaaaaagcccucaagcugucuugguucaagaaaggcagcuccauugggaagauguuugaggcuaccgccagaggcgcucgccggauggccauccugggagauacagcgugggacuucggcucuaucgggggaguguuuaccagcgccggcaaacucguucaucagauuuucgggacggcuuacggaguccuguuuuccggcgugagcuggaccaugaagaucgggauuggcgugcuucugacauggcucggacucaauucuagauccaccagccugucuaugacauguaucgccgucggccuugugacccucuaccuggggguuauggugcaggcugauuccggaugcgucauuaacuggaaaggccgcgaacugaagugugggagcggaaucuucgugacaaaugagguucacaccuggacggaacaauauaaguuucaggccgacuccccuaaacggcucucugcggccauuggcaaggcuugggaggagggggugugcggcaucagaagcgccacacgccuggaaaacaucauguggaaacagauuuccaacgagcuuaaucauauccugcucgaaaacgacaugaaguucaccgucgugguuggagauguggcuggcauucuggcccaggggaaaaagaugauccggccgcaacccauggaguacaaauauucuuggaaaagcuggggaaaggccaagauuaucggcgcugacguccagaauaccacauuuaucauugaugggccuaacacccccgaauguccugacgaucagagagcguggaauaucugggagguggaggacuacggauucggcauuuuuacgacaaacaucuggcugaaacuucgcgauuccuauacccaggugugcgaccaccggcucaugagcgccgcuauuaaagauucuaaggccguccacgccgacaugggcuacuggaucgaauccgagaaaaaugaaacauggaagcuggcuagagccagcuucaucgagguuaagaccuguauuuggcccaaaucucauacacugugguccaacggggugcucgaaagcgagaugaucauuccgaagaucuauggaggcccuauuucucaacacaauuaccgccccggguacuucacccagacggcgggaccuuggcaucugggcaaacuugagcuggauuuugaccucugcgaagggaccacaguggucguggaugagcacugcggaaaccggggccccagccugagaaccacaaccguuacgggcaagaucauccacgaaugguguugccgguccuguacacugccuccccuucgcuucagaggggaggacggaugcugguauggcauggagauucggccggugaaagaaaaggaggaaaaucucgucaagagcauggugucugcuggguccggagagguugacagcuuuucccugggccugcucuguaucucuauuaugaucgaagaggugaugagaagccgcuggucccggaaaaugcugaugaccgggacacuugccgucuucuuucugcucauuaugggacagcugaccuggaacgaucugaucagacuuugcauuauggugggcgccaaugcuucugaccgcaugggcauggggaccacauaccuggcccucauggcgacguucaagaugagaccuauguuugcuguuggacugcuguuccggcgccugaccagcagagaggugcuucugcucacaaucggccugucccuggucgccucuguggaacuucccaacagccuggaggaacucggggauggacuggccaugggcaucaugauucucaaacugcuuaccgacuuucaaucccaucagcugugggcuacacuccugagccugaccuucaucaagacgacauuuucucuucacuaugccuggaaaaccauggcuauggugcuguccauugucagccucuucccccugugucucucuaccacaucccagaagaccacauggcugccuguucuucuggggagccugggaugcaagccgcucacgauguuucugaucgccgagaauaaaauuuggggccggcgcucuuggccccuuaacgaaggcaucauggcgguggggaucguguccauucugcucagcucccugcucaagaacgaugucccucuggccggaccccuuaucgcuggcgggaugcugauugccuguuacgugaucagcggaucuagcgcugaccugucccucgagaaagccgccgagguuucuugggaagaggaagcugagcauagcggcgcgucccacaauauucugguggaaguccaggaugacgggaccaugaagaucaaagaugaggagagagacgauacacuuaccauccugcucaaggccacacugcucgcugugucuggaguuuauccucugagcauucccgccacccuuuucgugugguacuucuggcagaagaagaagcagcgguccggcguccugugggacacgccuucucccccggaaguggagcgcgccguccuggaugacggcaucuauagaauuaugcagcgggggcuccugggacgcagccaggugggcguugggguguuucaagaaaacgucuuccauaccauguggcacgugacaagaggagcuguucuuauguaccagggcaaacggcuggagccuuccugggccagcgugaagaaagaccucaucucuuacgggggaggcuggagacugcagggcuccuggaauaccggggaggaaguccaggugauugcgguggagcccggaaagaacccuaaaaauguucaaacagcucccggcaccuuuaagacaccggaaggggaggucggagccaucgcccucgauuucaagccuggcacgagcgggucucccauugugaaccgcgaaggaaaaaucgugggccuguauggcaauggggucgugaccacauccggaaccuacguuagcgcuaucgcccaggcgaaggcuucccaggagggcccucuucccgagauugaagacgagguguuucggaaaagaaaccugaccaucauggaucugcaccccgggucuggaaagacacgccgguaucucccugccauugucagagaagccaucaaacgcaagcugcggacgcuuauucuggcuccgaccagagugguugccagcgagauggcugaagcccucaagggcaugcccauccgcuaccaaacaaccgcggugaaauccgagcauacagggaaggagaucgucgaccugaugugccacgccaccuucacgaugcggcugcucagcccugugagaguucccaauuauaacaugauuaucauggaugaagcucauuuuacagacccuucuuccauugccgcucggggcuacaucagcacccgcgugggaaugggcgaggccgccgcuauuuucaugaccgcgacacccccugggucugucgaagccuuuccgcagagcaaugcugugauccaggaugaggaaagagacauccccgagcgguccuggaacucuggauaugaguggauuaccgauuucccuggcaaaacagugugguuuguccccagcaucaaguccgggaaugacauugccaacugucuucgcaaaaauggaaagagaguuauccagcugucucggaagaccuucgauacggaauaccagaagaccaagaacaacgacugggacuacguggugaccacagauauuagcgagaugggcgccaauuucagagcugaccgcgucaucgauccucggagaugccugaaacccgugauucucaaggacgggccggaacgcguuauccuggccggcccuaugcccgugaccgucgcguccgcugcccagcggagaggacgcaucggccggaaccacaauaaagagggggaucaguauauuuacaugggacagccccuuaacaaugacgaggaucaugcccacuggacggaagcuaagaugcugcucgacaacaucaauaccccugagggcauuauccccgcccuguuugaaccugagagagaaaagagcgcggccauugauggggaguaucgccugagaggagaggcucggaaaacauucguggaacucaugcgcagaggcgaccuuccgguuuggcugucuuacaagguggccuccgagggguuucaauauagcgaucggcgcuggugcuucgacggcgaaagaaacaaucagguccuggaggaaaacauggauguggagaucuggaccaaagagggagaacggaagaaacucagaccccgcuggcuggacgcucggacauacuccgacccucuugcccugagagaguuuaaggaguucgcugccggccgccggucugucagcggggaucucauccuggagauuggaaaacugccccagcaccucacccagagagcgcaaaaugcccuugacaaccuggugaugcugcauaauuccgaacagggcgggcgggcuuaucgccacgccauggaggagcucccugauacaaucgaaacccugaugcuucuggcucucauugccguucugacgggaggcgugacacuguuuuuccucucuggcagagggcuuggaaagaccagcaucggccugcugugugugauggccuccagcguccuccuguggauggcuucuguugagccccauuggauugcggccuccaucauccuugaauuuuuccugauggugcuccugauuccggagccugaccggcagcgcacaccccaggauaaccaacuggcuuacguggucaucgggcuccuuuuuaugauucugacaguggccgccaaugagaugggacugcucgaaaccacaaagaaagaccugggcaucgggcacguugcuguggagaaccaccaucacgccgcgaugcuugaugucgaccugcauccugccagcgcuuggacgcucuacgccguggcuaccacaauuaucacccccaugaugagacacacaauugaaaacaccacggccaauaucucucugaccgcgaucgccaaccaggcugccauucugaugggacucgauaagggcuggccuaucuccaaaauggacauuggcgucccccuucuggcucuggggugcuauagccaggugaauccgcucacacugaccgccgcuguucuuaugcugguggcccauuacgcgaucauuggaccuggccuccaagccaaggcuacacgggaggcccagaaacgcaccgcugccgggaucaugaagaaccccacggucgauggaaucguggccauugaccuggaucccguuguguaugacgcgaaguucgaaaaacagcugggccagaucaugcuccuuauucuguguacaucucaaauccugcucaugagaaccacaugggcucugugcgagagcauuacccuugccaccgggccucugacaacgcucugggagggauccccgggcaaguuuuggaauaccacaaucgcugucucuauggccaacaucuuccggggcagcuaccuggccggggcuggacuggccuucucccucaugaaaagccuuggcgggggacgcagaggcaccggggcgcagggagaaacacugggcgagaaguggaaacggcagcugaaucagcucuccaagucugaauuuaacaccuauaagagaagcggcauuauggagguggaccgcuccgaagccaaagaggggcugaagcggggagagacgacaaaacacgcugugucuagaggcaccgccaaacuucgcugguucguugaacggaaucuggucaaacccgaggggaaggugaucgaucucggauguggcagagggggauggagcuacuauugcgcuggccugaagaaagugaccgaagucaagggcuacacaaaagggggaccuggccacgaggaacccauuccuauggccaccuacggguggaaccugguuaagcuccauuccggaaaagacguguuuuucauucccccugagaagugugauacacuucugugcgacaucggcgagucuagcccgaaucccacgaucgaagaggggcgcacccugcgggugcucaaaauggucgaaccuuggcugagaggaaaccaauuuuguauuaagauccuuaaucccuauaugccuuccgugguugagacacuggagcagaugcagcgcaagcacggcggcaugcucgugcggaacccccugagcagaaauucuacccaugaaauguacugggucuccugcgggacaggaaacaucgugagcgcgguuaauaugaccucucgcaugcugcucaaccgguucacgauggcccacagaaaaccgaccuaugagcgcgauguggaccugggcgcugggacaagacacgucgccguggaaccugagguggcuaaccuugauauuaucggacagcggauugaaaauaucaagcaugagcacaaauccaccuggcauuacgacgaggauaaccccuauaagacaugggccuaccacggcagcuaugaagucaaacccucuggguccgcuagcuccaugguuaauggaguggugaagcugcucaccaagccuugggacgucauucccauggugacacaaaucgccaugaccgauacgacaccuuuuggccagcagcgcguuuucaaagagaagguggacaccagaaccccgaaagcgaagcggggcacagcccaaaucauggaagucacggcuaaauggcuguggggguuucuuagcagaaacaagaagccccggauuuguacccgcgaggaguucacaagaaaagugcggucuaaugccgcuaucggagccguuuuuguggacgagaaccaguggaauagcgccaaggaggcggucgaagaugagcgcuucugggaccuggugcauagagaacgggagcuccacaaacagggcaagugcgcuaccugcguuuacaacaugauggggaaacgcgaaaagaagcugggagaguuuggcaaagccaagggguccagagccauuugguacauguggcugggcgcucgguuccucgaguucgaagcccugggauuuaugaaugaggaucacugguucucucgcgaaaacagccuuuccggcguggagggggagggacugcauaaacucggcuauauccugagagacauuucuaagaucccugggggaaauauguacgcugaugacacagccggcugggauacccggaucacagaagacgaucuucagaacgaggcgcgcauuaccgacaucauggaacccgagcacgcccugcucgcuaaaagcauuuuuaagcugacguaucaaaauaaagucgugagaguccagcggccugccaagaacgggaccgugauggauguuaucucccgcagagaccagcggggcucuggacaggugggcacauacgggcugaauaccuucacaaacauggaagcucaacucauuagacagauggagagcgagggaaucuuuucccccagcgaacuggagaccccgaaccuugccgaacgcguccuggauuggcucgagaaguauggcguggaacggcugaaaagaauggcgaucucuggggacgacugugugguuaagccuauugaugaccgcuucgccacggcucuuacagcccugaaugauaugggaaaagugcggaaggacaucccccagugggagccuuccaaaggcuggaacgauuggcagcaaguccccuuuugcagccaucacuuccaccagcucauuaugaaggacgggagagagaucgugguuccuugucgcaaucaggaugaacuggugggccgggcuagagucucucagggagccggcuggucccugcgcgagaccgcuugccucggaaagagcuacgcccaaauguggcagcugauguauuuucaucggagagaccuucgccuggcggccaacgcuauuuguuccgccgugcccgucgauuggaucccgacaucucggaccacguggagcauucacgcccaucaccaguggaugaccacagaagacaugcucuccguguggaauagaguuuggaucgaggaaaacccuuggauggaggauaaaacccauaucagcucuuggggagacgugcccuaccugggcaagcgggaggaccaauggugcgggucccuuauuggacugacagcuagagccaccugggcgacaaauauccaggucgcuauuaaccaggugcgccggcucaucggcaaugaaaacuaccuggauuauaugaccagcaugaaaagauucaagaaugagucugaccccgaaggggcccugugguga

SEQ ID NO: 18908 - RNA, 9879 nt, Artificial Sequence
  derived and/or modified CDS sequence (opt5) from DENV-1__FJ410207__SS-prME
uccgugaccaugcugcucaugcugaugcccacagcccuugcuuuccaccugacgacccggggcggggaaccucauaugaucguguccaagcaggaacggggaaaaucucuccuguuuaagaccagcgccggcguuaauaugugcacccuuauugcgauggaccugggggaguucugugaagauacaaugaccuacaaaugcccgcgcaucacagaagcugaacccgacgauguggacuguuggugcaaugccaccgauacgugggugaccuauggaacauguucccaaaccggcgagcacagacgggacaagcgcucuguugcccucgcuccucauguggggcugggacuggagacaagaaccgaaacguggaugagcuccgagggcgccuggaaacagauucagcggguugaaacaugggcucuccgccaccccggcuuuauggugaucgcccuguuccuugcgcaugccauugggaccucuaucacacagaagggaaucauuuuuauccugcucaugcuggucaccccuagcauggcuaugagaugcgugggcauugggucccgggauuucguugagggacuuagcggcgccaccuggguggacgucgugcuggagcacgggucuugugugacaacgauggcuaaggauaaacccacccucgacaucgaacugcugaagacagaggucaccaacccugccguucuccgcaaacugugcauugaagcgaagaucuccaauacaaccacggauagcagauguccgacacaaggagaggccacccuuguggaagaacaggacgcuaacuuugugugccggcgcaccuucgucgauagaggcuggggcaauggguguggacuguuuggcaaagggucucucauuacaugcgccaaguucaagugcgugaccaaacuggagggaaagacaguucaguacgaaaaccuuaaauauuccgugaucgucacggugcacaccggcgaccagcaucaaguugggaaugagagcacagaacacggaaccacagcuaccaucacgccccaggccccuucuaccgagauucagcugacagacuacggcgcccucacccuggauuguagcccgcggacaggccuggacuuuaacgaaauggugcuccugaccaugaaggagaaaagcuggcuuguccauaagcagugguuccuggaucucccucugcccuggacguccggggcuucuacaagccaagagaccuggaaucgcaaagaccuucuggugacauuuaagaccgcgcacgccaagaaacaggaagucgugguucucggaucccaggagggcgcuaugcacaccgcccugacaggggccacggaaauccaaaccagcggaacaaccacaauuuucgcuggccaucugaagugcagacucaaaauggauaagcugacccuuaaagggaugucuuaugugauguguacgggcuccuucaagcuggagaaggaagucgccgagacacagcacggaaccgugcucguucagaucaaauacgagggcaccgacgcgccgugcaagauuccuuuuagcacacaggaugaaaaaggggugacccaaaacggacggcugaucacagcuaaucccaucgucacggacaaggagaaacuggugaacauugaagccgagccucccuucggcgagucuuauaucgugauuggggccggagaaaaggcucuuaagcucagcugguuuaaaaagggcuccucuaucgggaaaauguucgaggccaccgcuagaggcgcccgccggauggcgauucugggagauacagccugggacuuuggcagcaucgggggaguuuucaccuccgucggcaagcuggugcaucagaucuuugggacagcuuacggaguccuguucagcggcgucucuuggaccaugaaaauugggaucggcgugcugcuuacguggcugggacucaauuccagaagcaccucucuguccaugacauguauugccguuggccuggugacccuuuaccucggggucauggugcaggcugauagcggaugcguuaucaacuggaagggccgcgaacugaaguguggguccggaauuuuugugacaaaugagguccacaccuggacagaacaguauaaauuccaagccgacucucccaagcggcugagcgcggccaucggcaaggcuugggaggagggggugugcggcauuagauccgccacccgccucgaaaacaucauguggaagcagaucucuaacgagcugaaucauauucuucuggaaaacgacaugaaauuuacgguuguggucggagauguggcuggcauccucgcccaggggaagaaaaugauucggccucagccgauggaguacaaguauagcuggaaguccuggggaaaagccaagaucauuggcgcugacgugcaaaauacaaccuucaucaucgaugggcccaacaccccugaaugucccgacgaucagagagcguggaauauuugggaggucgaggacuacggauuuggcaucuucacaaccaacauuuggcugaaacugcgcgauagcuauacgcagguuugcgaccaccggcuuaugucugccgcuaucaaggauuccaaagccgugcacgccgacaugggcuacuggauugaaagcgagaagaaugaaacauggaagcucgcuagagccucuuucaucgaggugaaaaccuguaucuggccuaagucccauacacuguggagcaacgggguccuggaaucugagaugauuauccccaaaauuuauggaggcccgaucagccagcacaauuaccgcccuggguacuuuacccaaacagcgggacccuggcaucucggcaagcuggagcuugauuucgaccugugcgaagggaccacggugguuguggaugagcacugcggaaaccggggcccuucccucagaaccacaaccgucacaggcaaaauuauccacgaaugguguugccggagcuguacccugcccccucugcgcuuuaagggggaggacggaugcugguauggcauggagaucagacccgugaaggaaaaagaggaaaaucuuguuaagucuaugguguccgcugggagcggagaggucgacuccuucucucucggccugcuguguauuagcaucaugauugaagaggugaugcgguccagauggucucgcaaaaugcucaugacggggacacuggccgucuuuuuccuucugaucaugggacagcucaccuggaacgaucugauucggcugugcaucauggugggcgccaaugcuagcgacagaaugggcauggggacaaccuaccuugcccugauggcgaccuuuaagaugcgcccgauguucgcugucggacuccuguuuagacggcucacaucccgcgaggugcugcuucugacgauuggccucucucugguggccagcgucgaacugccuaacucccuugaggaacugggggauggacucgccaugggcaucaugauccugaaacuccugaccgacuuccagagccaucaacuuugggcuacacugcucucucugaccuuuauuaagacaaccuucucccugcacuaugccuggaagacgauggcuaugguucuuagcaucgugucucuguuuccccucugucuguccacaaccagccagaaaaccacauggcuccccgugcugcuugggucucugggaugcaagccucugaccauguuccucauugccgagaauagaaucuggggccggaaauccuggccgcugaacgaaggcauuauggcggucgggaucgugagcauccuucuguccagccuccugaagaacgauguuccccucgccggaccucugauugcuggcgggaugcuuaucgccuguuacgugauuucuggaagcuccgcugaccugucucuggagaaagccgccgaggucagcugggaagaggaagcugagcauuccggcgcgucucacaauauccucguggaaguucaggaugacgggacaaugaagauuaaagaugaggagcgcgacgauacgcugaccauccuucugaaggccacacuccuggcugugagcggagucuauccccucuccaucccugccacccuguucgugugguacuuuuggcagaagaaaaagcaaagaucuggcguccuuugggacacacccagcccucccgaaguggagcgggccguucuggaugacggcauuuaucgcaucaugcagagagggcugcucggacggucccaggugggcgucgggguguuccaggaaaacguuuuucauaccauguggcacgugacgcgcggagcuguccugauguaccaaggcaaaagacuugagccgagcugggccucugugaagaaagaccugauuuccuacgggggaggcuggcggcuccagggcagcuggaauaccggggaggaagugcagguuaucgcggucgagccuggaaagaaccccaagaaugugcagacagcuccuggcaccuucaaaacaucugaaggggaggugggagccauugcccuggauuuuaagcccggcaccuccgggagcccgaucgucaacagagaaggaaaaauugugggccucuauggcaaugggguugugacaacguccggaaccuacgucucugcuaucgcccaagcgaaggcuagccaggagggcccucugcccgagaucgaagacgagguguuccgcaaacggaaccuuacaauuauggaucugcacccuggguccggaaagaccagacgcuaucugcccgccaucguucgggaagccauuaagagaaaacuccgcacccugauccuugcucccacacggguggucgccagcgagauggcugaagcccugaagggcaugccuauuagauaccagacgaccgcggugaaaucugagcauacagggaaggagaucguugaccucaugugccacgccaccuuuacaaugcgccugcuguccccggugcggguccccaauuauaacaugaucauuauggaugaagcucauuucaccgacccuagcucuaucgccgcuagaggcuacauuagcacgcgggugggaaugggcgaggccgccgcuaucuuuaugacagcgacacccccuggguccguggaagccuucccccaaucuaaugcugucauucaggaugaggaacgcgacaucccugagagaagcuggaacuccggauaugaguggaucaccgauuuuccgggcaaaacaguuugguucgugcccucuauuaagagcgggaaugacaucgccaacugucuccggaagaauggaaaacgcgugauucagcuuuccagaaagaccuucgauacagaauaccagaaaaccaagaacaacgacugggacuacgucgugacgacagauaucagcgagaugggcgccaauuuucgggcugacagaguuauugauccucgccggugccugaaacccgugauccugaaggacgggccugaaagagucauucucgccggccccaugccggugaccguugcgucugcugcccaacgccggggaagaaucggccgcaaccacaauaaggagggggaucaguauaucuacaugggacagccucugaacaaugacgaggaucaugcccacuggacagaagcuaaaaugcuucuggacaacauuaauacccccgagggcaucauucccgcccucuucgaaccugagcgggaaaaguccgcggccaucgauggggaguauagacugcgcggagaggcuagaaaaacguuuguggaacugaugcggcgcggcgaccuccccgucuggcuuagcuacaagguggccuccgagggguuccaguauucugauagacgguggugcuuugacggcgaacgcaacaaucaaguccuggaggaaaacauggauguggagauuuggaccaaagagggagaaagaaagaaacugcggccuagauggcucgacgcucgcacauacagcgacccgcuggcccuucgggaguucaaggaauuugcugccggcagacgcuccguuucuggggaucugauccucgagaucggaaagcugccccagcaccugacccagcgggcgcagaaugcccucgacaaccuugugaugcugcauaauagcgaacaaggcgggagagcuuaucggcacgccauggaggagcugccugauacaauugaaacccucaugcugcuugcucugaucgccgugcucacaggaggcgucacccuguucuuucuguccggccgcgggcucggaaaaacgagcauuggccuucuguguguuauggccucuuccgugcugcucuggauggcuagcguggagccccauuggaucgcggccucuauuauccuggaguucuuucuuaugguccugcucaucccugagcccgacagacagcggacaccgcaggauaaccagcuggcuuacgugguuauugggcuccucuucaugauccuuaccguggccgccaaugagaugggacugcuggaaaccacaaagaaagaccucggcauugggcacgucgcuguggagaaccaccaucacgccgcgaugcuggaugucgaccuucauccugccuccgcuuggacccuguacgccguggcuacaacgaucauuacccccaugaugcgccacacaaucgaaaacaccacagccaauauuagccucaccgcgaucgccaaccaagcugccauccugaugggacuggauaagggcuggccuauuucuaaaauggacaucggcguuccccuccuugcucuggggugcuauagccaggugaauccucugacgcucaccgccgcuguccugaugcuuguggcccauuacgcgauuaucggacccggccugcaggccaaggcuacaagagaggcccaaaagcggaccgcugccgggauuaugaaaaacccgacaguugauggaaucguggccaucgaccucgauccugucguguaugacgcgaaguuugaaaaacagcugggccagauuaugcugcucauccuuuguaccucccagauucugcugaugcgcacgacaugggcucucugcgagucuaucacccuggccacagggccccuuaccacccugugggagggaagccccggcaaguucuggaauacaacgauugcuguguccauggccaacaucuucagaggcagcuaccucgccggggcuggacuggccuuuucccugaugaaaucucucggcgggggacggcgcggcaccggggcgcaaggagaaacacuuggcgagaaguggaagagacagcugaaucagcugagcaaauccgaguucaacaccuauaagcggucuggcaucauggagguugacagaagcgaagccaaagaggggcucaagcgcggagagacaaccaaacacgcugucucccggggcacggccaagcugagaugguuuguggaacgcaaucuugugaagccugaggggaaagucauugaucugggauguggcagagggggauggucuuacuauugcgcuggccucaagaaaguuacagaagugaagggcuacaccaaagggggaccgggccacgaggaacccaucccuauggccaccuacggguggaaccuggugaagcugcauagcggaaaagacgucuucuuuacacccccugagaagugugauacccuccuuugcgacauuggcgaguccagccccaauccuacaaucgaagaggggagaacgcugcgcgugcugaagaugguugaaccguggcuccggggaaaccaguucuguauuaaaauccugaaucccuauaugccuucuguggucgagacccuugagcaaaugcagagaaagcacggcggcaugcuggugcgcaacccccucucccggaauagcacacaugaaauguacuggguuucuugcgggaccggaaacauuguguccgcggucaauaugacaagcagaaugcugcugaaccgcuuuaccauggcccaccggaaaccuacguaugagagagauguggaccucggcgcugggacccgccacguggccgucgaacccgagguugcuaaccuggauaucaucggacagagaauugaaaauaucaagcaugagcacaaaucuacauggcauuacgacgaggauaacccguauaagaccugggccuaccacggcuccuaugaagugaagccuagcggguccgcuagcucuauggugaauggagucgugaaacuucugacaaagcccugggacguuauucccauggugacccagaucgccaugacagauaccacgccuuucggccaacagcgggucuuuaaagagaagguggacacacgcacccccaaagcgaagagaggcaccgcccagauuauggaaguuacagcuaaguggcucuggggguuccugagccggaacaaaaagccuagaaucuguacgcgggaggaauuuacccgcaaagugagauccaaugccgcuaucggagccgucuucguggacgagaaccaauggaacucugccaaggaggcgguugaagaugagcgguuuugggaccuugugcaucgcgaaagagagcugcacaaacagggcaagugcgcuacaugcgucuacaacaugauggggaagcgggagaagaaacucggagaguucggcaaagccaaagggagccgcgccauuugguacauguggcugggcgcuagauuccuggaguuugaagcccucggauucaugaaugaggaucacugguuuucccgggaaaacucucugagcggcguggagggggagggacuucauaaacugggcuauauccuccgcgacauuuccaagauccccgggggaaauauguacgcugaugacaccgccggcugggauacaagaauuaccgaagacgaucugcagaacgaggcgaaaaucacagacaucauggaacccgagcacgcccuucuggcuaagucuauuuucaagcucaccuaucagaauaaagucgugcggguucaacgcccugccaagaacgggacggugauggaugucaucagcagacgggaccagcgcggcuccggacaggugggcaccuacgggcugaauacauuuaccaacauggaagcucagcugauuagacaaauggagagcgagggaaucuucucucccuccgaacucgagacaccuaaccuggccggccgggugcuugauuggcuggaaaaacaugggguugagagacucaagcgcauggcgauuagcggagacgacuguguggucaaacccaucgaugaccgguuugccaccgcucugacggcccuuaaugauaugggcaaggugagaaaggacaucccgcagugggaaccuucuaaaggguggaacgauuggcagcagguucccuucugcucccaccacuuucaucaacugauuaugaaggacggccgcgagaucguggucccuugucggaaucaggaugagcucgugggcagagcucgcgucagccagggagccggguggucccugcgggaaacagcuugccugggaaaaucuuaugcccagauguggcaacucauguacuuccacagacgcgaccugcggcuugcggccaacgcuauuuguagcgccgugcccguugauugggugccuaccuccagaacaaccuggagcauccaugcccaccaucaguggaugacgaccgaggacaugcugucugucuggaaucgcguguggauugaagagaaccccuggauggaagauaagacacacaucuccagcuggggcgacguuccguaucucgggaaacgggaggaccaguggugcggaucucugauuggccuuaccgcuagagccacaugggcgaccaauauccaaguggcuaucaaccagguccggagacugauugggaaugagaacuaccucgauuacaugacaagcaugaagcgcuuuaagaaugaauccgacccugagggcgcccugugguga
